United States Patent 8,344,211 (PLANT NUCLEOTIDE SEQUENCES AND CORRESPONDING POLYPEPTIDES) - sequence listing, part 24

SEQ ID NO: 89805 - DNA, 808 bp, Zea mays
  misc_feature: Ceres CLONE 1577604
  misc_feature: Encodes the peptide sequence at SEQ ID NO. 89806
  misc_feature (484)..(484): n is a, c, t, g, unknown, or other
  misc_feature (631)..(631): n is a, c, t, g, unknown, or other
  misc_feature (700)..(700): n is a, c, t, g, unknown, or other
ctccccgcggtggcggccgctctagaactagtggatcccccgggctgcaggaattcgtctcacccctagaaaaaaatctgtggtcgcaacgtccccagtcgttgccgcgtgctatcttcctcctccctccctccttgccgcacgcgtcaaaccttgcaaagagagttcggtcgacggcgccagccggcgatggcagcgccgcgccaccgccagggccacattgcgcagtgccttggcaggatcctcgcctgccgtggcagcgccaccgccgccgtcgctgccggcccaggcggccgacggctcaccggcgcggagttcgtcgacggcgtgcggagcctggccgctggcgtcgccgaccgcggggtgcgccctggccacgtcgtcgccgccgtcgccctcaacagcgtcgagtacgtgcagctgttcctcgccgtcacctacgccggagccatcatcgcccctctcaactaccgctggagcttcnaggaggcggcgcaggcggtggagctcgtgcggccgacggcgttcgccttcgacggcgcgttcagctcctgggcgcttcggctgatggagggtgacaggttcccatccatcggcctctacctcctcctgggcgatccttgcagggacngccgcgctgctgcaggttgtgctgtacccattgccgacgtcacgggggagcctcggcggaactacggcngcggcggcgaagggagccccggtgtcggctccagacaacgtggcctctatatggcttcaccatcggaaacaccggggggggcccaagggccgtaacaataagcaaccc

SEQ ID NO: 89806 - protein, 201 aa, Zea mays
  misc_feature: Ceres CLONE 1577604
  misc_feature: SWISSPROT Homolog: EC 6.2.1.12 4-coumarate--CoA ligase
  misc_feature (99)..(99): Xaa is any aa, unknown, or other
  misc_feature (148)..(148): Xaa is any aa, unknown, or other
  misc_feature (171)..(171): Xaa is any aa, unknown, or other
MAAPRHRQGHIAQCLGRILACRGSATAAVAAGPGGRRLTGAEFVDGVRSLAAGVADRGVRPGHVVAAVALNSVEYVQLFLAVTYAGAIIAPLNYRWSFXEAAQAVELVRPTAFAFDGAFSSWALRLMEGDRFPSIGLYLLLGDPCRDXRAAAGCAVPIADVTGEPRRNYGXGGEGSPGVGSRQRGLYMASPSETPGGAQGP

SEQ ID NO: 89807 - DNA, 1151 bp, Zea mays
  misc_feature: Ceres CLONE 1577605
  misc_feature (13)..(13): n is a, c, t, g, unknown, or other
  misc_feature (14)..(14): n is a, c, t, g, unknown, or other
  misc_feature (63)..(63): n is a, c, t, g, unknown, or other
  misc_feature (69)..(69): n is a, c, t, g, unknown, or other
  misc_feature (1151)..(1151): n is a, c, t, g, unknown, or other
cttttttttgggnnattttttaatttaccatattggagaggaggaagtgggggggggcggctntcccanaaagaaaaagtgggactccccgcggtggcggccgctctagaactagtggatcccccgggctgcaggaattcgtctcacccctagaaaaaatctcgcggcggccctgcaaagctgcgatcaagaggtgcagaacagcggtgaagggtggaaacagagaacactaggcagaggcactagccgagccgagccgcgccaccacgaccacgagtccaccggcgagtggttggcgcaagttgtcaggtgagggggggcaccgcaccttccgcgccgcatcttgtcacacacttgttggagctgctgtatcctgtatgtattgcctgccgcccctggcttgtgctcatgggcgctgctgctgcggccaatgaaggggcgttgccggagccgtgcggcggcctgcggccgggagcggtgcccaccgggcgctacaagctcgtccgcagcgacgacgcgcctgccgtcgccgcggatctggaggccggcaccgccggcgccgtgcggacggctacccccaaggcgccacgtggcccaacgcccttctccggtctcccgggggcccggcgcccgaaccccgggcagcgccccttcgttcttcggcttcgaacgggggtttcacggcggggggaatcacccgggtcccgtgtgctgggaatggaatccaatgcgcaggagaaatggaatacccccccgggggggggcccattttggcggatgttaacccgcgggagcgaaaatggaaagaaaccaaaaaattcgccccgccccttgggggggaacaaggggggcgtgttaaaacccggcggtgggggaccgccaaagatatcttttgtgagcagagagggcgcgtgttttcacagtggcccccaccttgtcacctccacgggcggcgagagagtcccgcgcccccaggtggggccccccccggcggttagctacaagaagagagctcccccccgggaaaaaagatgtggggaaaacggcccctcctatagacaagaggggaattttgccctccccgttgggcccacaaaaaagccgggtttttgtggcctaggggaggtggggtccgctcgaagggggggggn

SEQ ID NO: 89808 - DNA, 820 bp, Zea mays
  misc_feature: Ceres CLONE 1577606
  misc_feature: Encodes the peptide sequence at SEQ ID NO. 89809
cggccgctctagaactagtggatcccccgggctgcaggaattcgtctcacccctagaaaaaagagcagtgcgacagagttccccgatcgaagcagattgaggtccactgtgctgtactgctgtgcggcaatcatggaagcaatccaccttgcctacgtgctcgtcttcctcttgcccatcctcctcctccgtctccggcgccgcgggcctcctccagtcaagcggccacgaacaacgacggcccactgcccgcaccccagcccggtcctgggcaacaccctccacttcatccgcaaccgccgccgcttcttcgactggtacgcggacatgctccgcgccgcgccatccggtgccatcgaagcgtggggggccttgggcgcgggccacgccgtcaccaccgccagcccgggcgacgtcgaacacctcctgcgcgccagcttcgacaagtacgccaagggcgcgctctttcgcgacgccaccgcggatctcatcggcgacgggctcttcgccggcgaacggccgcttctggagcctccgcggaaagctggggtcgcacgcctttctcgtcccggtccggtcccgcgggttcaccgaaagggttcctccaaagtgaacctggggcccgccgctttcctgggccgttcctggagacccggcaacccaaggaaagggggggggcccctggaaaccttcaagaacccccctgccccccgtttttgggtttccccaaacattttggccaaaatttcggtttttggggttgtggaggggccctgaaaaccccaaaaaaaacccccggggggggaaggaaatgcgcccc

SEQ ID NO: 89809 - protein, 214 aa, Zea mays
  misc_feature: Ceres CLONE 1577606
MEAIHLAYVLVFLLPILLLRLRRRGPPPVKRPRTTTAHCPHPSPVLGNTLHFIRNRRRFFDWYADMLRAAPSGAIEAWGALGAGHAVTTASPGDVEHLLRASFDKYAKGALFRDATADLIGDGLFAGERPLLEPPRKAGVARLSRPGPVPRVHRKGSSKVNLGPAAFLGRSWRPGNPRKGGGPLETFKNPPAPRFWVSPNILAKISVFGVVEGP

SEQ ID NO: 89810 - DNA, 788 bp, Zea mays
  misc_feature: Ceres CLONE 1577607
  misc_feature: Encodes the peptide sequence at SEQ ID NO. 89811
  misc_feature (696)..(696): n is a, c, t, g, unknown, or other
ccccgcggtggcggccgctctagaactagtggatcccccgggctgcaggaattcgtctcacccctagaaaaaatcgcaagcgcgaggtgagtccgcagcccgagctcccgcgctccttcctcgcctccccctctaattagaggctcctccgcgctctcggcgggggtttagctgccgtggcctgaggatttgtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaagttgagctggaggaccctgtggaaaacattggagctaaattggtcaggcaagctgcagctaagaccaacgatcttgctggagatgggacaaccacctctgtggtccttgctcaggggctgattgctgagggtgttaaggtggtagcagctggtgctaatcctgttcagattactcgtggtattgagaaacagctaaagcactagttgaagaactacngaagttgtctagggaggttgaagatagtgagcttgcagatgttgctgcagttagtgctggcaacactatgaaatgggtacatgatagcagag

SEQ ID NO: 89811 - protein, 160 aa, Zea mays; identical to SEQ ID NO: 85623
  misc_feature: Ceres CLONE 1577607

SEQ ID NO: 89812 - DNA, 834 bp, Zea mays
  misc_feature: Ceres CLONE 1577615
  misc_feature: Encodes the peptide sequence at SEQ ID NO. 89813
ctggagctcaccgcggtggcggccgctctagaactagtggatcccccgggctgcaggaattcgtctcacccctagaaaaagcccccggtgagctgccactgccagcttccccgtgcgcgagctgtgctgctgctcggcggcgcgcccactccccggccgctccctcgtcactccgcctgccggtaatcggtctctatatatataggtggttcgaggtgatcggcagaaccacacaggcaaagatggcgagcgtgcacaaggccaccacccttgttctcatgttctgcctgctagcgctggggagagcggaatacctcaagtacaagtacccaaagcagcccgtcgctgttcacatcaaggacctgctggggcggatgactctcgccgaaaagatcggccagatgacgcagatcgagagggaaaacgcctcggccgacgcgctggccaaatacttcataggtagcatgctgagcggcggatgcagcgtgcctgctcctcaggcgtctgctcaagcttgggccgccatggcgaccgagatgcagaagggcgctctttctacgcgtctggggtataccgatcacctacgggatcgatgcaatgcatgggcacaacaacgtcggaaaaagctactattttccctcacaacgtcgggcttggaacctccagggaacccggacctcgttaaagagaattgaagaaacaactgcctccttgaagttagagctactgggattttcctaacaccctttgctccctggaataggggtctggtagagatccagaatggggacggttgcctatcaaaaactaaaggggggggacccaaaggggtgt

SEQ ID NO: 89813 - protein, 150 aa, Zea mays
  misc_feature: Ceres CLONE 1577615
MASVHKATTLVLMFCLLALGRAEYLKYKYPKQPVAVHIKDLLGRMTLAEKIGQMTQIERENASADALAKYFIGSMLSGGCSVPAPQASAQAWAAMATEMQKGALSTRLGYTDHLRDRCNAWAQQRRKKLLFSLTTSGLEPPGNPDLVKEN

SEQ ID NO: 89814 - DNA, 835 bp, Zea mays
  misc_feature: Ceres CLONE 1577616
  misc_feature: Encodes the peptide sequence at SEQ ID NO. 89815
ggagctccccgcggtggcggccgctctagaactagtggatcccccgggctgcaggaattcgtctcacccctagaaaaagccgtctcagttctcatgtccgggtgaagaaaagaaaaatcctcctgttccctgactatcgctacccctccacatccagtggccatggtgaagaagcccaacgacgttgccaaggccgcggcgacctccgccgacgcggcagccaggccatccaaggcgaatccgtccacccctcagtcggtcaagacctcgaagtttaagaagcggaaggtcaaggccaaccgccagaagccagcggtagctgccgcagctgttgacgatgtcgccccggtaggcgcaggcactggggatggcgatgcatctgcatccgcggttttaccgcagccatccaatgttgctgaggcatcgcctgtggtgcaaacgccaaagtcgaccgcttttgttgaggcgtcacctgtggtacagacgcagaagacagccactgatgctgaagtaccggtgcattcaccaatgccagccactgctgaagcatcagctttgtcgccaaagccaaagccaaaaccagctcatgctaatgctgatgctgcagctgcaatttctgtcagcaagggcaaaggcgtgggtgctgataatagcgggggtgatggcagaatgaagagcacacaagagagggctaggagtggcaaggggcaggagtttggggatggaggaaaatttaaaggggaaaaaggcgcttttttgccaaacaaaaatgccctggggggctttggggccctttattgggaaaaatgaaccccaaaatatctccctggggcgc

SEQ ID NO: 89815 - protein, 215 aa, Zea mays
  misc_feature: Ceres CLONE 1577616
MVKKPNDVAKAAATSADAAARPSKANPSTPQSVKTSKFKKRKVKANRQKPAVAAAAVDDVAPVGAGTGDGDASASAVLPQPSNVAEASPVVQTPKSTAFVEASPVVQTQKTATDAEVPVHSPMPATAEASALSPKPKPKPAHANADAAAAISVSKGKGVGADNSGGDGRMKSTQERARSGKGQEFGDGGKFKGEKGAFLPNKNALGGFGALYWEK

SEQ ID NO: 89816 - DNA, 807 bp, Zea mays
  misc_feature: Ceres CLONE 1577617
  misc_feature: Encodes the peptide sequence at SEQ ID NO. 89817
  misc_feature (670)..(670): n is a, c, t, g, unknown, or other
  misc_feature (672)..(672): n is a, c, t, g, unknown, or other
  misc_feature (675)..(675): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacgtgctggcgtcccgcccgcggaaccccgtcgccgacatcatccgctacaactccacggacgtggccttcgcgccgtacggcgagtactggcgcacggcgcggaaagtggtcaacacgcacctgctcagcggcaagatggtcttctccaancngcnggagcgggaggaggaagtgcnccctgttggtggcgcggatccgcgacgctggcgaggcggtccccgggaacggccctcgacatgacggaactgctgggggggtaccccagcgacttcttgggcggcgcgtgg

SEQ ID NO: 89817 - protein, 199 aa, Zea mays
  misc_feature: Ceres CLONE 1577617
  misc_feature: SWISSPROT Homolog: EC 1.14.13.68 4-hydroxyphenylacetaldehyde oxime monooxygenase
  misc_feature (170)..(170): Xaa is any aa, unknown, or other
  misc_feature (171)..(171): Xaa is any aa, unknown, or other
  misc_feature (172)..(172): Xaa is any aa, unknown, or other
  misc_feature (179)..(179): Xaa is any aa, unknown, or other
MALEAAYDYLHVAVVQCTPTQAAAVLGVLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHVLASRPRNPVADIIRYNSTDVAFAPYGEYWRTARKVVNTHLLSGKMVFSXXXEREEEVXPVGGADPRRWRGGPRERPST

SEQ ID NO: 89818 - DNA, 1001 bp, Zea mays
  misc_feature: Ceres CLONE 1577619
  misc_feature: Encodes the peptide sequence at SEQ ID NO. 89819
  misc_feature (1001)..(1001): n is a, c, t, g, unknown, or other
acccgcggtggcggccgctctagactagtggatcccccgggctgcaggaattcgtctcacccctagaaaaagtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcaatgcaaggggtgctgtgagcagcacgcagtgtgtgctcccatcagatggtggggcggaggctcttgtcctcccaacatcctttcggaggaattatgctcgatcctaatgaagtcccctgccgccatttttgggtgggggtgcccgggactcagcttttttccctcctcaccagccacaggggccaccccctggcttgttccctcttggaagggagttttacgggcttctttgatcatcccccactgaagcaagctgtttttccgcgcgggggcgtggaaaaaagagacgtttgtgttaatgaagctccggtttacaccccccaccccttcccttcttaaccgtggcacacataccacaccctacaccccattcatccggcggggggggcggacccccacatcccccccccaagcggagataccggtgctgcaggttgactttgcgcgggagaacccaaatagtgtgcgtccgggggaggagggtagcactgtagtatctgcgttgcacgggggcgactagcagcccgccactctacatatgcgaactatatatcatagcgggaagagcctgtgaggaacataaatgtgtgacggagccgcataactcggatgtcccgatgacacatacattgtgatgatgtaatattagagcagaagaaagagaatgcttctattcattcttgtgtccn

SEQ ID NO: 89819 - protein, 83 aa, Zea mays
  misc_feature: Ceres CLONE 1577619
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFNARGAVSSTQCVLPSDGGAEALVLPTSFRRNYARS

SEQ ID NO: 89820 - DNA, 782 bp, Zea mays
  misc_feature: Ceres CLONE 1577623
  misc_feature: Encodes the peptide sequence at SEQ ID NO. 89821
agctccccgcggtggcggccgctctagaactagtggatcccccgggctgcaggaattcgtctcacccctagaaaaagtgatttaactttctccatagaaaccccatgaaaaagcgttctgggggcccccgcgtcgcctccgcctgggcgacacgggcggcgccccgctccccttgccgccgtcgcccgcaaatcctctctccctttcccttgccgccgccggaggggtctgccggaggccggctcggcccctaggatggcgacggcggggtgtttcgcgcggatctggtgggagttagcgcagctcatcggcggtggagcgcgcgcagcacggtacctatgggtggccgtggccgtgctggggcgcgccgtggcacgcgccgcggagctcgccgggcggcggctgaggcccaggcggccaggcgtggcggggcgtcgccgtgaggacgtcgtggcctgcctccgcgcctcgctcgaggatctgctccggtcgccgctgtcgtgcgctgtcggtgggggcttgggcgacgccgagctgtgcttctgcgaggcggaggccgtcgacgtgtgcgtcagcgggcagatctgtgcgggggtcggcgcacggcggcatgggcgactcagcgtagccggtgcgctggctgcggcgaggaaaaccactaggtggtgtgactgcggtggagctctggcggtgcggtcgcagctgctgctgcctgctcgggccttcagtgtggtctggaatggggcgggtggcctttgcggctgctgccgccctggatggca

SEQ ID NO: 89821 - protein, 175 aa, Zea mays
  misc_feature: Ceres CLONE 1577623
MATAGCFARIWWELAQLIGGGARAARYLWVAVAVLGRAVARAAELAGRRLRPRRPGVAGRRREDVVACLRASLEDLLRSPLSCAVGGGLGDAELCFCEAEAVDVCVSGQICAGVGARRHGRLSVAGALAAARKTTRWCDCGGALAVRSQLLLPARAFSVVWNGAGGLCGCCRPGW

SEQ ID NO: 89822 - DNA, 813 bp, Zea mays
  misc_feature: Ceres CLONE 1577626
  misc_feature: Translation starting site: 295
  misc_feature (469)..(469): n is a, c, t, g, unknown, or other
  misc_feature (715)..(715): n is a, c, t, g, unknown, or other
gcggtggcggccgctctagaactagtggatcccccgggctgcaggaattcgtctcacccctagaaaaaaaccaacagtgggagtgggacacacccgacagcgacaccaaccacgaggtacatcccctcctgcgctgcccgcctctccttcagatcgccgcctcgcactcgcacagtcgcactcgctccacttccattcccagcgaccccgcccgcccggaggcgtcgcacctgcacgccgcggcagcagccaagcctctctcgtctcgtgcggcaagcgccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcctccgctccgtccggcgaggtggcgtcgtcgtcccaggacggccgcggcntacgggaccgtgggcgggcccaacggccacgccatcgctcccgccacagacaccaagtccaccgccgtcgagaccaccgtcgagagggtgatcttcgacttccggttcctggcactcctcgccgtcgccgggtcactcgccggctccgtcctgtgcttcctcaatggctgtgtcttcatcaaagaggcgtaccaggtttactggtcgagctgtgtcaagggggttcatacggggcagatggtcctncaggtcgtcgaggccatcgatgtgtatcttgctggaacagtcatgctgatattttgggatggggtctctacggcctcttcatcagcaacgctcccgcc

SEQ ID NO: 89823 - DNA, 793 bp, Zea mays
  misc_feature: Ceres CLONE 1577627
  misc_feature: Encodes the peptide sequence at SEQ ID NO. 89824
ctcaccgcggtggcggccgctctagaactagtggatcccccgggctgcaggaattcgtctcacccctagaaaaaagccggtccagcccacagtccacgaggacacgatccccgacctctatcaggttcccctccccatcccggagagcaaaagcgcttctctcgctagcgagttcggcagtagaaaccctaaaaaaaaagacaccgccctctccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcgcacacgacctctttcagctcacgaaaatggatctcgggtccttgttctaagattcattctcttcaactgcggaaagaaagcgaaagcaaaaggaacagaaaatttttgatagagaactcgaggatatgatagaaaggctcattgggggagtgtgacagggaaattcagaggggccctaaaacggcttgcagatgatgatgccaatgcggctattggcgatatcgggcctctgagggtactctgaacgggatgacattactgcaagctgtcaaaacagaattaagggagaaaaatggcaggaaatttgatgccttttgatttttgaaaggggagatcttgatgaacaaaattaaaggcgcccaggaaagtagggggaaaaaagctaaaaagactaa

SEQ ID NO: 89824 - protein, 57 aa, Zea mays
  misc_feature: Ceres CLONE 1577627
MDAFRKQLDVLMGANRNGDVEEVSRNYYDRDVCRLFLAGLCAHDLFQLTKMDLGSLF

SEQ ID NO: 89825 - DNA, 861 bp, Zea mays
  misc_feature: Ceres CLONE 1577629
  misc_feature: Encodes the peptide sequence at SEQ ID NO. 89826
ctggagctccccgcggtggcggccgctctagaactagtggatcccccgggctgcaggaattcgtctcacccctagaaaaaacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgttttgggttgggacaaaaaaggtctcatggtccaactcccggccgggaatccggccggcaatcccggggaaaagagggtttttttttgaaaatatgtggaatagtgggaaggcggggcgaaggcggcgagagtgaaggtttcacggggaaagaggatggtgggggacaaggggtggagagggagtggatgcgtggcggagttaaaaatttgtgtggaaaagggtatatgaggagtaggacaaagggggggagtggggtgaaaggaaaaagatgcgcggagaagggtggaaaacacgaacgacgtggatgtaaagaacaaaaatagaatgagtcagactcgggatacggggctgagagagggggtgcacgtagtaggcgggtatttgaggaagaagatgag

SEQ ID NO: 89826 - protein, 115 aa, Zea mays
  misc_feature: Ceres CLONE 1577629
  misc_feature (16)..(113): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVLGWDKKGLMVQLPAGNPAGNPGEKRVFF

SEQ ID NO: 89827 - DNA, 820 bp, Zea mays
  misc_feature: Ceres CLONE 1577630
  misc_feature: Encodes the peptide sequence at SEQ ID NO. 89828
gcggtggcggccgctctagaactagtggatcccccgggctgcaggaattcgtctcacccctagaaaaagctcttgtcttcggaagtttcagatcctcgcatcgtccgcaccttatcctctcgactttacagtacctgctctcagctcctccctatctcaatggcatccgcgaatgccatctccaccgcctccctcctccggcccctctctcagggcagggcgacgaggtcacagcggttcgtggtgcgtgcgaacgccaaagacattgcctttgaccagaaatccagggcagcgctgcaggccggcgtcgagaagctggcaaacgccgtcggtgtcaccctcgggccacgagggaggaatgtggtgctcgatgagtacggcaaccccaaagttgtgaatgatggagtcactattgcccgtgctattgagctgtatgatccaatggaaaatgctggtgcagcattgattcgtgaggttgctagcaagaccaatgattcagctggtgatgggactacaactgcatccgtccttgctcgtgaatcatcaagctaggccttctgagtgtaacatctggtgcaaatcctgtatcactaaagaaaggatagacaaaactgtgcagggcctaaatcaggagcttggagataagtctagaccagtcaaggggtggtggtgatatcaaaagctgtgcatctatctctgctggcaatgatgaatttatcggattcatgatggctgaaacaatgacaaagtggggcctgatgggtgtctatcaattgaatcctctcgtcttttgagaccactgttgaagttgaaaaaggaa

SEQ ID NO: 89828 - protein, 130 aa, Zea mays
  misc_feature: Ceres CLONE 1577630
MASANAISTASLLRPLSQGRATRSQRFVVRANAKDIAFDQKSRAALQAGVEKLANAVGVTLGPRGRNVVLDEYGNPKVVNDGVTIARAIELYDPMENAGAALIREVASKTNDSAGDGTTTASVLARESSS

SEQ ID NO: 89829 - DNA, 798 bp, Zea mays
  misc_feature: Ceres CLONE 1577631
  misc_feature: Translation starting site: 222
  misc_feature (602)..(602): n is a, c, t, g, unknown, or other
  misc_feature (603)..(603): n is a, c, t, g, unknown, or other
ctccccgcggtggcggccgctctagaactagtggatcccccgggctgcaggaattcgtctcacccctagaaaaagtccccaacccacgcactgcccaccggtctctctcacacaacacagggatataagcccagtccacgagatctcccgtagaccagtggcgagggaagggaaggaacgaaacagagcccgatcctagcgacagggcagggaagatcgccatgatgatgatgggcgaaggcgtgagcgtgccgccgtggtcccaccacgtccccgtgagcggcgtcgacgtcggcgtcggcggagacgagatgacgccgtacctactggcggcgctgcggcagtacctgccgtgcaacgacgccggcgccgccgaggcggacgacgaggaggcggcggccatggccgcgggcgtggacggctacggctgcgacgagttccgcatgtacgagttcaaggtccggcggtgcgcccgcgcgcgcagccacgactggaccgagtgccccttcgcgcaccccgggggagaaagcgcggcggcgcgactcgcgcaggtaccactactcgggcgccgcctgcccggacttccgcaaggggcgggtgcnnagcgcggcgacgcctgcgacttcgcgcacggcgtcttcgagtgctggctccacccggcgcgctaccgcacccagccctgcaaggacggcacggcctgcccgcgccgcgtctgcttcttcgcgcacaccccggacccagctgtcgggtgctccccgccacgccgcagcagtctagcgccagccccagggggcgccg

SEQ ID NO: 89830 - DNA, 831 bp, Zea mays
  misc_feature: Ceres CLONE 1577632
  misc_feature: Encodes the peptide sequence at SEQ ID NO. 89831
ggagctccccgcggtggcggccgctctagaactagtggatcccccgggctgcaggaattcgtctcacccctagaaaaacttgctcgctgcgccgccgcctccgacatcgtcccttcgtccccacgagcaaccgataatccgccggcgttgagatgttggtttatcaggatctcctatctggcgacgagctcctgtcggattcattcacctacaaggagctcgagaacggcgtcctgtgggaggtcgagggaaagtgggtcacccaaggtcctgttgatgtggacattggtgccaatccatccgccgagggtggtgaggacgaaagcgttgatgacacagctgtgaaggtggttgatattgttgacacattccgtctacaggagcaacctccttttgacaagaaaataaaaaaaaaaaaaaaatcatttgtgtcttacatcaaaaaatacatcaagaatctcactgctgtgttggagccagagaaagcggatgagttcaaaaagggtgtcgagggtgcaaccaagtttctccttagcaagctgaaggacctccaattttttgttggtgagtccatgaaggatgatgcgtctgtggtattcgcctattacaaggatggtgccactaatccgacattcctctatttctctcatggtcttaaggagatcaagtgctaggcgtgcggcgaaattagttacccatgttgggtactatctatgtactattattatatcaaaaactatagttgtcctggctgaattgaactcaaaagggtttgtttgagaaaaaattgcccaagatgggattgcttgttaagctcaatattgggattgc

SEQ ID NO: 89831 - protein, 173 aa, Zea mays
  misc_feature: Ceres CLONE 1577632
  misc_feature (1)..(170): Pfam Name: TCTP Pfam Description: Translationally controlled tumour protein
MLVYQDLLSGDELLSDSFTYKELENGVLWEVEGKWVTQGPVDVDIGANPSAEGGEDESVDDTAVKVVDIVDTFRLQEQPPFDKKIKKKKKSFVSYIKKYIKNLTAVLEPEKADEFKKGVEGATKFLLSKLKDLQFFVGESMKDDASVVFAYYKDGATNPTFLYFSHGLKEIKC

SEQ ID NO: 89832 - DNA, 901 bp, Zea mays
  misc_feature: Ceres CLONE 1577634
  misc_feature: Encodes the peptide sequence at SEQ ID NO. 89833
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (52)..(52): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
ttttttttgttggtgaggactcatcgtcagcnnaaanaaagaaaaaaaaaangtggnnnnnnnnnnnnnnnnnnnnnaaaactggactccccgcggtggcggccgctctagaatagtggatccccgggctgcaggattcgtctcacccctagaaaaaaaattcggcctatcacaaccacttactctcgtgcgctctccgtgggagcgaggactcgcggccggcgcagcggcaggttctcctagatctccggcatcatcagtaacaaatggctgacggtgaggacattcagccccttgtttgtgacaatggaactggcatggtcaaggctggttttgctggtgacgatgcgccaaaggctgttttccccaagcaattgtcggacgcccccccgtcacactgggtgtaaatggttttggcatggggggcaaaaaaggaatgcctttatgttttggggtaaacaaaaggccccccgttcccaaaaaagggggggaattccccctggacctttttttggaaaaaaaaacccccccccctttttgaaaaaaaaaaaagggggggaaaattttttgttttcttaaccccaaaaattttgggggaggagaaaaaacaacaccccggggggaaaaaaaaaaaaaaataaataattttgggggagcaaacaccaaccccaccccccttttttctctttttttattgttgggaaaaaccccccccggggaggggagggcgcccccccctcttaaaaaaaaaaacacaccccccctttgtgggtttctcttcttttataaaaagggaaaaaaaaccccccccctttttttttaacacccccccaaaaaaagtttttttaaagagggggggggaaaaaaaaaaataaacccccccccaaaatttgtagggggg

SEQ ID NO: 89833 - protein, 46 aa, Zea mays
  misc_feature: Ceres CLONE 1577634
  misc_feature: SWISSPROT Homolog: EC 2.7.10.2 Non-specific protein-tyrosine kinase
MADGEDIQPLVCDNGTGMVKAGFAGDDAPKAVFPKQLSDAPPSHWV

SEQ ID NO: 89834 - DNA, 786 bp, Zea mays
  misc_feature: Ceres CLONE 1577636
  misc_feature: Translation starting site: 198
  misc_feature: SWISSPROT Homolog: EC 1.4.1.2 Glutamate dehydrogenase
  misc_feature (681)..(681): n is a, c, t, g, unknown, or other
tggagctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttggttccacatcaagaacgcagtggtgacagtgccggcctactttcacgactcgcagaagcaggccaccanggacgccggtgtcattgcgggcctcaatgtgatgcgtatcatcaacgagcccactgctgctgctatttgctacggtctttgacaggagggcaccagctcgggcga

SEQ ID NO: 89835 - DNA, 2247 bp, Zea mays
  misc_feature: Ceres CLONE 1577637
  misc_feature: Encodes the peptide sequence at SEQ ID NO. 89836
gccatttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgtgtgccgacgccggcgacgtcgtcgtcgagctcccggggttcccgggcggcgccgaggcgttcgaggcctgcgccaagtactgctacggcatcaccatcacggtgagcgcgcgcaacctggtcccgctgcggtgcgcggcggcgcacctcggcatgtcggaggccgccgacaggggcaacctcgcggccaagctcgacgcgttcctcgcctcctgcctcctgcgccgctggaaggacgcgctgggcgtgctccactccacgcgccaccacgccccgctctgcgaggacctgggcctcacgtcccgctgcgtcgacgccgtggccgccctcgtcgccagcccggacaccgccccgacgtccacgtcggcgtcgccgtggtgggcgcacgacgtcgccgagctcggggtcgacctcttctggcggatcatggtcgccgtcaaggccaccggcgccgtccacgagaagaccgtcggcgacgcgctcaaggcgtacgcgcgccggtggctgcccaacgtcgccaaggaccagccgctcgaccgcgacgccgcggacgtgaagcaggtcgccacgaggcaccgcctcctgctcgagaagatcgtcagcctgctccccgcggagagggacgccgtctcctgcggcttcctgctcaagctgctcaaggccgccaacatcctgggcgcgtccaaggcgtccagggcggagctggtgaggagggtggcgtggcagctggaggaggccagcgtctccgacctgctcatcccgtcgctgtcctgcgtcagcgacacgctgtacgatgtgggcgccgtgtcggccatcctcgacgagttcgcgctgcggtgcgccgcgctcccgccggcgccggcgctggctctgtccgggagcctcgacgacagcccggcgcactcgggcggccaccggcggtcccgttcggcggagagcgtgagcttcgacggcacgcgacgctccttgtcggccgcacccgtgtcgcagggcggtctggtgcaggtgggcaagttggtggacgggttcttgattgaggtcgcaaaggaccccaacatgccgatggacaagctgctcgccattgccgaggccgtgccagacagcgcccggccggagcacgatggcatgtacaaagtcgtcgacacatacctcaaggcgcatccggagatgagcaaaagcgtgagaaagcggctgtgccgggtgctcaactgccggaagctgtcggagaaggcgtgcgcgcacgcggcgcagaacgagctcctcccgctgcgcgtggtggtgcaggtgctgttcttcgagcacgcgcgcgccgcggcgctggcgtcgggcgggcacgccgtggccgcggcggcggacctgccgagcaacatccgggcgctgctgtccaagtccgggtcgtccgaggacgacgaggcggaccgcgtcgacgagcagcggctccgggcgctggccgccggcgcgtcccccggcgacgactggagcgtggagggcctccgtcgcgcggcgtccaagatcgccacgctgcggatgaagctggcggaggacgaggacgaggaccgtgacgccgacgagttcgcgcgcaaggccgggctaccgcgcagcgcgtcgctgcggttcagggcgttctgcgccatccccgccgggaagccgaggcggatgctcagcaagctgtggccgctgggcagaagcggcgttagccactagtagcagacagtgttagctcctgtgatctcctgtttctctctctctcgttttcctgagggtgatttgtctgtctcttctacgagttcctcctctctctctctctctctctctctctctctctctctctctctctttgttacgctttcaaggcaaattgtaccttgcatgtagttgtaatctcaacgggcacaatcaaagatagaaattgcacaggcaaaaa

SEQ ID NO: 89836 - protein, 624 aa, Zea mays
  misc_feature: Ceres CLONE 1577637
  misc_feature (181)..(469): Pfam Name: NPH3 Pfam Description: NPH3 family
MKFMRLGTRPDTFFAAADSVRSVCTEVATDLQILVDNCLYHLHKFPLLSKCMLLQALCADAGDVVVELPGFPGGAEAFEACAKYCYGITITVSARNLVPLRCAAAHLGMSEAADRGNLAAKLDAFLASCLLRRWKDALGVLHSTRHHAPLCEDLGLTSRCVDAVAALVASPDTAPTSTSASPWWAHDVAELGVDLFWRIMVAVKATGAVHEKTVGDALKAYARRWLPNVAKDQPLDRDAADVKQVATRHRLLLEKIVSLLPAERDAVSCGFLLKLLKAANILGASKASRAELVRRVAWQLEEASVSDLLIPSLSCVSDTLYDVGAVSAILDEFALRCAALPPAPALALSGSLDDSPAHSGGHRRSRSAESVSFDGTRRSLSAAPVSQGGLVQVGKLVDGFLIEVAKDPNMPMDKLLAIAEAVPDSARPEHDGMYKVVDTYLKAHPEMSKSVRKRLCRVLNCRKLSEKACAHAAQNELLPLRVVVQVLFFEHARAAALASGGHAVAAAADLPSNIRALLSKSGSSEDDEADRVDEQRLRALAAGASPGDDWSVEGLRRAASKIATLRMKLAEDEDEDRDADEFARKAGLPRSASLRFRAFCAIPAGKPRRMLSKLWPLGRSGVSH

SEQ ID NO: 89837 - DNA, 1192 bp, Zea mays
  misc_feature: Ceres CLONE 1577639
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (957)..(957): n is a, c, t, g, unknown, or other
  misc_feature (1010)..(1010): n is a, c, t, g, unknown, or other
  misc_feature (1074)..(1074): n is a, c, t, g, unknown, or other
gttgagaggggtgggcgggccacacccccactaacaatcataccctcccccaataaaataatttttttttnnnnnnnnaaaaactggtactcaccgcggtggcggccgctctagaactagtggatcccccgggctgcaggaattcgtctcacccctagaaaaacatttccgagaccagcgggagcgatcttgcaacgaaatcccatcagagggaggctcgagccctcggaccccgtcgccaggggaccgggtccggcagatcacccgcaggtacttttgggcgtgcctctgggcccctagccgacccctaacgaacggggcacggacgtccactcggattacccgcttgcagctcaccggagaccccatgttcggtgcccatcgagggtagcatggggctctcccccccctcctccttgcggaaaggcgacgtaggggcgaacgtaaaaaaccgagtctgtccctgatcgtcctctccccctattgcccaggctcgggggggctgctctcacatgacccggtctctgggccaaatccgtggaaccagcgtcatacttaaccagccccgaaaaaccttggggcccccgaacccgcgggcaccccgggggcgtacgggaccaaggtgtccccaatggtaaggggaaacccagccccggaaacgccgggcgaggaaaggcgggtggtaccccctctaagggcccaactttacaatacacctcctcctaataaagggcaagattggtaaaaacaatttaaccattcacctcctacaccagaagaaggggccctctctctaggggggagtggggcctatgtcaccatatctcaaccccagggacccatggggaagggtcctcgcatccaacagcgtcgccgcgtgtctaacgatctctctcctgaatgagatataatgcgaggactcccatcgtgccctagtgagctaaccaaatcacgtantgcgcacggcgtgtcccacccgcgaaggagtgtgaagctgcgaatacctcacngactacaactctagagagagggctttatatttgtggacaccgagataactaggctaggacgcgngaagaggcagtggtaggacggaacatccagacctgaacactgagcatacggagaaccaatcgccgattccagtgaccttctcctcacctcgtatcgcggcgcactctataatctcctg

SEQ ID NO: 89838 - DNA, 1178 bp, Zea mays
  misc_feature: Ceres CLONE 1577640
  misc_feature: Encodes the peptide sequence at SEQ ID NO. 89839
  misc_feature (56)..(56): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (802)..(802): n is a, c, t, g, unknown, or other
  misc_feature (967)..(967): n is a, c, t, g, unknown, or other
  misc_feature (1178)..(1178): n is a, c, t, g, unknown, or other
aaaatagggacgatagggctatccccccctgatgtagaaaagagaatcctttcccncccnnncnnnnnnnnacaagctggaactccccgcggtggcggccgctctagaactagtggatcccccgggctgcaggaattcgtctcacccctagaaaaaaccctccctgtatccctctgaccctctcggcggcgactgggcgacagccgctgtctcactacgcctggtgcccaggtatctctgccggcgacgagcacctgccagctgcaggggtatgggaatggaggtcgttggtgctgaagcagcaccagcagagatcaaagtatctgatgatgtgaatctattccaagagaaggaaagcaaagcaactgctaaagaacgtgaggaggcagctgtttttggttcagaagacaactaccaatggtcactgatctggcacctccaacggatgtgaaggatgagtggcctgaacctaaccaaacttatgcctttctacttcatcaagggcccgctcatttggggaatcctaaactggaggggaaaacctcggagccaagcttgaacaaagaatttcccacgaagaaggatcccaagcttccgtttcttaaactttatccgcaggccagtttgaggaagctcaaggaaagggcaggaaagccgcctcccaaggtaattattgcccccggcgaaccctgaaaaagccccattttggaggcggcctttggaagaaaaccaaaggccgcaatctataaacatgggcacaatttatggtgtgcagtttggacccaaaagcgtatcgaaaagngggaaaagtatttgggaagccctcctcctttttctcagggaagaccacaactcttttggggcccacgaaaagtttttctcgttgggagtgaagagaaaagcccattggccccacttggagaaagagccaccctaagatagttggccaagtgttttttattacccnccctttgcctattcctcaagaagcccttttggacctcctcacccgagtccaagagatgtgctttaaaaagggttcccccactctctaacactgtgggaggagctaatgcctcttttattcttaacggaaaaaaagcccttcttttggctgaaaagaaaaattaacaaagacctttttataaaaacccccaattcgttaaatagtcttcttn

SEQ ID NO: 89839 - protein, 59 aa, Zea mays
  misc_feature: Ceres CLONE 1577640
MGMEVVGAEAAPAEIKVSDDVNLFQEKESKATAKEREEAAVFGSEDNYQWSLIWHLQRM

SEQ ID NO: 89840 - DNA, 816 bp, Zea mays
  misc_feature: Ceres CLONE 1577646
  misc_feature: Encodes the peptide sequence at SEQ ID NO. 89841
ccccgcggtggcggccgctctagaactagtggatcccccgggctgcaggaattcgtctcacccctagaaaaccccctagaaaaaaaatctggaatcctttcacgccgccactctcccctttttccttctctcttcgtcgttgtggctcctgccttcctgcctcggcgcatcgactcgcggagagggacagcacagcgcctcctccccatcctttctccattcccagatcgaaggtccatgtgagtattgcgtgaatcttgcaaggtttggttccgtcgcggtttctggttttcttgctgattggttgcctgaatctttgccgagacctgaaattcgagagatgtaggaagtttaaaacacgagtcaggtaccaagcaccgagtatttgcaagatccgcaccggttccaagctagaattgttccacctattgatcctgtataataccgcttcgtagttttttcctccgttgctgaatcttctccagtaatttggtgtgcagaaaaaaccatccttttgcatctgattgagcactgtctttgtgcaagagaacaatttagttgtacatacaaacaagagagaagtgcgagtatttttcagagtttattagaagagactgtttcgacggaccaggtcagagaaaggccatgagctttagcagcggcaatggtctggacaatggacccgcaggtggacgtccacgacgactgggtgtcagccttggtgccgctgatgaacctgctgtcgcctggcggtgatcggcctgctcatcgccaacccggggggtccagggcggggccagtgtcctccttcaagca

SEQ ID NO: 89841 - protein, 50 aa, Zea mays
  misc_feature: Ceres CLONE 1577646
MVWTMDPQVDVHDDWVSALVPLMNLLSPGGDRPAHRQPGGSRAGPVSSFK

SEQ ID NO: 89842 - DNA, 841 bp, Zea mays
  misc_feature: Ceres CLONE 1577652
  misc_feature: Encodes the peptide sequence at SEQ ID NO. 89843
  misc_feature (211)..(211): n is a, c, t, g, unknown, or other
  misc_feature (212)..(212): n is a, c, t, g, unknown, or other
  misc_feature (253)..(253): n is a, c, t, g, unknown, or other
  misc_feature (314)..(314): n is a, c, t, g, unknown, or other
  misc_feature (327)..(327): n is a, c, t, g, unknown, or other
  misc_feature (386)..(386): n is a, c, t, g, unknown, or other
  misc_feature (403)..(403): n is a, c, t, g, unknown, or other
  misc_feature (584)..(584): n is a, c, t, g, unknown, or other
  misc_feature (596)..(596): n is a, c, t, g, unknown, or other
  misc_feature (841)..(841): n is a, c, t, g, unknown, or other
tggagctccccgcggtggcggccgctctagaactagtggatcccccgggctgcaggaattcgtctcacccctagaaaaaaccgcactccagcgttcagcattagacacgagagctcctagtagccagaccagtagtcccgcgaccctgtcgagagaaacagacagagcaacatggcgcctgcattgtcattcccgatcatcgacatggggnnctgctcgccggggaggagaggccggcggcgatggagctgcngcaagatgcgtgcgagaactggggcttcttcgaggtagatgctcagcatggatggagaacntgatccactccanggaactgaaacaaaataattaagctgcacaaatataccactctatctgtttttatcgtntgatgatggtgctctantctgttttctttaatcctattattccctcctgcccctgcagattctgaaccacggcatctcgacggagctgatggacgaggtagagaagctgaccaaggagcactacaagcgggtgcgcgagcagaggttcctccgagttcgccagcaagacgctcgggggacggccgcgacttgtcgcanggcgtgaaggcngagaacctgggactgggagagcaccttcttcgtccgccacctcccggagccccacatcgccgagataccggactgggacgacgattacccgcgcgtcatgaaaccgttcgccggcgagctggaagcgctggcggaacggctgctggacctgctgtgcgaggacctcggcctcgacaggggctacttggcgcgcgcggtccgcggggcccagcagggcgccccgacgttcggcaccaagtcagcan

SEQ ID NO: 89843 - protein, 49 aa, Zea mays
  misc_feature: Ceres CLONE 1577652
MKPFAGELEALAERLLDLLCEDLGLDRGYLARAVRGAQQGAPTFGTKSA

SEQ ID NO: 89844 - DNA, 1147 bp, Zea mays
  misc_feature: Ceres CLONE 1577655
  misc_feature: Encodes the peptide sequence at SEQ ID NO. 89845
  misc_feature (45)..(45): n is a, c, t, g, unknown, or other
cacaaaaaatgtagagttagtgacccccgaggaaaatgacgcacngtatttggtgtgtggggttagaggtatgatttttaaactggagctcaccgcggtggcggccgctctagaactagtggatcccccgggtctgcaggaattcctctcaccccttgaagctgctcaggtcgctctacgccgcgctccgcttcctcccggcttaccgcgccttccgcaggctctgcgcgtctggccaggtgtacaactactgcatgggccaccgcgtcggatccttcaacgagcccttctcccgcgccgaggaggcggccatgcgcacaatacgcctcgcccccgtcgagacccagctcggacgcctcgtcgtctccgtccagtacgtccccagcctcgccacctaaaacttcgagggcacttccctcgagtccgccgcgatcatcaaggattacctcggcagccccgcagccaaatacaatgcggggacttcccaccccttgacgtcaaggaaagccaccgggattcgaacctttttcaggaagaaactcggcgggcgcccccaaacaggcttggggcttttatcaccaaagggcccatgagaaagttaacaataactttgggggaaaaacacggagcataataattctggaccgaacccatcctaagcccgggcccccttatttataacgacagttacggccccatagaactgcgccaagttgggggccacaagcgggagagaggatatttggaggggccgagaaattactgaggactaccgctcactcgaaagttgtttatcaaaaccctaggtttgataaggaaactttgtggcgagacaggaaggggtggtgccatataaactccccaccaatttgttccttgtaaaattgtggtgggggatataagttgatccaaaccggatgtggctcaacccagaaagcaggtaaaacacatggttcccgagataaccaaccttagtgggagaagaggcactatgttcaatgtattcaactcacgttgacagacactctctactcccagaaataaaaaatatgttgacatcaaacgggggcgtagggtagcagcgtaattcccacactcatatttctatcctcggagacctaacatttaccatatgggaaattccacc

SEQ ID NO: 89845 - protein, 47 aa, Zea mays
  misc_feature: Ceres CLONE 1577655
MGHRVGSFNEPFSRAEEAAMRTIRLAPVETQLGRLVVSVQYVPSLAT

SEQ ID NO: 89846 - DNA, 828 bp, Zea mays
  misc_feature: Ceres CLONE 1577657
  misc_feature: Encodes the peptide sequence at SEQ ID NO. 89847
ctccccgcggtggcggccgctctagaactagtggatcccccgggctgcaggaattcgtctcacccctagaaaaaacgattctgccatcgcgcgattcccctcctccatcccgattcctccgcccgcgactccccgtgcccgcagcccccgccgccgtcctcgcggcctgccgaggacagccgtcgcgcccgcaaatcacgcgaccatgcccttccatgtcctcgcgtcctccactctgcccgcgattcccctccccgcacccgcagcccccgccgtcgtcctcgcggccagccgaggatagccaccgcgcccgcaaatcacgcgaccatgtccttccatgcccgcaaatcacgtcgcccccttccatccatggcagtcgcgctccctctgcgcccttccatccacggtcgcggatccctacgcgccgcgattcttcccatacgctccctctgcgcccttccatccatggccgcggatccccgatgttgagatctgggagctgaagctggagatctcgcggatgcgggtgcggctgacggagctggagcgggagcaggggctgatgagcagcagggaggagcgcccggcccaggaaagcggcggctgggctgggggcgccgcaaacaaggccgcgccttcctcgcgtcgctctcgaggggcatcggcagcatcaccatggttcggcgggcccacgggggccgattgaacggggcaagaaatgcgggcggccgggagcctcccattggctcccaacggcaaaggccccgcagggcgggataaaagggaatccctttcgccctaaggactggaaggcttcccacgggcggg

SEQ ID NO: 89847 - protein, 122 aa, Zea mays
  misc_feature: Ceres CLONE 1577657
MPANHVAPFHPWQSRSLCALPSTVADPYAPRFFPYAPSAPFHPWPRIPDVEIWELKLEISRMRVRLTELEREQGLMSSREERPAQESGGWAGGAANKAAPSSRRSRGASAASPWFGGPTGAD

SEQ ID NO: 89848 - DNA, 811 bp, Zea mays
  misc_feature: Ceres CLONE 1577658
  misc_feature: Encodes the peptide sequence at SEQ ID NO. 89849
ccccgcggtggcggccgctctagaactagtggatcccccgggctgcaggaattcgtctcacccctagaaaaacccgaagcgtcgcgccgccgcccatcacggacatcggacaggagaagagaagcgggagcaccggagcaggcaccaccgccgaggcgtcgaggtcgccgtgctccccatccgctgaggtagctgctctccggcctccgcggctgccggctccgccaacgcccagtcccaaggcgggcaggcacccacggcagcacggctgtcgcggtagtatttaaggaacagggaaacatctgctaccgcccaatctttccccttcccggactgctcgctggacgccgaggacgtacgtgtccgccgtctgtttccactcaccgtgtgatactgtgatggtggacttggacgagccgctcgatgcggctgtaactgctgagaacggcgaggcggcgctacaacggttacgtgaggctgaccctgcactcttcctctccccctctgcggaccttgctgccgccacccgagcggcctcgcagcacatctactcctcactggtgccactctaccctgctcagcctccaccgctctctaccctcctcacggaccctgacttcgacgccgagcagatttggatcccagatcgagctgctttgcccgcccactcctccctaagatgggccgaacagcttcgcccgcatgcgtgctagcaacccttcttcgcaacagccgtcctttgaaaaatgcctgctggtcccctaagggttgaaacatttgggcgggaaggatgggtaaaaagttcccaatt

SEQ ID NO: 89849 - protein, 104 aa, Zea mays
  misc_feature: Ceres CLONE 1577658
MVDLDEPLDAAVTAENGEAALQRLREADPALFLSPSADLAAATRAASQHIYSSLVPLYPAQPPPLSTLLTDPDFDAEQIWIPDRAALPAHSSLRWAEQLRPHAC

SEQ ID NO: 89850 - DNA, 828 bp, Zea mays
  misc_feature: Ceres CLONE 1577659
  misc_feature: Encodes the peptide sequence at SEQ ID NO. 89851
ctccccgcggtggcggccgctctagaactagtggatcccccgggctgcaggaattcgtctcacccctagaaaaagttactactccccagtcccactcccacccgcaggccgcgccgccccagcaaatctcacgcacagaaacaccaaagccccaaaggcccaaactcaccacctcccaatggagaacggcgacgaaaccctcgcctcccccacggccgccgccgagacggacgcgctcaacggcggtgtcgcggaggaggagcaggtccccatcacccaccccgcaaagtcctacgtcacgctcgccgacgacaaccccgctcctaacggcggcgtcgtgaaagaggaggagggcggcgcccacaccgccgcgaagtcctacgcagctgtcgccgcccaagccgagatcgaggacctccgcgccgccaagctcgacctggaggagaagctcgctgaggcccgccgtgagaacaagtccctcgccgaggagacgcaccgcagcgaggggatcttcacgcaggcccgggaggaggtcaccatcgccgagttcgccgccacctctgccgagaaagaggtcgcctcgctccgcgcggaggtcgaacgcctcgatgcccttctcatgatcgagaagggcgagcacgagctggacaagcagagacacgagaagggtcgcaaggaggtgggatgccgtgcgccaggagaaagctcagctagaggaggagatcagagccctgtaggtatccgccaccgccgccggccacaccaaggtagaggggaggctgcgcccggcttctgaggcaccgaaaggaggaggagtcgcgtggctgg

SEQ ID NO: 89851 - protein, 205 aa, Zea mays
  misc_feature: Ceres CLONE 1577659
MENGDETLASPTAAAETDALNGGVAEEEQVPITHPAKSYVTLADDNPAPNGGVVKEEEGGAHTAAKSYAAVAAQAEIEDLRAAKLDLEEKLAEARRENKSLAEETHRSEGIFTQAREEVTIAEFAATSAEKEVASLRAEVERLDALLMIEKGEHELDKQRHEKGRKEVGCRAPGESSARGGDQSPVGIRHRRRPHQGRGEAAPGF

SEQ ID NO: 89852 - DNA, 765 bp, Zea mays
  misc_feature: Ceres CLONE 1577660
  misc_feature: Encodes the peptide sequence at SEQ ID NO. 89853
tccccgcggtggcggccgctctagaactagtggatcccccgggctgcaggaattcgtctcacccctagaaaaactctccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatgtttctcatcaagatgcgtgagatcgctgaagcttaccttggcagcacgatcaagaaatgctgttgtcacgggtcccctgcctactttcacgaactccaagaaggcagggccaccaaagaatgcctggggggggaattgcctcggccctcaaagggggccggcgtatttcatccaaagggggccccaacccgtcgg

SEQ ID NO: 89853 - protein, 191 aa, Zea mays
  misc_feature: Ceres CLONE 1577660
  misc_feature (9)..(191): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMFLIKMREIAEAYLGSTIKKCCCHGSPAYFHELQEGRATKECLGGELPRPSKGAGVFHPKGAPTRR

SEQ ID NO: 89854 - DNA, 1292 bp, Zea mays
  misc_feature: Ceres CLONE 1577661
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (1292)..(1292): n is a, c, t, g, unknown, or other
aacatatgtgtattgtttacttttctacaaaacacacgcacgaggggtgttntnnttttnnnnnnnaaaagctggagctcccgcggtggcggccgctctagaactagtggatcccccgggctgcaggaattcgtctcacccctagaaaaatactctgcgagtccaggagatttttttccccttcttcacgatactctcgacgagagtgtctccatggtcggaaaaggagacgggccggcgaataggcaccgacctcgggacaacctactcgtgcgtcaggatgttggcagcatgaccgagtggagatcgtccgcaaagataaaggggaacagtaaaactcccgtcttcggtcgctgttcccggttgtcggagaggttcgtgcagcaacacagacagatgcccatgttatcccggtaaacccttacaacaccgtgctttccacgcccaactatcctagtacgggcgaggaacttcctctcaaaacccccaagcgccctaaggtgactaagaagaggcggcggcggtcttcgaaatgcgtgctcgcgttgagttagccatctcgccacacacccggggaatccggtgcgagtaacgagtatatgtggcggcgtgggtgataaaacaatgttgtaccgctcgctgtggcatgcgatgccgatatttatggagatcttgtgtgatttagcgactttatacgggtgcgcacggcgaccgaaaggggttttggcgcttatggtgcggccctgactagtgtgcccggcaaatattataggggccgaacggggcatctatcgatccgcgcgcgccgctaacatgagataggatcagacaaacccggacattaagtcagtgtaccgaagagtgtatatgtaattactatagtatgtacgatgcaatagagccggacgcactactatcgtcgcgcttgtcagatttgtgtctcatccccctcctgccctcgggtcgactcttcccctactgttacgcgcagtgcaatcgatcaatcctacgcgaggtgctcaggtgaggcgaccatatgtgagtaggcactgtcatgcggagtaaactcgcatctatccttctcactctctgtactaccaacgctgcaagtctctactggtggaatatgagtgttacccccctcgcgtgtacttgtaactatgacgcgctagatcgccacacgaccgacgagctaatgccagaaccggtgacgatagatgatcactcccgagaatatagggtaccgccccactgctggcgagcgcctggaatagtaggcggtgctctcctcn

SEQ ID NO: 89855 - DNA, 1248 bp, Zea mays
  misc_feature: Ceres CLONE 1577668
  misc_feature (65)..(65): n is a, c, t, g, unknown, or other
  misc_feature (1248)..(1248): n is a, c, t, g, unknown, or other
gattgggatgggtgtttatgtgggtagggggtgagagagggtggttggggggggggagggggggntggccaaatgtggggagttgtgggtccccgcggtggcggccgctctagaactagtggatcccccgggctgcaggaattcgtctcacccctagaaaaactcccagatcaggattagccgaccacccgccgaaggccagagagaaatatctcatcttctctccaccggatcggttcaatcgagagcgagggagaaagggaggtggtgcgtctaggggggccaagattttgccggtttggagccaaataggggtatgagctgcttcgcacaccgccgccgctccgacgtcgcccgccgccaggacggcctcctcgtcttcgtcttcttcctctcgattcccatacgtaccaggagttttaattcaagtagcaagtacttggagcagcaaggctcgggtaaacctgcgctccacatttgcgtggaccccgagcccttatctgcaatttcttagtggccctctttacaccctcaaatcggcggcatataatttcttaccaccctttccccggggggaaaaaaccccgggcggagctggagtatagggatttgcccaaagtggggcgctgcaaaaaaacgggggaaggggcgcctatttgttggctccccaccggagaacccattctcctaaaaataagatagaagttgaaaaaagataaataccacaccatagtaacaaaattacgcgtgggtggcatctttttgggtcacaaaatagcactgttacgtggagtaatgtgaaacaccagataccgtctgtcgagggagactgccgcgttataatgtaaaaatactcatatggggacccccgggcgatgggggcacccagctataccaactatccgaataagattgcctcgctacaacatatgttgcaaacgaggtcggggagcaccccgctgcatgttcttcgggaggatgaggtcacacacacaagagcgcgttccggagacaacttattagcccgaccggcgggcactacccagatgtgtataacaatccgtgctagttaatggcacaaccatatctatgggggtcatgacgccgcgacacaaaggcacacagagagagaagacgtacccttctgtggggggatgtttatcagatagctcttgagtgtagcacaagtgagtgggaatacactgaccgagggagccacgacgaataataatagaacaagataacgtn

SEQ ID NO: 89856 - DNA, 823 bp, Zea mays
  misc_feature: Ceres CLONE 1577669
  misc_feature: Encodes the peptide sequence at SEQ ID NO. 89857
  misc_feature (804)..(804): n is a, c, t, g, unknown, or other
ctccccgcggtggcggccgctctagaactagtggatcccccgggctgcaggaattcgtctcacccctagaaaaaggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcaaccaacaaggttcatttcatccttaagcacaagaatcctaagactggaaagtatgttgagcatcacctcaaattcccaccttctgtcccatacgacaagctctctcatgtctacacagctatcttgaagccagacaatgaggtcagatttttgatcgatggggaagaaaagaagaaggcgaacttcccttctgctgatgactttgagccagcacttatcccatccaagaccattcctgaccctgatgacnagaagcccggagactgggc

SEQ ID NO: 89857 - protein, 229 aa, Zea mays
  misc_feature: Ceres CLONE 1577669
  misc_feature (24)..(229): Pfam Name: Calreticulin Pfam Description: Calreticulin family
  misc_feature (224)..(224): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSTNKVHFILKHKNPKTGKYVEHHLKFPPSVPYDKLSHVYTAILKPDNEVRFLIDGEEKKKANFPSADDFEPALIPSKTIPDPDDXKPGDW

SEQ ID NO: 89858 - DNA, 1333 bp, Zea mays
  misc_feature: Ceres CLONE 1577674
  misc_feature: Encodes the peptide sequence at SEQ ID NO. 89859
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (35)..(35): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (952)..(952): n is a, c, t, g, unknown, or other
  misc_feature (990)..(990): n is a, c, t, g, unknown, or other
  misc_feature (1049)..(1049): n is a, c, t, g, unknown, or other
  misc_feature (1052)..(1052): n is a, c, t, g, unknown, or other
nttgttgggtnncnnggctcccccttcaaaaatanaattataaaggaaagcagtgagagtgntttgtnnnnnncaaaactggaactccccgcggtggcggccgctctataatagtggatcccccgggctgcaggaattcgtctcacccctagaaaaaaatacgccgtggcacgcgtcgccatgccgccccagttccccaccgcccgcctcctcctccctagtcacaggctgctcccgctcctctcccctctcccctccgcgtccctgtcccctgctcctcgaaccctccgcctcccgccgccacagcttcttcaccgagtcgcccgccgccgcccgctgctgcgcggcatggcctccgccgccgcccccgggtcacacgccgccgcggaagcgccccccgtcgacgtggggggagggagcgcctgccccccacgggcgctccccccgggaggaggttacgatgggacatttccttggtggtgccccccccccccgcgtacacacaaatgttgtaggtaggacccacagagaaaggtccccccccaaaggatgttttagatccacaaaggcgttgtccccgtctagagcactatatggggtatcaacccgcccaggaatggttggccgattggggtgctaggaataatgcaggtagggggcagaaacaaatgccccccaagaagcggggggaaattcacggggggggcaaacctcgctgaacaaaagaaaatctgtgtggcaacgttgtgccgccttgcacggagcgcctattaagatctcatcgtgaggaggtcgaggacaccgagtggcctctcgctcctggctattggcgaatgtgagagggaggggaggggacggagattttctgtgtgggcgtgcctccgcgtaacgctggtctgtttagtccgttaggagaggccggcagtacgaatgcgcagaaacgagagggatntttttcgacgcaggacggcgatgcatgcggcgagtctntatctgtcgcaactcagacgttgacatactggatcactcatccatatcaggcgctccgnggngtgcacagtgccgtgagcggttatgacaacggcaagtcgcacgataatacgtgtgatctaccacttgattacacacaatcgctagcgcttggcgacgataatatgtagaatgttgaagcgaaacgagactcatacagagagatgtgagctgagacactgtgatacgaagtgagtacaagatgccgcactctctcgagttacgtcgcggtgccgggtgagatgaggtgaggtgcagtttttgggtattatggcggagacataaagtcatgagtcgatgagtc

SEQ ID NO: 89859 - protein, 41 aa, Zea mays
  misc_feature: Ceres CLONE 1577674
MGYQPAQEWLADWGARNNAGRGQKQMPPKKRGEIHGGGKPR

SEQ ID NO: 89860 - DNA, 852 bp, Zea mays
  misc_feature: Ceres CLONE 1577675
  misc_feature: Encodes the peptide sequence at SEQ ID NO. 89861
ccccgcggtggcggccgctctagaactagtggatcccccgggctgcaggaattcgtctcacccctagaaaaacgattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggcggccagcgtcgccgccctcgagcagttcaagatatccgccgaccggtacatgaaggaaaggagtaccctacctgtgataggcctccgtgtacacccagcaccagtggagatgcgtgaaaaacttgttggtgcagaggaactgggggccccggggcttttcaaaaaactcctatgcctggaaccattttgaagaaggcgcggggttcttagacccggaaaaaaaaagggaaaattttgggggggggccgccttttggtgaaaccgggggtttacagaaaaaaagggggaccgggagttccaaaaaaaaaaggggtatttcccccctctccacgagttttgggggagaccccttgtt

SEQ ID NO: 89861 - protein, 121 aa, Zea mays
  misc_feature: Ceres CLONE 1577675
  misc_feature: SWISSPROT Homolog: EC 1.2.1.70 Glutamyl-tRNA reductase
MATTTSATTAAAAAATTAKPRGSSSALCQRVAGGGRRRSGVVRCDAAGVEAQAQAVAKAASVAALEQFKISADRYMKERSTLPVIGLRVHPAPVEMREKLVGAEELGAPGLFKKLLCLEPF

SEQ ID NO: 89862 - DNA, 751 bp, Zea mays
  misc_feature: Ceres CLONE 1577676
  misc_feature: Encodes the peptide sequence at SEQ ID NO. 89863
  misc_feature (231)..(231): n is a, c, t, g, unknown, or other
  misc_feature (238)..(238): n is a, c, t, g, unknown, or other
acccgcggtggcggccgctctagaactagtggatcccccgggctgcaggaattcgtctcacccctagaaaaagcaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcnttccccnttcctccctccccgccgcgcggcgcaacgcactccacggagcgtctacgccacggcaccacgagcttcctctcctgcgctgccggcagccatcgtcatcggggtttctggaagaccgcgtcggggaagacaacgtgtgcgacatgatcatccagaagctggacgaccaccgtgtcgggctcgtttaaccagggattcgttttttccgggggccctttccggcctaaaaaaattttgcccaatggcccacaaaaaatttaaaatttttggaacccccccccggaagcccattttgaaaccaaaaaacccaactttcttaaaaaatacccttgggggggcccccttaaaaaattgtccccccacccccggaaaaaaaggggtcccccctatatttgggaatttcccaagaaaacccccccccggggggttttctttaaaaaaattttttttaaaaaagaggcccaacgccgcccccaaaagaggcccttttttttttgggggggggggggctttt

SEQ ID NO: 89863 - protein, 84 aa, Zea mays
  misc_feature: Ceres CLONE 1577676
  misc_feature (37)..(37): Xaa is any aa, unknown, or other
MPDKAVDDVMEAAVGAHFSGLRLEALRLSTSAPSFPXPPSPPRGATHSTERLRHGTTSFLSCAAGSHRHRGFWKTASGKTTCAT

SEQ ID NO: 89864 - DNA, 807 bp, Zea mays
  misc_feature: Ceres CLONE 1577677
  misc_feature: Encodes the peptide sequence at SEQ ID NO. 89865
ctggagctccccgcggtggcggccgctctagaactagtggatcccccgggctgcaggaattcgtctcacccctagaaaaaaggctgacgcgggctctgcccgccgatccgatgattcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaaccaggatccattggagggcaagtctggtgccagcagccgcggtaattccagctccaatagcgtatatttaagttgttgcagttaaaaagctcgtagttggaccttgggccgggccggccggtccgcctcacggcgagaaccgaccggctcgacccttctgccggcgatgcgctcctggccttaactggccgggtcgtgcctccggcgccgttactttgaagaaaatagaagtgctcaagcaagccatcgctctggatacattagcatggggataacatcctaggattcccgggccctattgtgttttccccaatggagaaggggcctggggtattcctgatggctccaaggtgttacgggccaaagactcccaagctggtgggacatttctcaagtggaaacct

SEQ ID NO: 89865 - protein, 64 aa, Zea mays
  misc_feature: Ceres CLONE 1577677
GAPRGGGRSRTSGSPGLQEFVSPLEKRLTRALPADPMIHDNLTDRTAFVPATHHSNFCPINFRW

SEQ ID NO: 89866 - DNA, 842 bp, Zea mays
  misc_feature: Ceres CLONE 1577679
  misc_feature (761)..(761): n is a, c, t, g, unknown, or other
ctggagctccccgcggtggcggccgctctagaactagtggatcccccgggctgcaggaattcgtctcacccctagaaaaaccctctccctctccctctccctgcaggccggcagccgctggaggcacagacgacaaggcatcggccccggatcgagcccgacccctcttctcgtctcgtctcgtctctgcgctgggaacgccggctgccatggctgtaagtcccctctcctcctcctcctcctcgctcgccttccaatcttccatggcatcagccagtcctggatgcttcggtttcgacggtttatatagtttggttgtgacttgtaccccacagctttcgggtagaattttgtagcgccatcttagtttgtgtcctgaactttcctattatgcatgcacaaacaactctttcaccgccaagaatttggtgttccgtggtggttctcctgaacgatggcttagttcgtcctcgtatggtttccggatgcgcgatcgagcggtgatctggacctgaaatttcacgccctgcgattactcctccttggatcagcccgtttctcgcgcgagctgttccatatcttggcgtgtagagagatcaaaaccgctgaacagttgctgatgaaacgtgagaaatgtctctcggtcacaatctgtcgccgcgatagtcttcatctcataaattgttaagtgcacaaagctagagatggtgctagggttactgattggaatacgactccccacttatctggatttttttttnatttaaggaaagaaaggaaagaaatggccgagcaaatttgaggggcggtttgactgaagatcggaacacccgccccaaggc

SEQ ID NO: 89867 - DNA, 1032 bp, Zea mays
  misc_feature: Ceres CLONE 1577681
  misc_feature: Encodes the peptide sequence at SEQ ID NO. 89868
ggggaggagggaaggggggatcttttattattaatggggagaaaaggggaaggaagtggttggacggccctttttgtttaaactggaactccccgcggtggcggccgctctagaatagtggatcccccgggctgcaggaattcgtctcacccctagaaaaaaaaaaaaaaaatcgtccatccgtatttccgtcacaactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagcagcctccacagcagcagcagagcagcgggccttccttcatggaaggatgcttggctgccctctgctgctgctgcctcctggacgcctgcttctgacggaaccatcccgtgccgggtccaacacgggctgccaagtggaagcaacccagcttaccggaaaaagctggaaactggggccgtgcctattcctagccttttgtccctggcgttaatcggccccttcgtttttcatttttactttttgccttatttttttttttttacacctccacgtcctacgaccccttctgggtgtaataaaaaaacaaaccgggggtaacctccctggtggggaatgtaccgaattggggggattataaacccaaaggggcccggggggggttggtattttcctggggagaaagtccccccacggggttattctggtggggggggggaattccaacattttcaaaaaccccggagggagatttaagtggggttattttccttgtcccaccaccagggtgatagccgcccaaagggtcccccaaatcccccgaatgactagtattagcatatatataacaa

SEQ ID NO: 89868 - protein, 93 aa, Zea mays
  misc_feature: Ceres CLONE 1577681
MSYYGQQPPVGVPPQQGYPGKDGYPPAGYPPAGYPPPAQGYPPQGYPQQGYPQQGYPPQYAQQPPQQQQSSGPSFMEGCLAALCCCCLLDACF

SEQ ID NO: 89869 - DNA, 786 bp, Zea mays
  misc_feature: Ceres CLONE 1577683
  misc_feature: Pfam Name: Carboxyl_trans Pfam Description: Carboxyl transferase domain
ccccgcggtggcggccgctctagaactagtggatcccccgggctgcaggaattcgtctcacccctagaaaaactgctggtgccaggcttggtgtagcagaggaaataaagtcatgcttccatgtcggctggtctgattatgagagccctgaacgtgggtttcagtacatttacctcactacacaagattactcacgtctaagctcttcagtaatagctcacgagctgcaactaaaaaatggagaaaccagatgggtggttgataccattgttggtaaagaggatggacttggttgtgagaatctccacggcagtggggcgattgccagcgcatattctaaggcatacaaagagacctttactctgacatttgtgactggaagagctgttggcattggggcttatctggctcgtttaggcatgaggtgtatacaacgtcttgatcaaccaattattttgactgggttttcggcactaaacaagctcctggggcgggaggtgtacagttctcatatgcaattgggtggccccaaaatcatggctacaaatggcgttgtccaccaaactgtgtcagatgaccttgaaggtgtttctgctatcctgaaatggctcagttatgttcctccatatgttggtggtcctcttcccattatgaaacccctggacccacccgaaagaccagtaacatacctccctgagaaagcttgtgatgcttctgcagccatctgtggcattcaggatggtgaggaggtggttttggggggggaaaatttttaaagggaaaaat

SEQ ID NO: 89870 - DNA, 824 bp, Zea mays
  misc_feature: Ceres CLONE 1577685
  misc_feature: Encodes the peptide sequence at SEQ ID NO. 89871
ctggagctccccgcggtggcggccgctctagaactagtggatcccccgggctgcaggaattcgtctcacccctagaaaaagaggacatcctcggccttccagggcagcaaccacgaaagccttctgcgcggggtgctttcctcgcagcaaatattcctgccttttgcattccggctttgcaagttccttgctttgggcatatatattgtgaggtctctatatatataggtggttcgaggtgatcggcagaaccacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaagcagcgtgcctgctcctcaggcgtctgctcaggctttgggccgccatggtgaccgaaatgcagaaaggccgctcttttctaccgcggcttgggattaaccaatccatcttacgggatccaaatgccatggcaagggggccccaaaaaccgggtttcaaaaaaagggtcccagttttttccccccaaaaaaaaaagggggggggggtggggggggaccccacggggggagccccccccccccccccttctaaaaaaaaaaatgggggaaaaaacaccctccccccccccccctttaaaaaaaaacccccccccccgcttccc

SEQ ID NO: 89871 - protein, 111 aa, Zea mays
  misc_feature: Ceres CLONE 1577685
MASVHKATTLVLMFCLLALGRAEYLKYKDPKQPVAVRIKDLLGRMTLAEKIGQMTQIERENATADALAKYFIGSVLSGGSSVPAPQASAQALGRHGDRNAERPLFSTAAWD

SEQ ID NO: 89872 - DNA, 849 bp, Zea mays
  misc_feature: Ceres CLONE 1577686
  misc_feature: Translation starting site: 241
  misc_feature: SWISSPROT Homolog: EC 1.1.1.22 UDP-glucose 6-dehydrogenase
  misc_feature (849)..(849): n is a, c, t, g, unknown, or other
ccccgcggtggcggccgctctagaactagtggatcccccgggctgcaggaattcgtctcacccctagaaaaagcacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcagggaacctctttcttcagcactgatgttgagaagcacgtcgctgaggctgacattatctttgtctcggtgaacacccccaccaagacccgtgggcttggagctggcaaggctgccgaactcacctactgggagaccgctgccccatggattggggatgtctccaagtttaacaaaattggtgttaaaaaagcccatgtccctggtaaaaacccctgaggttttttaaaaaaattttgacccaccaaacgcagggggctctaatttccaaaatcttttcaaacccaaaattccttgggggaggggctcgccctttgaggaaacttttcaaccctctaaaaaaagtgttttttggggggggggggggaaccccctgggggggggggaggggccccccacggctctccaggggggggtgccn

SEQ ID NO: 89873 - DNA, 837 bp, Zea mays
  misc_feature: Ceres CLONE 1577687
  misc_feature: Encodes the peptide sequence at SEQ ID NO. 89874
ctccccgcggtggcggccgctctagaactagtggatcccccgggctgcaggaattcgtctcacccctagaaaaactgatcgagcgcccttgcgctgaagatgaacggggctaagcgatctgccgaagctgtgggatgtcaaaatgcatcggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggacgctaggttagccgaaagatggttataggtttaaggacacaaggtgaccctgctttttcagggtaagaaggggtagagaaaatgcctcgagccgaggtccgagtacctagcgctgcagcgctgatgtatgagccccgtggactagccattgcttctccacgaggctcataccaggcgctacgggcctgaaatatgtaaaccctgccatactcccaaggaaaagctcgaacgaaccttcaacaaaaggggtactggtaccccgaaaccaaaaagggggggggagggaaaaaaataccttgggggcgccaaaaaacccttctctaaaggaaccggggaaaaaaaccccccttaaccttggggaaaaaggggggccccccccccaaaaaggggggtgccaatgtaaccaagccccggggggaaatgtttttaccaaaaaaca

SEQ ID NO: 89874 - protein, 68 aa, Zea mays
  misc_feature: Ceres CLONE 1577687
MNGAKRSAEAVGCQNASVGERSALEGSKRESGGRRSGSENVGLSNENIGENPMPRKPKVSSARFVHGG

SEQ ID NO: 89875 - DNA, 753 bp, Zea mays
  misc_feature: Ceres CLONE 1577689
  misc_feature: Encodes the peptide sequence at SEQ ID NO. 89876
tggagctcaccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcgggcgacgacggggagctcgccccgcgggtggcgggaggtccacggcagcaacaactggggagggtctggctggacccccatcgacgggggtgctcctcccgggaactcatccgcttaaggggaaggtccgcccagggcacccttaagaaaaggtttgaaataagaaacgctttttccccccctattgggggggaagttgaaaaattaccccggggaaaaaaaacttttttttccaaaaaaagttgggggccttctgggggggggtattcggggtttacaaaagagggcccc

SEQ ID NO: 89876 - protein, 167 aa, Zea mays
  misc_feature: Ceres CLONE 1577689
MAATVSSCLSLVPTVHHRAGGFPSSVALTNTLQRRRRSRRYLVVASATRAEQEAAPVTIEDVDLSSHQAAGDDGELAPRVAGGPRQQQLGRVWLDPHRRGCSSRELIRLRGRSAQGTLKKRFEIRNAFSPPIGGEVEKLPRGKKTFFSKKSWGPSGGGYSGFTKEGP

SEQ ID NO: 89877 - DNA, 908 bp, Zea mays
  misc_feature: Ceres CLONE 1577690
  misc_feature: Encodes the peptide sequence at SEQ ID NO. 89878
  misc_feature (400)..(400): n is a, c, t, g, unknown, or other
  misc_feature (908)..(908): n is a, c, t, g, unknown, or other
tccccgcggtggcggccgctctagaactagtggatcccccgggctgcaggaattcgtctcacccctagaaaaagtttgttgtttacttctattttttttgcccgtcagcagccccaccgcaaccgacgcctccagcactccagtcctactcctccacccacccagctcgctgcttccggagtccggagagctcgcgtcgcgcgtgcgcgggcgtgggtgcgtgcggcggcgaagcaccagcaccaccctctcgcgtcgcgcgcgcgtctcgatggccgacggggagccttccctcacgcgctggaccttcgaggatttcgtggtccactacgaagggcgcttcggcctccagcgcgaggccgacggcgacggcgacggcgatggcgacgacgcacccccnccgcgcggatccgatcatggggccagccgccccgccactgcccgcgccaacggcggcgcggacctcgccgtcctcgagcatttcaagcggatggagaggaaagggggagataagcaatgggagctaccgagggatggtcccctggtaaaacttggggtggaccccaagaaaagaggttggactaccccatttttttttttcttggaacccttggaaaggggggaaaggggccgcttctaaaggttagcctaatttcccttctgaaggcgccggttttagaacaacaggaaactagcccctcaaaaagggcccctccaaagtgatgcccacatcccccctggaaaaccccgggttccccaacccggggaaccctggcctttgaaaagagaccccccctaaagggtgcggcggggcaaaattcccccccgggataccccgggggggccccaacacaaaataccctgggcgtgggggcgcgccaacattcccttgtagaacaaggtggtgn

SEQ ID NO: 89878 - protein, 122 aa, Zea mays
  misc_feature: Ceres CLONE 1577690
MADGEPSLTRWTFEDFVVHYEGRFGLQREADGDGDGDGDDAPPPRGSDHGASRPATARANGGADLAVLEHFKRMERKGGDKQWELPRDGPLVKLGVDPKKRGWTTPFFFFLEPLERGERGRF

SEQ ID NO: 89879 - DNA, 874 bp, Zea mays
  misc_feature: Ceres CLONE 1577692
  misc_feature: Encodes the peptide sequence at SEQ ID NO. 89880
gcggccgctctagaactagtggatcccccgggctgcaggaattcgtctcacccctagaaaaaaccgagctcaaacacacatctagaaagcaagaaagagaagactgtagctagctagccaccgcgcgcgcgcacgagtagtctagctagaatacactcgcgttcaaaacaaacacacagctgccgtgctgcgtgatctctgaccgcgtctactactatcgcagcaccaagcagctgatggcggtcaccgtatcttcctgcctgagcctcttccccaccgtgcaccatcgggtcggcgggttccccagcagtgtggaagtgacgaacacgcttcatcgccgtcgtcgttctcgccgctagcgtgtcgtcgcctcggcggaggagagggcgacacaccaggccgcccctgtgacaatccgagagatttggacactcagctctcatcaagcccggggcgaacgaccgggagctcccctcgcggtggaggggaggttcacgggagcaactaagtggggaaggtctggctggaaccccaatcgaggggagaagctcctccaggggcctccttccgcttacgggagaatttaggcccaggggcacccttgggaataggtttcgaatttaggaacgggatttttcccccctaaaggggggaaccgttccaaataccaccgcggaaaaaaacttttttcccccgaagtgtggggcccttggggggggttttggggtaaaaaagggtcccccccctttccttttttacggaccaccgggagagggaccccaagagttttcgcgcccatttgtggggtttataagagggcgcccccccaacccccctaatgtttgggagagggggaatccccggaactttgttt

SEQ ID NO: 89880 - protein, 40 aa, Zea mays
  misc_feature: Ceres CLONE 1577692
MAVTVSSCLSLFPTVHHRVGGFPSSVEVTNTLHRRRRSRR

SEQ ID NO: 89881 - DNA, 950 bp, Zea mays
  misc_feature: Ceres CLONE 1577693
  misc_feature: Encodes the peptide sequence at SEQ ID NO. 89882
cggccgctctagaactagtggatcccccgggctgcaggaattcgtctcacccctagaaaaaaatccagcaatacccgagtacccgacgcgctagctagttctattgccgcaccccagatctccaggagggactcgttcgttcagctaactacactgcacgcaatggccaccacggcgaccgaggcggcgccggcgcaggagcagcaggccaacggcaacggcgagcagaagacgcggcactccgaggtcggccacaagagcctgctcaagagcgacgacctctaccagtacatcctggacacgagcgtgtacccgcgggagccggagagcatgaaggagctccgcgagatcaccgccaagcacccatggaacctgatgacgacctccgccgacgaggggcagttcctggacatgctcatcaagctcatcggcgccaagaagaacatggagatcggcgtctacaccgggctactccctcgctgcccacgggcgcttcgcccctcccgggaggaacgggtacgaaatcttgggccattggacaatccaagccggcggaaaaacctacgaagcctgggggccttgcccccgggccaccatataaaaggggccgggcgtttccgccccccacgagggaattcggacgtttcccgaccggaaggtgtcccaccctggttccccccatggaccttgcggaagggaaccctcgattcggggggaaggaaagtaaaagaacaccaacggagtctgttacccaacattaggctgcttgcgatgggaaccgccccgcccgagggtataaaaataccccattaaacatcttgtgacggtaacctgccgctctgttacagcctggggtgaagacacaggcgatggacaccttcatctttggtgttaagaaaacatacgcgcccgtggtgtgaaaaaaggcttgcttgtcaacgagcacacaa

SEQ ID NO: 89882 - protein, 216 aa, Zea mays
  misc_feature: Ceres CLONE 1577693
  misc_feature (45)..(152): Pfam Name: Methyltransf_3 Pfam Description: O-methyltransferase
  misc_feature: SWISSPROT Homolog: EC 2.1.1.104 Caffeoyl-CoA O-methyltransferase
MATTATEAAPAQEQQANGNGEQKTRHSEVGHKSLLKSDDLYQYILDTSVYPREPESMKELREITAKHPWNLMTTSADEGQFLDMLIKLIGAKKNMEIGVYTGLLPRCPRALRPSREERVRNLGPLDNPSRRKNLRSLGALPPGHHIKGAGRFRPPRGNSDVSRPEGVPPWFPPWTLRKGTLDSGGRKVKEHQRSLLPNIRLLAMGTAPPEGIKIPH

SEQ ID NO: 89883 - DNA, 776 bp, Zea mays
  misc_feature: Ceres CLONE 1577694
  misc_feature: Encodes the peptide sequence at SEQ ID NO. 89884
ggagctccccgcggtggcggccgctctagaactagtggatcccccgggctgcaggaattcgtctcacccctagaaaaaaaaaaaaaatccccacccaaaaacccacggaggagacaagcacagcaagccaccctcccgcccgttcgtttcactcatggagccgctgccgtcggcaacggccgccggcgtgggggcccccggccctggtcccgggtaccccgagtccacggagtcttctccgcgcagccggggtggggattcgtgggacgagccctttccgtcctctgcagcggcggctgccggcggcgggggccggctccgcctgatgtgcagcttcgggggccggatcgtcccgcgcccgaccgataagtcgctctgctacctgggcggggagacccggatcgtggccgtggaccggcacgcgtcgctcgccgacgtccacgcgcgcctctcgcggtcgctgctgggcggtcgccccttcacgctcaagtaccagctacctaacgaggacctcgactccctcatctccgtctctacggacgaggacctcgacaacctcgtcgacgagtacgaacgcatcgccgcgacctcctccggcagcggatcctcgcgcacctcccggaatccgctctttctcttcccgccacccccgagtcctcgtcctcgctcggctccctggtgggacgactcttcgaagtccaagaactggttcttcaaccccctcaaaaggggcatcttttgggtcccttagagggaattcccaaaagggggacttc

SEQ ID NO: 89884 - protein, 198 aa, Zea mays
  misc_feature: Ceres CLONE 1577694
  misc_feature (69)..(164): Pfam Name: PB1 Pfam Description: PB1 domain
MEPLPSATAAGVGAPGPGPGYPESTESSPRSRGGDSWDEPFPSSAAAAAGGGGRLRLMCSFGGRIVPRPTDKSLCYLGGETRIVAVDRHASLADVHARLSRSLLGGRPFTLKYQLPNEDLDSLISVSTDEDLDNLVDEYERIAATSSGSGSSRTSRNPLFLFPPPPSPRPRSAPWWDDSSKSKNWFFNPLKRGIFWVP

SEQ ID NO: 89885 - DNA, 841 bp, Zea mays
  misc_feature: Ceres CLONE 1577695
  misc_feature: Encodes the peptide sequence at SEQ ID NO. 89886
  misc_feature (841)..(841): n is a, c, t, g, unknown, or other
ggagctccccgcggtggcggccgctctagaactagtggatcccccgggctgcaggaattcgtctcacccctagaaaaatctcttaaggctgccaccgccagcgccgccccctcggtgcatcctcagtgcgtactgtctgtgcgaaggcgaccattccttcttcgctccttcgccgccgctatggttaagtactcgcaggagccgggcaaccctaccaaatcggccaaggccatgggaagggacctgagggtccacttcaagaacacaagggagacagcttttgcgcttcgcaagctgcctttgaccaaggctaagcgataccttgaggatgttattgctcacaagcaggcaattcccttccggagatactgtggaggtgttggtcgcaccgcacaagcaaaatctcgccactccaatgggcagggtcgctggcctgttaagtcagccaggttcatattggatttgctgaaaaatgctgagagtaacgctgatgtgaaaggcttggacgtggacaacctctatgtttcacacatccaggggaaccaagcccagaagcagaggcgccgccccttccgtgctcacggacgcattaacccttacatgtcctccccctggcacattggagctgattctgtcagaaaaaggaagagcccggtgaaaataggaggcctgacaaacattgtccccggccaaggaaaccattgaaatattgtttaccctggctgataaatgggcatccttttccgaaaaaattttaagcccggaagcccctttttatgggaaccctttttccggggggggggaccccaataaccccgggggaattggggaatatttcccn

SEQ ID NO: 89886 - protein, 174 aa, Zea mays
  misc_feature: Ceres CLONE 1577695
  misc_feature (17)..(150): Pfam Name: Ribosomal_L22 Pfam Description: Ribosomal protein L22p/L17e
MVKYSQEPGNPTKSAKAMGRDLRVHFKNTRETAFALRKLPLTKAKRYLEDVIAHKQAIPFRRYCGGVGRTAQAKSRHSNGQGRWPVKSARFILDLLKNAESNADVKGLDVDNLYVSHIQGNQAQKQRRRPFRAHGRINPYMSSPWHIGADSVRKRKSPVKIGGLTNIVPGQGNH

SEQ ID NO: 89887 - DNA, 854 bp, Zea mays
  misc_feature: Ceres CLONE 1577696
  misc_feature: Encodes the peptide sequence at SEQ ID NO. 89888
ctccccgcggtggcggccgctctagaactagtggatcccccgggctgcaggaattcgtctcacccctagaaaaaaacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgtcgcgtcgcccgcgcgcaccccccgcgccccgtcgtccaccggctcggtgaagaccgcgatgacgatgacggagaagatcctggcgagggcgtcggagcgcgcggcgctggagcccggggagaacgtgtgggtggacatcgacgtgctcatgacgcacgacgtctgcgggcccggcaccatcggcatctttcagaaagagttcggggaggatgcccagggctgggacccccagaaggtcgtcatcctcccccaacactacatcttcaccagggacgagcgcgccaaccgcaacgtcgatatcctcagggacttcctgtctggggcagaacatcaggtactttcttgattttcagggacctccgcgatttcaggggctaatcccaaattacagggggggcctggcccaattgcacttggctcagggaaggggccctgccggacctgggggaaggttccccccggggggaacggagttcctcaaaacctgggcagaggtcggggagccctttgggccaaatttggcaccccggaaattggggagagaacctgggt

SEQ ID NO: 89888 - protein, 157 aa, Zea mays
  misc_feature: Ceres CLONE 1577696
  misc_feature: SWISSPROT Homolog: EC 4.2.1.33 3-isopropylmalate dehydratase
MASSISAAAKASAAFAQKKELAAPAPHRAGSSRRTKPCRVRAVASPARTPRAPSSTGSVKTAMTMTEKILARASERAALEPGENVWVDIDVLMTHDVCGPGTIGIFQKEFGEDAQGWDPQKVVILPQHYIFTRDERANRNVDILRDFLSGAEHQVLS

SEQ ID NO: 89889 - DNA, 815 bp, Zea mays
  misc_feature: Ceres CLONE 1577697
ctggagctccccgcggtggcggccgctctagaactagtggatcccccgggctgcaggaattcgtctcacccctagaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagacgaaccggggaccgggcgccgggccagcggacccccgacaaggctctttgaggcctgctggccgtcgcccgccccatgaagctcccccatcatcggggcacctggaacctggaggggggaaaatccccctaacgtgtccccttggcggggttgggccaccaaggtaagggcccccggaaccggaaggctggttccgcccttcgggcgccgtggccaaaaacctgggggtgggttttttgttccccgcccccgggttcctcccaaaagggccgggggttccccccaccctatagaaacaacctgtttttttttccccccccgggccggggggggttcccccgtggggggtggcgccaaaaaattcttctctttgggggttgggggggcgcccccccccc

SEQ ID NO: 89890 - DNA, 855 bp, Zea mays
  misc_feature: Ceres CLONE 1577700
  misc_feature: Encodes the peptide sequence at SEQ ID NO. 89891
ggagctccccgcggtggcggccgctctagaactagtggatcccccgggctgcaggaattcgtctcacccctagaaaaatccggcctcgtcgggatccggtgctggattgacgcaatggcgccgctccacgccgcgctgccgccgccctcctccgccgccgctcaccaccacgcggcagccccgcctgtcttcctcgcccgctcgccgtaccacccccgcagggcggcggcctcctgcccgctcgccgtcgctgccgctccctcgtcgagaaaagcgttcttgtcgtgcccgctgctgggccactggaccacggccgcgccgccgcgcgccatcccctcctcgtcgtcgtcgtcgaccccggcgctcatcgcgtccgtgcaggacctgtatgacttcatctgctgcggcccgctggtggacaggatcggctacaccagtgagaagatcaccgagtccatcgaccgctggcttctcgccggggctagggtggcgcgcctcttccgcctcaacgagctccagctgtcggacgccgagaaggcccggatataccacttctacatccccgtcttcctctggtgcgaggacgaggtcatgttgcacagagccaggtacaacgacggcgaagacatccccccatttgggggtacgcactttccatgtcaggccctgggccaaaatttgctcccccctcccaatcccatggcaagttactacaaagttagaactatgcaaatcgaccctccttagaaagaagcaccaacggtaggcgcgcattcaaacggttgggccccaaaaaaaaaaccccctaaaaaaaaaaaccaaggggggaaaaaataaaaaaacctgaggggggat

SEQ ID NO: 89891 - protein, 210 aa, Zea mays
  misc_feature: Ceres CLONE 1577700
  misc_feature: SWISSPROT Homolog: EC 2.7.1.31 Glycerate kinase
MAPLHAALPPPSSAAAHHHAAAPPVFLARSPYHPRRAAASCPLAVAAAPSSRKAFLSCPLLGHWTTAAPPRAIPSSSSSSTPALIASVQDLYDFICCGPLVDRIGYTSEKITESIDRWLLAGARVARLFRLNELQLSDAEKARIYHFYIPVFLWCEDEVMLHRARYNDGEDIPPFGGTHFPCQALGQNLLPPPNPMASYYKVRTMQIDPP

SEQ ID NO: 89892 - DNA, 838 bp, Zea mays
  misc_feature: Ceres CLONE 1577702
  misc_feature: Encodes the peptide sequence at SEQ ID NO. 89893
ccccgcggtggcggccgctctagaactagtggatcccccgggctgcaggaattcgtctcacccctagaaaaagaaccgaacaaaccagcggagcgtgcggtgggtgatgataattcccacatccgctgctcggggtgcggtcggcgcgtgaggtgagaccgtgcgagagagccagagagggcaacgcagacaccaccgcggccctggcccacgcccacatcggctcccgcgtcggccccgcgtgcatccggccgcctttccgctcaccggacaccgccgcttcttgtcccctgtgggcccgtgacttggcctccctcgcacctcgcccccgccgattcagctctccttcctcgacgcaggcatcggggccactcatgcataacgttcgcacggtgttccgcttccgcccgtcttgagaaactaaacacacagagagagcagtacgggaccggggattggggtggcccgggccgggcaccagcggaaggaagaggttatcggcggcggtagacctcacggcgatggatatcacggaggtaacggtggtgcaccacgcagcgctcgtgctggcggcgctctgggtcgccgcggcatccggctggacgcacccggcgctcctcctcgtcgggctcctgtacatatttgcggtgaatcaacggtacacaatgaggctgtggaggcggatacagtatgaggaaaggaaatgcgccaatcagagaaaagctctctctgatgcagagactggcagggtgctttaatacgctgggggaaaagatttgggcagtttgccttggaaagggttgcatcccaccagttccttttacccataattcccggg

SEQ ID NO: 89893 - protein, 78 aa, Zea mays
  misc_feature: Ceres CLONE 1577702
MDITEVTVVHHAALVLAALWVAAASGWTHPALLLVGLLYIFAVNQRYTMRLWRRIQYEERKCANQRKALSDAETGRVL

SEQ ID NO: 89894 - DNA, 1951 bp, Zea mays
  misc_feature: Ceres CLONE 1577703
  misc_feature: Encodes the peptide sequence at SEQ ID NO. 89895
aaggccggatctttatcgggcctgcggcacctagcccagcgcttgcacctcacccaggacgaggcccagggaggatcctcccgactccgacgctgcgtaggactccccgactccgacggcgtccgcccgcgtcgcgtgccacgcccacgccacgccggccgccgcgaggaaagaacaccgggtacttccccttcccttacgctccagtttcacaagtcgcgagccgtgcgtcgcgtcgacgcgagttccgcgtgagggagcaggcagttgcagttggaggcggtgacgaaaccctaggacttgagctccagcgcacggctcgggtcctcctcaccgttcccggcgatggaccggcggcaggagctctgcaggaacttccagcgcggcagctgcaagtacggatcgcactgcaggtttgtgcacgcctcctctcagcagcagcagcaggcgaagcccaacccgtttgggttcggcttagggagtaggcagcagcaacagcagcagtcttcgtttcgtgcgcagttccagcagcagcagcagcagaagcccaacccgtttggatttggagtgcaaggcagtgcggctgcacagtccagaaacgctcctggccaggcaaagccatttcaaaataaatgggtaagggacccctcagccccaacgaagcaacaggaagcggcacagccaccagcagcagcccacacctcctgtacagatcctgagtcctgcaggcaacagattgccgaggattttaagaatgaaactccactctggaagcttacgtgctatgctcacctcaggagcggtccttgtgacatcacgggagatattagctttgaagagctgagagctaacgcgtatgagcaaggcaggcaagggcatcctctgcagtcaatagtagagggtgaaaaaaatttgaaaaatgcaaagctgacggactttaataattttctgaacacgccacgtctatcggtatcacaaactccaagctttccaactgtggcttccttccctgaagtgaaaaataactcagcatttggggtttctcaaaataatggaccaccagtgtttagtagtttcagtcaaattggagtaacaactaatatgggacctgggtccagaactacaccaggagtcccaaccaatactctttttggtcaatctacccaaccaagccatccaacatttcctgcacctacttttggtcgttctgatatgaaatttggagtttcaggtccatttggaagccagatatcacaacaatcatctgggacttttcaaggctcaaacatgtccagttttggcaatttctcaaagcctcatgccagctaccagcagtccccttcctcctctagccatcacagagacattgataggcagtcacaagatttacttagtggaattgtggttcctacaagtgccacaaatgaagctcctgttgaggacaataaaaatgaaaatcaggatgatagtatctggttgaaggaaaaatggtcaattggagagattccgctgggtgaaccgccacagaggcacgttagtcacgtgttttagcaacattcttgtatttctgtgtcgtggaaccactgtcaagtcagcttcactgtctccttccatattgtcgggacaccatcttacaatttctcctccaggttcataaccataacacgtcaaattgggggcataaaatgcacctgaaatgctgattgggcagcgtagaaacttcttgtatcctgcatcacatactctgtctctattgttttcttgttagctccatgtacttcgtcacattcagggctcgtaatatcccgatttcttgttttagggtttgttgagtttagctgtgggttttaaaaagccgttgcagctgttttttttttttgcggaaattgtaccatacatggaagcagtagtttttgaagaagcggaatttggttctaaaaaaaaaaaaaaa

SEQ ID NO: 89895 - protein, 401 aa, Zea mays
  misc_feature: Ceres CLONE 1577703
  misc_feature (3)..(28): Pfam Name: zf-CCCH Pfam Description: Zinc finger C-x8-C-x5-C-x3-H type (and similar)
MDRRQELCRNFQRGSCKYGSHCRFVHASSQQQQQAKPNPFGFGLGSRQQQQQQSSFRAQFQQQQQQKPNPFGFGVQGSAAAQSRNAPGQAKPFQNKWVRDPSAPTKQQEAAQPPAAAHTSCTDPESCRQQIAEDFKNETPLWKLTCYAHLRSGPCDITGDISFEELRANAYEQGRQGHPLQSIVEGEKNLKNAKLTDFNNFLNTPRLSVSQTPSFPTVASFPEVKNNSAFGVSQNNGPPVFSSFSQIGVTTNMGPGSRTTPGVPTNTLFGQSTQPSHPTFPAPTFGRSDMKFGVSGPFGSQISQQSSGTFQGSNMSSFGNFSKPHASYQQSPSSSSHHRDIDRQSQDLLSGIVVPTSATNEAPVEDNKNENQDDSIWLKEKWSIGEIPLGEPPQRHVSHVF

SEQ ID NO: 89896 - DNA, 835 bp, Zea mays
  misc_feature: Ceres CLONE 1577705
  misc_feature: Encodes the peptide sequence at SEQ ID NO. 89897
  misc_feature (835)..(835): n is a, c, t, g, unknown, or other
gagctcaccgcggtggcggccgctctagaactagtggatcccccgggctgcaggaattcgtctcacccctagaaaaaaaaaaaaatttttttctcctctcctctcccctcccctcgctcgttcgtcgcgtcctcctcagatcaacaaaccgtgtcctgctgcctctggaaaccaccgggggatcgccccgccctttccttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcaggcccccgtgccggtgctggaggtgcagtaccaccggcgcgcgacgaccaagggggttgacgacgtcgtcgggatgtccgcgcccgcccccgcggaggttggggttggggttgggggttgagggccactgcccggattccctcccccgtttagggactcgtccccccctagggagccccgccgggcggataagtccataaccgcgccgcgtctccgacaaggagcgcgcaaagagtgcatgcgcgtcgggttttctgtgtagatcgcactttcgagtttccaactgccaatggaactccgcccccccaagcaccgggggcgaatgtggcaagacctacgggcggaagggcccctctggactcccgcgccgggctcactcactgccgtgcacgggttgaaacagccgcccctggatgttattaaatcgacgtgcaagagtgagn

SEQ ID NO: 89897 - protein, 49 aa, Zea mays
  misc_feature: Ceres CLONE 1577705
MVAEAEVMHQAPVPVLEVQYHRRATTKGVDDVVGMSAPAPAEVGVGVGG

SEQ ID NO: 89898 - DNA, 810 bp, Zea mays
  misc_feature: Ceres CLONE 1577707
  misc_feature: Encodes the peptide sequence at SEQ ID NO. 89899
gcggtggcggccgctctagaactagtggatcccccgggctgcaggaattcgtctcacccctagaaaaaggatccattgactgccttccctacgatagtttctctcattccgttctcatcttggatgggtgcgtgcacctccatggaaatccgggagttaccccggaggtgacactacatgtatgcttgctggacgtaatgatggctgcatacttgtacatctatcagattgaagagctgatgtgcgagctctctatgtggcgctgcgacgatgagcttctcgtgcgtgcctaagagctccacagttcgtctggttcgcaagttgccccgtcttacatagaattctggaggcagattcctccaaacgagcgctctaccgggtgatactaggccatgtgagtggacaagctgtacaacacatgcgagcgtgctctccatctgctgggatctggagtttctgaaatttcagcggaatcgtcatttaccagtatcggatagttccttgagccacgtgagcagtgctacacatcactgtgtgactgcggcgacaaggccatcgcggacggcagcctcctagcacctctgcagcgggtgttcacgttcgggctctccctcgtgcaggctgacatccgggaaggaatctgagcggcacatccgacgggatcgaacccttcacaccgaacttcggaatggggatggaaaccccgagggggctaggaccttagggaggaagtggtttcttttttggacttccaaagaaatgtcccttttgatgcccccggaaactttttccgaaaaacaagaatatccc

SEQ ID NO: 89899 - protein, 96 aa, Zea mays
  misc_feature: Ceres CLONE 1577707
  misc_feature: SWISSPROT Homolog: EC 4.1.1.31 Phosphoenolpyruvate carboxylase
GGGRSRTSGSPGLQEFVSPLEKGSIDCLPYDSFSHSVLILDGCVHLHGNPGVTPEVTLHVCLLDVMMAAYLYIYQIEELMCELSMWRCDDELLVRA

SEQ ID NO: 89900 - DNA, 868 bp, Zea mays
  misc_feature: Ceres CLONE 1577711
  misc_feature: Encodes the peptide sequence at SEQ ID NO. 89901
gcggtggcggccgctctagaactagtggatcccccgggctgcaggaattcgtctcacccctagaaaaaatggtgttccggaaaggaccctggcctttcttatagcccaagccactcccttcttcctcctctcacctctctcgaaactttccccaatcccatctcctgcccccctcttccaaccctatccacgccgccgccagccctgctcgggtggtgcgcatacatgaaccatccgtcctcgtcttcgtcctccgcccagccgccgccagccccggcggcggcggccgaggccacctccctcgcgccgggcttccgcttccaccccaccgacgaggagctcgtctcctactacctcaagcgcaaggtcctcggccgcccgctcaaggttgatgccatcgccgatgtggacctttacaagctcgagccctgggacctgcccgcccgctcccgcctccgctcccgcgactcccagtggtacttcttcagccgcctcgaccgcaagcacgccaaccgcgcccgcaccaaccgcgccacgtcgggaggggactggaagaccaccgggaaggacagggaagggcgccatgggcccagggcttgtcggggatgaaaaaaaaccccgtattccacgcggggaggcgcccccaagggggaaaagcacccaccggggtcatggcacgaatacccgcccccgagggcgaacaacgcccccagggaaaccggaggtgaaaaaaggaaaatgggccaaaattgtaaacgccggaattgtggtaaaccaaaggggcttaaacctttacttttcttttgcacgcccccgtgaaatgggcacccctttatacaaatgggccccgggtaacattagagacacg

SEQ ID NO: 89901 - protein, 127 aa, Zea mays
  misc_feature: Ceres CLONE 1577711
  misc_feature (26)..(128): Pfam Name: NAM Pfam Description: No apical meristem (NAM) protein
MNHPSSSSSSAQPPPAPAAAAEATSLAPGFRFHPTDEELVSYYLKRKVLGRPLKVDAIADVDLYKLEPWDLPARSRLRSRDSQWYFFSRLDRKHANRARTNRATSGGDWKTTGKDREGRHGPRACRG

SEQ ID NO: 89902 - DNA, 910 bp, Zea mays
  misc_feature: Ceres CLONE 1577712
  misc_feature (163)..(163): n is a, c, t, g, unknown, or other
  misc_feature (242)..(242): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (377)..(377): n is a, c, t, g, unknown, or other
  misc_feature (378)..(378): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (388)..(388): n is a, c, t, g, unknown, or other
  misc_feature (525)..(525): n is a, c, t, g, unknown, or other
  misc_feature (526)..(526): n is a, c, t, g, unknown, or other
  misc_feature (910)..(910): n is a, c, t, g, unknown, or other
ggcggccgctctagaactagtggatcccccgggctgcaggaattcgtctcacccctagaaaaaagaagccgcagccacgccccacgcccccacaccaagacgtatcgtcttctccctcttgtccggttcgggtggtccgcggtcggggtgagtgagtgagcanctttgcttctccatctccccattcccttccctccccagcccccccggcccggcggcggtacgtgaccctgacgccgcancgctagctagctcgccggaacggcaggtggcggcgcgcgaccttatatcacaacagcaccggaccggctcaggcaggcgaccggttttttttccctccccaaggaggagaatgaaaggggggggggcnnncnncnncnncnnncnncccccccccctccaacggaaaaagcgtgcttgccccggccgcccaagggggccccgggttccccccccgccgtttggagggccattgggaaaaaaggccccccggggaaaaaaattctctcatccgttccacctgcnnttgttccaactgggaagtggggaattttagcagaccccggtattttccttttgcgggaggggatggatttttgtggaactccccagtcttcttccataacaataaaatctgcgagggtagtatcccacaaggggctcctctcgagtccacccctacttgtgggacggacaagaaagtgtaacgagagtccggggtgtgagagaatcgctgtccacgaatcctggcctcgcgggggtcccccctataggtcctgagacagcgcgcgtttctcttaagacttgtgccggctaccttaatgtaaatagacgacgtgagttttgagctactcgggacatccattcgagtcaaactcttgagcgagggcccgctctctctttggtatan

SEQ ID NO: 89903 - DNA, 831 bp, Zea mays
  misc_feature: Ceres CLONE 1577713
  misc_feature: Encodes the peptide sequence at SEQ ID NO. 89904
  misc_feature (646)..(646): n is a, c, t, g, unknown, or other
ctccccgcggtggcggccgctctagaactagtggatcccccgggctgcaggaattcgtctcacccctagaaaaaacgctgccctcggcgctgcgcctggacccggcacctacctcccccctccccacctcgccgccggcgggtggagtcgggctggagcagccgctctcctctgttacccccctaaccccctataaagaaaaagaaaaaaaaacagagagagagagcgagcgaccggcggctcggcagccatggggcacggcgtcagctgcgcccgcaccggcgacgagcacgactacttccgcgcggcgcaggtcggggacctcgaggccctggacgcgctcctcgacgccgacccctctctcgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagactgactgcgtgctgaagctcctgcaggccggcgccaatatcctcatgttcgattcccagcacgggcgggaccctgctgcaacacgcgtcctacttccggcacgtcggctgcctgcaggncatcttcaaggcggcccggaccaagccgggtggccgaactcatgggggtttccccccggttccgccaaaccgtgagggaacaaacaagggggcccaggccggtttaaacttttcccccagagggaggggccccccccggggtttttttttaaagggcctcttttggagaaaacaggcgccccccc

SEQ ID NO: 89904 - protein, 156 aa, Zea mays
  misc_feature: Ceres CLONE 1577713
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGVSCARTGDEHDYFRAAQVGDLEALDALLDADPSLARRATLYDRLSALHIAAANGRLEVLSMVLDHGVPPDVVNRHKQTPLMLAAMHGKTDCVLKLLQAGANILMFDSQHGRDPAATRVLLPARRLPAGHLQGGPDQAGWPNSWGFPPGSAKP

SEQ ID NO: 89905 - DNA, 777 bp, Zea mays
  misc_feature: Ceres CLONE 1577716
  misc_feature: Encodes the peptide sequence at SEQ ID NO. 89906
ctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctcccagggcgagtcggcgggcccggggggcttcgtcgccttcgtcggcaacctcctctttccttttatcgcgttcgctgggcctcttctcatcttccgccgcggcgcaaggcggggccccggcgcccgggcctggggga

SEQ ID NO: 89906 - protein, 210 aa, Zea mays
  misc_feature: Ceres CLONE 1577716
  misc_feature (103)..(207): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSQGESAGPGGFVAFVGNLLFPFIAFAGPLLIFRRGARRGPGARAWG

SEQ ID NO: 89907 - DNA, 994 bp, Zea mays
  misc_feature: Ceres CLONE 1577719
  misc_feature (158)..(158): n is a, c, t, g, unknown, or other
  misc_feature (983)..(983): n is a, c, t, g, unknown, or other
ggagctcaccgcggtggcggccgctctagactagtggatcccccgggctgcaggaattcgtctcacccctagaaaaagcttggttcaggcagtttctacttcttcagagttcggggaggcgaggcgaggcgaggcgtggagggattgggaattttttngggaggggaggaggcgtgagcgggaggaaagtgaagagagagtagcttccgatctcgattaccccggtctccgtatcgggaatccaattcggttccatccagcgcctgagatcggattccaacccccatttcggaccgatcgctttccacaaaccgatcggctttgggggattttttttcccgagcgatttttctgggaggctcgatgggggtgggccggaatttagttgaacgcgggacggtgccagtcggaggagcttgcgggtcgatccgggtggaagaacaatagtgagggcgggggaaatataaactacttgctggtctgcgccgcggggcattgcgtacccccccgtaagggccaaaaagtgtaaattgttttacccccgtgcggcccttcctaaccccgttaaatatgccgctaccggggaggggtttgtataacaccttcagaatttgccttttccctacaccccgacccgctgggggcgtacccaacccgcgtacgtgagaggaaaagtaaggattgctccaaaaatgaccactcttcccctctgtgggaggggggatttcgaccactccaaccgagagcctcccggagggggtgtcttcttctcccacaagtgtggtgggtacgcgacagattacgcggtagtgcttcggcgaattatcgggtggttaccagggagatgatgattatgtcgagaaagggcgcggttatttacgccatctctggcggtgggagaagtcgtccgccggaggtgcctgcgtgggtgtcgcgtcgtgtgagacgcgtgtgaggggtcgctgtgggagcggggtgccgcngtggtgggtcg

SEQ ID NO: 89908 - DNA, 824 bp, Zea mays
  misc_feature: Ceres CLONE 1577720
  misc_feature: Encodes the peptide sequence at SEQ ID NO. 89909
  misc_feature (587)..(587): n is a, c, t, g, unknown, or other
ccccgcggtggcggccgctctagaactagtggatcccccgggctgcaggaattcgtctcacccctagaaaaaaagcaaatccatatgctcagctcccgcctcctcccatccccggaccccggaccccggccatgggcgcttgcttctcctccgcctctgccgcccccgccggcgccgccgtcgacgagcgccgcccgtccaaggagggcgacggcaagaagaggcgccgcgccgccggggcatcgccggatgccgcggcgcccgtgcgcgtggagttcggctacgagagggacttcgaggcgcgctacgaggtcggccgcctgctcggccacggccagttcggctacaccttcgccgccaccgaccgcggctctggggaccgcgttgccgtcaagcgcatcgacaaggccaagatgacccgccctgttgctgtggaggatgtgaaaagagaagtgaagattcttaaagcacttaaaggacatcagaatattgttcacttctacaatgcatttgaggatgattcatacgtgtacattgtgatggagctatgtgagggcggtgaactattagatcggattttggcaaanaagaatagccgctatagtgagaaagatgctgcagtggtagtccgccaaatgctcaaagtagctgctgaatgccatctgcggtgggttagttcaccgagatatgaagcctgaggtagaaatcaaatacttcaatctctttgccacagtaagcatttggtgatatttcactacttcctcaggtcatgtaagactgtacctattttcctccccagaacttccttttcaatcgaagcaggg

SEQ ID NO: 89909 - protein, 188 aa, Zea mays
  misc_feature: Ceres CLONE 1577720
  misc_feature (59)..(189): Pfam Name: Pkinase_Tyr Pfam Description: Protein tyrosine kinase
  misc_feature: SWISSPROT Homolog: EC 2.7.11.1 Non-specific serine/threonine protein kinase
  misc_feature (152)..(152): Xaa is any aa, unknown, or other
MGACFSSASAAPAGAAVDERRPSKEGDGKKRRRAAGASPDAAAPVRVEFGYERDFEARYEVGRLLGHGQFGYTFAATDRGSGDRVAVKRIDKAKMTRPVAVEDVKREVKILKALKGHQNIVHFYNAFEDDSYVYIVMELCEGGELLDRILAXKNSRYSEKDAAVVVRQMLKVAAECHLRWVSSPRYEA

SEQ ID NO: 89910 - DNA, 804 bp, Zea mays
  misc_feature: Ceres CLONE 1577721
  misc_feature: Encodes the peptide sequence at SEQ ID NO. 89911
ctggagctccccgcggtggcggccgctctagaactagtggatcccccgggctgcaggaattcgtctcacccctagaaaaagctcccaaccatttctgcgcgtgcgcctccaccgccagaaccccgaagaagagcatccccctccttggagattttcagtaaccgttcctgctcgacgccgacggcatgccgaccgagcgcgtcgatgtcgcggtctcctcacggacgctgctgcgggcgtccgacccgcctccggacttccccgcggtgctccaggcgtccaacctcgacctcatactcggttccttccacatctacctcatcgccatgtaccccgccccggccgcgggcttccccgccgtggtagctgccgcgcgggccgccatgcccgctttcctctctcgcttcttccctttcgctggccgcgtcgtcgccaacgccgacaccggcgtgcccgagatcgcgtgcgacaacaccggcgcggagctcgtggtggcgcgcgctggggtgaggctcgcggacgtcgacttcgcggacgccgaccgctcgctgggccgcatcgcggtgccgtttcagcaggacctcgcgctgtcgctgcagctggtgcggttcgcgtgcggcgggttcgcgctgtcgtggggggacaaccacctgctcgtggacggccacggtctgacggggcttgccagcgcgtgggcggagctgctccgcaccggcgggctcctcgtgggagcctcacaacgagcggggcttcgctcttccgggcgcggggaaaccgcgcgggtacagcgcgtcgcttggaacc

SEQ ID NO: 89911 - protein, 206 aa, Zea mays
  misc_feature: Ceres CLONE 1577721
  misc_feature: SWISSPROT Homolog: EC 2.3.1.166 2-alpha-hydroxytaxane 2-O-benzoyltransferase
MPTERVDVAVSSRTLLRASDPPPDFPAVLQASNLDLILGSFHIYLIAMYPAPAAGFPAVVAAARAAMPAFLSRFFPFAGRVVANADTGVPEIACDNTGAELVVARAGVRLADVDFADADRSLGRIAVPFQQDLALSLQLVRFACGGFALSWGDNHLLVDGHGLTGLASAWAELLRTGGLLVGASQRAGLRSSGRGETARVQRVAWN

SEQ ID NO: 89912 - DNA, 936 bp, Zea mays
  misc_feature: Ceres CLONE 1577725
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (28)..(28): n is a, c, t, g, unknown, or other
  misc_feature (38)..(38): n is a, c, t, g, unknown, or other
  misc_feature (40)..(40): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
nnnnnnnnnnnccccccccccccccccnggggaaaaanancanaccccccnnnnnnnnnnnnaataaannnnnaaaaaaggaactcccggcggtggcggccgctctagactagtggatcccccgggctgcaggaattcgtctcacccctagaaaaaaggaatccaagccaccccagtccgctgcttccattccatctcccttctctcgccttctgcggcactgcagtgctctgctgcctcggcgtctccacctcctcccggcgacggcagggcatccgatacgacgccgcgcttccttccgaatcccaagccgcaccccgcaccctcccggtcgccattcccgatgctggtgttctcgagcgacgacgactgctgcggctcctcgtactaggggggcaggatcgatcggcagactcgcagaactataggatatcacagaacagttcttgaggtacttattgcagcctaatagtacatggagcgatattcagatatgagaccaaaggcagaagtttcatatctcggaaggggttccagattctcttctagaaatcaaagttcagaagagaggactaaccatagcagcgataaaccgggaagcagcacaagattcaatcctacgaaagcgagaattggcggtaatcaagggaggccaagatatgtatgcgattcatttaaatctccaagctcaaaggtgtcgcctgcaggctcttccaaatttccacttagcaagttttgaggagaggcgaaggacagcctttttgtgcccagggtttgacatttgctggaaagtagtaagaagaaaaggctgatgccaaagcagcctacaaggttagtaaaggaaaaatggctggcaaaagaacgaccagttccaaacaattccggccaagggggaattcaagaaagggtttttacttacctgaaaccaaagtaaga

SEQ ID NO: 89913 - DNA, 810 bp, Zea mays
  misc_feature: Ceres CLONE 1577726
ctccccgcggtggcggccgctctagaactagtggatcccccgggctgcaggaattcgtctcacccctagaaaaagcttggttcaggcagtttctacttcttcagagttcggggaggcgaggcgaggcgaggcgtggagggattgggaattttttgggaggggaggaggcgtgagcgggaggaaagtgaagagagagtagcttccgatctcgattaccccggtctccgtatcgggaatccaattcggttccatccaacgcctgagatcggattccaacccccatttcggaccgatcgctttccgcagaccgatcggctttgggggattttttttcccgagcgatttttctggaggctcagatcgggtcggtctgattttagttgatcgcggagcgaccccaatcgagagcttccgggcgatccgggtggaggacgaggtgagggcggggaggatcagctgctgctgccacgccgcgaggatggcgaccccacatagggcgagattggactggtgatgcgggtggcccgcccactcttagcgcgccccggtgggggtaaccgctctggatgctttttcaacccggaagcgggtgttcaacgtctggcaaggaatcggggtgaacgaagcactttcaaccgggggggattacgattcccctaggggcacgggggggttttttttcccccaattttgaaccaaaggtttttccgtacctgaaaattggggaggtcccccgggccccccgtattcccctgggcaaaaaggggtggaaccttttggtgggggggacatttttaaacacagcccccg

SEQ ID NO: 89914 - DNA, 773 bp, Zea mays
  misc_feature: Ceres CLONE 1577734
  misc_feature (442)..(442): n is a, c, t, g, unknown, or other
tggagctccccgcggtggcggccgctctagaactagtggatcccccgggctgcaggaattcgtctcacccctagaaaaaccccggccctgctggcccttctgcctgccactcctccctcctctcttcgttgcccctgccgtattcactttcactcgttcgtccatccttccacgccccccacagaaccgtctccccagcccggcgcctcacggtcgcaatttattgcttgcgcaccgcctcgccgctttggcgtggggcgtttgcctgtgtggcgctgggcatgtgccgtgcccgtggcttgcttcgtcgtgctcactagtcacgagagagggaggaggctctgcttctgctgccgcttcttcttctcctgctgctcttccggagataagcagggggccgggacagctgactagctgaaaggcatggggatggacgccggcngcggcaagctgccgtacagctacgccggccagcaggacggcgggaagctggtgaagagcgtcagcccgcgtggaagccccgcaagttcgggcctgggcctccgtggggggcttcctccgtcgtcaactgggcctacctcttcaccgccaaggttcgacgccctcccgaattgccattgaaccggcgaacccgtctcccagaaatgggggcgggggtcggagtccggcccccctgggaatgggggggcccccccccccccaaaaccttccaaagccctccagggaaggggatttaaattttggggccccaatttcccaggggcccaagggag

SEQ ID NO: 89915 - DNA, 976 bp, Zea mays
  misc_feature: Ceres CLONE 1577735
  misc_feature: Translation starting site: 127
  misc_feature: SWISSPROT Homolog: EC 5.3.4.1 Protein disulfide-isomerase
  misc_feature (257)..(257): n is a, c, t, g, unknown, or other
  misc_feature (258)..(258): n is a, c, t, g, unknown, or other
  misc_feature (509)..(509): n is a, c, t, g, unknown, or other
  misc_feature (510)..(510): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
tccccgcggtggcggccgctctagaactagtggatcccccgggctgcaggaattcgtctcacccctagaaaaatgtctcacccctccggacgaaatctgacctgggccacactccgctgctccgccatggcgatccgctccaaggcctggatctcgctgctgctcgcgctggccgtcgcgctctccgcccgggcggaggaggagcccgccgccgcggcggagggcgaggccgtgctcaccctcgacgtcgacagctnntcgacgaggccgtcgccaagcaccccttcatggtcgtcgagttctacgccccctggtgtgggcactgcaagaaacttgctccagagtatgagaatgcggccaaggcacttagcaaggcatgaccccaccgatttggttctccccctaaaggtttggatgcctaaacgaggaaaaaggaacaggcccgctttggctaccaaggtacgaaaattcccaagggggtcccccaaaccccttccaaaaattctttnnaagggaagccaggggagaagaaaaccttttcggggaaattccaggggggccccttagggggggggccttgatatggccctttttttggggaatatttccctgtgtaaaaaaaaaccccggggttgttggggccccccnnnnncccgccccccagggggggggtttcacttgtccccctaccaaaaaagaatgggcgcggggcccctctcttttgtggtgggaaaaaaaaaaaaaaacccccccctttggtgggggatctctcgggggggccgggaaaatattttgggggggcgccccgaaaattatctaacacaccctctttggggagggggggcgccaaaaacagatatctgtgggggggcgctcaccaccccccaattggtggggcgccccatcttgtgtgtggcggccccccccacccccccccctccgggggtgggaagccccgcaacaagaagacgaccgg

SEQ ID NO: 89916 - DNA, 964 bp, Zea mays
  misc_feature: Ceres CLONE 1577737
  misc_feature: Encodes the peptide sequence at SEQ ID NO. 89917
ctggagctccccgcggtggcggccgctctagaactagtggatcccccgggctgcaggaattcgtctcacccctagaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgagggtgaaattatctttggtcctcggggaacaccccccaccaagaccccgtgggggccttggaacctgggcaagggctgcccgaaccttcaccttactgtgggagaaagcgctgcccccgcatgaatttgggcgaagtgtcttcccaagttcttgaaacaagaatttgttttgtttgaaaaaaaatcccccctggttccccctggttcaaaaaccccgcctggagagggttattggaaaaagaattatttggaacccccccccacaggccaagggggctcctcaacctaacccaaaaatccttttttccaacccccgagaatttccccttttgggggagggggcacttgcgccctttgtgggggaaccttttttttaaacaccttggaaaacaaggtggtctttttcgcgggggggcgcgggggagaaccacccctggggagggggggggaagagggcggtctccacggggccccttaaaggagggg

SEQ ID NO: 89917 - protein, 118 aa, Zea mays
  misc_feature: Ceres CLONE 1577737
  misc_feature (2)..(119): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDVEKHVAEGEIIFGPRGTPPTKTPWGPWNLGKGCPNLHLTVGESAAPA

SEQ ID NO: 89918 - DNA, 824 bp, Zea mays
  misc_feature: Ceres CLONE 1577738
  misc_feature: Translation starting site: 189
  misc_feature (412)..(412): n is a, c, t, g, unknown, or other
  misc_feature (416)..(416): n is a, c, t, g, unknown, or other
  misc_feature (424)..(424): n is a, c, t, g, unknown, or other
  misc_feature (564)..(564): n is a, c, t, g, unknown, or other
ctggagctccccgcggtggcggccgctctagaactagtggatcccccgggctgcaggaattcgtctcacccctagaaaaaaaggcagcggcagccggccggcagcggcaacggcgtaactcccaagtcacctccgcctcgggctccaaaaatccccacccgacctcgagactgagcggaccgacggtgatgtcgtcgtcggtgcccccgccaccgccccagcaggagctggagtcgccctccgccggcggcgacaaggtcctggccgcagcgcagcacatcgtcaagtccctcgccacctccaagaacgccgctgacgacatgatccgcatactctccggcttcgacaaccgcctctcctccatcaccaacgaccacctcttcccctcacccgaccttaccgccgccctcgncctncgagatcntccgccgcgccgcctcctttcgacgccgccgaccagctcatccagctctgggacgccaccccggacgcgctcgtcttcgaggccccggaggacacatcgcgcatacctcgccggcgtggacgtcgccatcgacacctccncccgcggggcccccggcggcccccgggcccggcttcccctccaatttcgccttggggggccttcaaggaggactgcccccccttcgtggtccggccagcgcgtcccattgaaaccacgggggcttttttttttggccccccgccttttggttgggggcccggggagaaccttaaggcccgggccccaatttttaagccccccccgccccaaaaattcttgaaacccccccccgggggggcggagaaataccgcggggcgg

SEQ ID NO: 89919 - DNA, 842 bp, Zea mays
  misc_feature: Ceres CLONE 1577740
tccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataacattgaacttcagcaccgcttcggcgacccccgacaagtacaagagcttcatcgcttctgttcgtgctgggcttgatgagcaaagcgggtgggcaccaggcagacgggatcccccgtggcctggtcgattgaagaacgacccggatcggggctcggaaatcgtttctaaaacatccacctctggatggaacaaaggaaggggccgcttcccccaaagctttgaaaaatggaattttttccccaaagccctaccttcgtggggtttacataaaaaggggcaaaggcctccggggccctcccccagaaaaaaacggggccgccacgttttctcttctgggggaaatttttttattattaaggggggggccccggggggggaaaaaaaattttccgggctcccctggggttttaaccccagaagaaccgcggggtgtccttttctcccaggggggggggaaataaaacacccggttgtttgtgtttcccccggggggaaaatacttggggtaaagggggaggagaaattttt

SEQ ID NO: 89920 - DNA, 819 bp, Zea mays
  misc_feature: Ceres CLONE 1577741
  misc_feature: Encodes the peptide sequence at SEQ ID NO. 89921
  misc_feature (751)..(751): n is a, c, t, g, unknown, or other
tccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgaggcaaccgctgctgctattgcctatggtnctgaacagaaagcaaccagcgtcggtgaggagaatgtcctcatctttgaccttggaggtgggacttta

SEQ ID NO: 89921 - protein, 211 aa, Zea mays
  misc_feature: Ceres CLONE 1577741
  misc_feature (9)..(211): Pfam Name: HSP70 Pfam Description: Hsp70 protein
  misc_feature (189)..(189): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISSMVLIKMREIAEAYLGSTIKNAVVTVPAYFNDSQRQATKDAGVIAGLNVLRIINEATAAAIAYGXEQKATSVGEENVLIFDLGGGTL

SEQ ID NO: 89922 - DNA, 736 bp, Zea mays
  misc_feature: Ceres CLONE 1577742
  misc_feature: Encodes the peptide sequence at SEQ ID NO. 89923
gctccccgcggtggcggccgctctagaactagtggatcccccgggctgcaggaattcgtctcacccctagaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggaccccggtgggccgttgctcatcgccgggctccaacggctactacaaactaccggccacaaggcgggacattctgccattaccaagattcattgaaaaaaagggggggggaccttaagggacgaaaaaacctccggttggccttcccggggaaccaatagaaaacttcccccccaataggcccccgggaaaaaacccccgaaggcccccgggggggcccccccccaaaaaaacccccccccccccccagggggtggggcgcaaaaaccctctttttggccggggggggggggcgccccaaaaagaaattttaaaccctcgggggggggaaaaaaattttttccacccccccgccgccaaaaaaattttttttttcctcccccccggttttcttcccccgctttgggggggaaaaaaaaaaaaaaaagatgca

SEQ ID NO: 89923 - protein, 85 aa, Zea mays
  misc_feature: Ceres CLONE 1577742
MVADRLRLALLLSACLCSAWARPRLEPTIRLPSERAAADETDDDAVGTPVGRCSSPGSNGYYKLPATRRDILPLPRFIEKKGGGP

SEQ ID NO: 89924 - DNA, 875 bp, Zea mays
  misc_feature: Ceres CLONE 1577750
  misc_feature (295)..(295): n is a, c, t, g, unknown, or other
  misc_feature (297)..(297): n is a, c, t, g, unknown, or other
  misc_feature (307)..(307): n is a, c, t, g, unknown, or other
  misc_feature (310)..(310): n is a, c, t, g, unknown, or other
ctccccgcggtggcggccgctctagaactagtggatcccccgggctgcaggaattcgtctcacccctagaaaaaacttgccccctcttatcagagagagtggtgtggtggcgcctccccaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgccggaatgcccgtggaaggaggggananagggagggcncangcgcagctgagctgagctgagcccgcgaggttcgcggtctgcggggggggccccccacgcctcgccaggcgcgatggccaagcggcggctccctcaaggaacagcctcttaccaaggggcccggggctgtcgccggcccccctcgcggaaggcgggcccaccttgtcctgggctcggaggaaccggtaccgacctcggggcccgccaacttgggggtggggggcccagttcggggggtgaacccgggtcccggggtcagaaacggggggtacgcgggggagagggcccgggcccggccaattcccatcccccccgggggcccggcgtgcgggtgccccccgcgaagaaattgtgccgggagggggggggggggaaagaaatggaagcttcctgtggacggctccgcgtgtgggggcacccacgaaaaacactatagggaggggctacaagacgtgtacgttttagcaaggaaagaaccgacagaactaggtggtgcaaaccaccatcaggaaaggggaggtcgttacgtcccggtggggaggaggaatgtgtcttctcggcagaa

SEQ ID NO: 89925 - DNA, 825 bp, Zea mays
  misc_feature: Ceres CLONE 1577751
  misc_feature: Encodes the peptide sequence at SEQ ID NO. 89926
ggagctccccgcggtggcggccgctctagaactagtggatcccccgggctgcaggaattcgtctcacccctagaaaaagtttcgtttcgtatcggatcgtgccgctgccgctcttcccttctcgtctagtcttgtttttctttcctcctctgttactccacctacagacctactactgccatcgggagggtaagctcttcggagccggagccgggtccacgttaacgccatcgagcgctgcgatgggcagcttaggagggagcgccggtgctggggacggcggcaaggtcgggctgccggcgcttgacgtgacgctcgcgttcccgcaggccacgcccgcatcgctcttcccgccagccgtttcggactactaccaatttgatgatttgctgactgatgaagagaaggcactcaggaagaaggtccgaggtatcatggaaaaggaaattgcgcccattatgactgagtactgggagaaggctgaattcccattccatgccattcccagccttgccagtcttggtttagctggtggtacaataaaggggtatgggtgccctggactctcgcttacagctagtgctatttccatagcaaaagttgcacgggtcgatgcgagctgctccacatttattctagtgcactcctcgttggctatgtccacaattggcctttgtggatctgagggtaaaagcaaaaatactaccatctcttacccagttcaaaactattggttgctgggcattgacagagcccgattatggagggatgcaagcttccctaggactgcaacaacaaggaacctgggggggttggcatttaaac

SEQ ID NO: 89926 - protein, 194 aa, Zea mays
  misc_feature: Ceres CLONE 1577751
  misc_feature (51)..(150): Pfam Name: Acyl-CoA_dh_N Pfam Description: Acyl-CoA dehydrogenase, N-terminal domain
  misc_feature: SWISSPROT Homolog: EC 1.3.3.6 Acyl-CoA oxidase
MGSLGGSAGAGDGGKVGLPALDVTLAFPQATPASLFPPAVSDYYQFDDLLTDEEKALRKKVRGIMEKEIAPIMTEYWEKAEFPFHAIPSLASLGLAGGTIKGYGCPGLSLTASAISIAKVARVDASCSTFILVHSSLAMSTIGLCGSEGKSKNTTISYPVQNYWLLGIDRARLWRDASFPRTATTRNLGGLAFK

SEQ ID NO: 89927 - DNA, 941 bp, Zea mays
  misc_feature: Ceres CLONE 1577753
  misc_feature: Encodes the peptide sequence at SEQ ID NO. 89928
  misc_feature (762)..(762): n is a, c, t, g, unknown, or other
  misc_feature (839)..(839): n is a, c, t, g, unknown, or other
tggagctcaccgcggtggcggccgctctagaactagtggatcccccgggctgcaggaattcgtctcacccctagaaaaaaaccaactcatgctcgacggaccacctcgtcggagcttcgcatttatcgtgccgtccatgtccatgcaacagccgacgaacgccgcaagccaacttcacgccgcgatggaagcgccattgtcgctctcgtcactgcagctcgccttcacggcggtcgcggcgatcgcggcgctggccgtcgcggtggccgtcacgaggtacaaccggagatacatgggcctgaggctgcctccgggcccgcccgggtgggccgtcgtcagcaacctcttccaggtggcgtttcccgggaaaggtcttcatccactacatccggcgaggctccccaaggaaggtaggccccccttcctgaacctttgggcagtggggggaagccccccccccccgggatcatccacccagcccccccaaattgggcccccacgaaaggcggcttgggggggaaaaaaagggggcggggaatgtttcccagaaccccggccccccggggaaaaaaaaaacccaatgggggcaaaaaaataatttttcttcggtcttaaacaaagggatttccaccgcggggtaaaaatcccccgggtggcggggtaacgggggccccccaagagcgggggggggaccctttgggccccgccggagaacaacaggggggtgcccccggggaaagcgcttaaaaccaccggccctcncccgccctccgggattattttcttggagacagaccccaaaaaaacaccccacccccctggaaacccggtttattggngtggcgcgaaagagcacaccccccatgtgacgcgccattcatatcgccccctagaggggagcacgagtaccccccgggggcctccccaaatcaccgctgtga

SEQ ID NO: 89928 - protein, 137 aa, Zea mays
  misc_feature: Ceres CLONE 1577753
MEAPLSLSSLQLAFTAVAAIAALAVAVAVTRYNRRYMGLRLPPGPPGWAVVSNLFQVAFPGKGLHPLHPARLPKEGRPPFLNLWAVGGSPPPPGSSTQPPQIGPPRKAAWGGKKGGGECFPEPRPPGEKKNPMGAKK

SEQ ID NO: 89929 - DNA, 875 bp, Zea mays
  misc_feature: Ceres CLONE 1577754
  misc_feature: Encodes the peptide sequence at SEQ ID NO. 89930
  misc_feature (749)..(749): n is a, c, t, g, unknown, or other
tggagctccccgcggtggcggccgctctagaactagtggatcccccgggctgcaggaattcgtctcacccctagaaaaaagagtcgctcagcactgcacgactcctcccccatctaccactacctgtctacctacccagcccatcgatcacccctcgcaacgcaatggcgctggccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcgacagctggaagtcgaagaaggcgctgcagctcccagagtacccgaaccaggaggagctggacacggtgctcaaaaccatcgagacgttcccgccgggggtgttccccggagagggcgcgccacctcgaggagcgcatggccgaggccgccatggggccgcgccctcatcctcccagggcggcaaccgcccccaagagctttcaagggagttccacgccaaacaagcatccgggaaaaccttcccgtaaccctgctgcaagatggggcgcccgggccccatggttcgggggggccagggggcccggccctccaaggggggggaagaaagggcttggcccaantttgcaaaacgcaagggtccgaacccctttggaaagaaaaagggaacggttttcaaaacgggccaaaagtcaccggggcggaacaaaacttaaagcggggaaaaaactttaccccgagaagaagcc

SEQ ID NO: 89930 - protein, 163 aa, Zea mays
  misc_feature: Ceres CLONE 1577754
  misc_feature: SWISSPROT Homolog: EC 2.5.1.54 3-deoxy-7-phosphoheptulonate synthase
MALATNSAAAAAAAVSGGAASQPHRAATFLPLKRRTISAIHAADPSKNNGPAVPAAAAAKSSASAVATPEKNPAAPVKWAVDSWKSKKALQLPEYPNQEELDTVLKTIETFPPGVFPGEGAPPRGAHGRGRHGAAPSSSQGGNRPQELSREFHAKQASGKTFP

SEQ ID NO: 89931 - DNA, 808 bp, Zea mays
  misc_feature: Ceres CLONE 1577757
ccccgcggtggcggccgctctagaactagtggatcccccgggctgcaggaattcgtctcacccctagaaaaaatctccaccgtccatccacttaaaccccaccctcagtcctcacccaccaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgaagaagcccgcgctgcagggcgcggccatcaagccgctcctggcctccatcgcgactggcgtcctcatctggctcatcccgccccccgccggcgtgccccgcaacgcgtggcagctcctagccatcttcctctccaccatcgtcggcatcatcacccagccgctgcccctcggcgcggtcgccctcctcgggctcggcgcggccgtgctcagccgcacgctcacgttcgccgcggccttctcggccttcggcgacccgatcccctggctcatcgcgctcgccttcttcttcgcgagggggtcatcaagaccgggctcggctcccgcgtcgccaacg

SEQ ID NO: 89932 - DNA, 814 bp, Zea mays
  misc_feature: Ceres CLONE 1577758
  misc_feature: Translation starting site: 301
  misc_feature (416)..(416): n is a, c, t, g, unknown, or other
  misc_feature (427)..(427): n is a, c, t, g, unknown, or other
  misc_feature (433)..(433): n is a, c, t, g, unknown, or other
  misc_feature (727)..(727): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
ctcaccgcggtggcggccgctctagaactagtggatcccccgggctgcaggaattcgtctcacccctagaaaaagacgttctcctccccgtacacaacacgcacgccatctctctcgaagcttccgcttcctccagccgccaccgacccgaacccaccccggacgcggcgcctcccccgcaccctatattgttccccgagctccagccgccaaggattggcgaaaggagccgggcagatattgaaactcgtttcagatcggatccgaggactcgagaaattgcagggaaggaatttgaggatggatttcgagctgcggcaggcgcgggagaagctggagcgcgagcagcgggagcggatgcagcgcgccaaggccaaagcggagcgcgagagcctggccaaggcagaggtggcccncctcccccccncactcnaggcgtcccaccgcgagcgacgactcgatgccgcacgggcccaggaagaggctgaccggacaatggaagaggtgatgcagctggcgaaggggatttcattctcgcacatgtttgaggcacttcgatatgatggccctgggggataagatcaagttggcaccatcttcgtttaaagaggtgtctgatgaaggagctctcgataaagtcccatgtacctcaggttgtcgaaaggtagggacacagtcccaggtgctgctatgggacgagatgctgggacaccctggtgggggaggntcttgaattccccgccaggggaaagcactcgnnnnnnnnnnnnnnnnnnnnnnnnnnnnnnnnnnnnnnnnnnnnnnnnnnnnnnna

SEQ ID NO: 89933 - DNA, 890 bp, Zea mays
  misc_feature: Ceres CLONE 1577768
  misc_feature: Encodes the peptide sequence at SEQ ID NO. 89934
  misc_feature (805)..(805): n is a, c, t, g, unknown, or other
  misc_feature (807)..(807): n is a, c, t, g, unknown, or other
ccccgcggtggcggccgctctagaactagtggatcccccgggctgcaggaattcgtctcaccccctagaaaaacccagccgtcatcgcttcacgtccgctacataccggcgaggagactaaaggagggagttttgagaagcataaatggctcctaaagccgctcctgtcaagaagggtgatgccaaggcccatgccttgaaggtggccaaggctgtgaagtctggggcaggcaagaagaagaccaagaagattcgcacatctgtaacatttcaccagcccaagaccctgaagaaggccagggacccgaagtacccaagaatcagcactactggaagaaacaagcttgatcagtaccaaatcctcaagtaccccctcaccacagaatctgcaatgaacaacattgaagataacaacactctggtctttattgttgacctcaaggcagacaagaaaaagatcaaggctgcagtcaagaagatgtatgacattcaagcaaagaaggtcaacaccctgatcaggcctgatgggaagaagaaggcttatgtgaaactgacacccgactacgatgcccttgatgtggccaacaaaatggcatcatctaatttaataggcaactgggtttcgactcctatggccttactagttcggaagcttaccaacgggattttttcaatggttacagggaaattttggtttgggaatattgggggtggttttttttggaaacaaaagaccttgtttgggagtccccagaaacttacaaatttcccttgtatttgaaatttccttgggtttgcgcccctncngtgacaaagggagaaagacccgagcgctttctcttttttattggggctcatgatatttttctttttaagaaaaagcaaaaaaa

SEQ ID NO: 89934 - protein, 211 aa, Zea mays
  misc_feature: Ceres CLONE 1577768
  misc_feature (70)..(149): Pfam Name: Ribosomal_L23 Pfam Description: Ribosomal protein L23
  misc_feature (11)..(64): Pfam Name: Ribosomal_L23eN Pfam Description: Ribosomal protein L23, N-terminal domain
MAPKAAPVKKGDAKAHALKVAKAVKSGAGKKKTKKIRTSVTFHQPKTLKKARDPKYPRISTTGRNKLDQYQILKYPLTTESAMNNIEDNNTLVFIVDLKADKKKIKAAVKKMYDIQAKKVNTLIRPDGKKKAYVKLTPDYDALDVANKMASSNLIGNWVSTPMALLVRKLTNGIFSMVTGKFWFGNIGGGFFWKQKTLFGSPQKLTNFPCI

SEQ ID NO: 89935 - DNA, 817 bp, Zea mays
  misc_feature: Ceres CLONE 1577770
  misc_feature: Translation starting site: 188
  misc_feature: SWISSPROT Homolog: EC 1.4.1.2 Glutamate dehydrogenase
  misc_feature (673)..(673): n is a, c, t, g, unknown, or other
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctggctacttcaacgactcacagaggcaagccacnaaggatgctgggggtgatgcctggcctcaatgtgctgcgtatcatcaatggagccaaccgctgcggctattgcctaatgggcttgaacagaaaggcaaccagcgtccggggaaaaaaaggtccctcacctttgacccttgggga

SEQ ID NO: 89936 - DNA, 801 bp, Zea mays
  misc_feature: Ceres CLONE 1577771
  misc_feature: Encodes the peptide sequence at SEQ ID NO. 89937
  misc_feature (645)..(645): n is a, c, t, g, unknown, or other
ggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccaccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgtcaccccgccgccagccaccgggaagaccggcggcggcaagatcaccgacgagtttcacggcgccggcgccatcggccaggtgtgccaggtgatcggcgccgtcgtcgacgtgcgctacgatgaggggctcccggcccattctcacggggcttcgaggtggtcgaaaaacgacattccgcctccggggcccaaggtgggcccaacaccctgggcgaggaaattgggggccacccttcgctttgggacgggccgggagggggttttccccgggccaggggggtccctaaaaattggggtccccccattccccntggccctttttggcagggggtcaccccccttgggaacggatccctttaaagggtttcccggggggaaaccccaatttttttatgaaaaagggggggtttttttaaggcaaaaaaacaacctttcccccccccaattaccaatgggggggaaagccc

SEQ ID NO: 89937 - protein, 213 aa, Zea mays
  misc_feature: Ceres CLONE 1577771
  misc_feature: SWISSPROT Homolog: EC 3.6.3.14 H(+)-transporting two-sector ATPase
  misc_feature (162)..(162): Xaa is any aa, unknown, or other
MASHRVVSSLLRSASRLRAASPAAPRPRGAPHRPSPAGYLFNRAAAYASAAAAQAAPVTPPPATGKTGGGKITDEFHGAGAIGQVCQVIGAVVDVRYDEGLPAHSHGASRWSKNDIPPPGPKVGPTPWARKLGATLRFGTGREGVFPGPGGSLKIGVPPFPXALFGRGSPPLGTDPFKGFPGGKPQFFYEKGGVFLRQKNNLSPPQLPMGGKA

SEQ ID NO: 89938 - DNA, 1309 bp, Zea mays
  misc_feature: Ceres CLONE 1577774
  misc_feature: Encodes the peptide sequence at SEQ ID NO. 89939
  misc_feature (65)..(65): n is a, c, t, g, unknown, or other
  misc_feature (66)..(66): n is a, c, t, g, unknown, or other
  misc_feature (74)..(74): n is a, c, t, g, unknown, or other
  misc_feature (1020)..(1020): n is a, c, t, g, unknown, or other
  misc_feature (1309)..(1309): n is a, c, t, g, unknown, or other
ttcttggtggttttttcttttgatgttttcggctgtgtttctttgtggtcgttggtgtggttttnntatctgtngtttaaaactggggctcaccgcggtggcggccgctctagaactagtggatcccccgggctgcaggaattcgtctcacccctagaaaaaaccgctcccccgagattagggggggagcgcaagtgcctgaagtaagcctaatcctaaccgccgccgtcatgacggcgcccaagctcaagctcctagctcttcctactctgctggtcctcatcctcctcctcctcctctccgccgcccggcggcgcgtccttctggagacgctcctcctccgcgccccggtcctcccgggcgacctcctcccgctcctgccctggcccgtgtctcagccgctgctccgccgcctcgcgctgcggggccccgccgacctgctcccggctttcgtcggggggccgcgcgcgcgccgtgggtccgaacgaattccctaccccgggtcgcccgaagtggaaggggcgccctggcttccttcctaacaaaacaggggcgggtggggggggagaattcccccaaaaccggggatcccgggcttgggtggggtcttctgttaagggccgggcatctaaattccccctttgtttggggggggagcatttgcccataaaagccaacacacataatgatctttggggacacttgtggccaatttcagccgaaactacctcgcataaaatagaggaaaatattgtatgggggcgcacctgacgcctctccatttttttccccgatgaggaggatgggtatgtttcaatacaaggtggggcgggcggaaaagaattagttacccggtattcggcgcctttctttttggccgtcggggggggggctgtgcccataaatgaaaagaatctccctcagggaagattatcccgccttgtgtgggagcggtacttcgccccaaaaataagggaaaaagagggcgggggatataatactatctcctcttatcagganaacctcgcgtgataattatcttcttgtgataacttttctaacggtggtggattataaaaaaacgtcttcataaaatacaggcagaatgggggtggactcacaaatagctcaaatttgtttcgccttgcgtgggaggggatccgatcgcttattagggagaaagaaaaaaacttgcgggggaccgaatcaattatttctaggtagagtgtagaattcgctgggggggtggtgtatgctcctctctctacctccactaggtatactccacaaaagaaaacgaatttagcgn

SEQ ID NO: 89939 - protein, 103 aa, Zea mays
  misc_feature: Ceres CLONE 1577774
MTAPKLKLLALPTLLVLILLLLLSAARRRVLLETLLLRAPVLPGDLLPLLPWPVSQPLLRRLALRGPADLLPAFVGGPRARRGSERIPYPGSPEVEGAPWLPS

SEQ ID NO: 89940 - DNA, 796 bp, Zea mays
  misc_feature: Ceres CLONE 1577780
  misc_feature: Encodes the peptide sequence at SEQ ID NO. 89941
  misc_feature (537)..(537): n is a, c, t, g, unknown, or other
ctctccgcggtggcggccgctctagaactagtggatcccccgggctgcaggaattcgtctcacccctagaaaaaacctccctactcgcgtagtagtcgtcgtcgtcgtcctcctcccgacgtctggtggtatcggacttgcgtggcgtggaggtgcttccgaacttgggatcgatttgcttgtcagcgccgaaccctagctttgcttcgacggcacccacctacggtacgcccgcggccccaagcagtcaggcgacaccgaataatttggttacagagacgagcgggtgcgccggcgagagggcccgattctcaccgcgccggcgatggcgagcagctcgtctccgtcacaggtcatctgcgcctccttcaatcaggacaacagcatgttttctgtcgggaccaaggatgggttcaagatctttgacgctcgtaatgggaggctctgctacgaaaagagtcttgggggattcaacattgtggaaatgctatttggcacaaacctacttgccattgtcggaaccggtgaacagcctgncatgtctcctcgtcgtttgtgcctggttcatacccaaacaggagcatcaaagagagatctgaactttaagacttcatttttggctgttccggtaaataagaagaagccttgggtgttgtattgcaggatagggacttttgttttttgatctaaatagccctacctattttgggacgaaatttggaaacgggtccccattacaaaaggggcctttgccgccttttgccccctaaattttgaaaaaaaaggttttttttgt

SEQ ID NO: 89941 - protein, 119 aa, Zea mays
  misc_feature: Ceres CLONE 1577780
  misc_feature (71)..(71): Xaa is any aa, unknown, or other
MASSSSPSQVICASFNQDNSMFSVGTKDGFKIFDARNGRLCYEKSLGGFNIVEMLFGTNLLAIVGTGEQPXMSPRRLCLVHTQTGASKRDLNFKTSFLAVPVNKKKPWVLYCRIGTFVF

SEQ ID NO: 89942 - DNA, 815 bp, Zea mays
  misc_feature: Ceres CLONE 1577783
  misc_feature: Encodes the peptide sequence at SEQ ID NO. 89943
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (693)..(693): n is a, c, t, g, unknown, or other
  misc_feature (782)..(782): n is a, c, t, g, unknown, or other
  misc_feature (783)..(783): n is a, c, t, g, unknown, or other
ctccccgcggtggcggccgctctagaactagtggatcccccgggctgcaggaattcgtctcacccctagaaaaacnnanaaaaaaaaaaaaaaaaaaaaaaaaaaaaaaaaaaaaaagattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcggtagctttctgtcttccctgatctatctagataatggcgaccacgacgtcagcgaccaccgccgcagcagcagccgccaccaccgccaagccgcgggggtcgtcgtcggccctctgccagagggtggccggcgtggaggcccaggcgcaggccgtggcaaaggcggcagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgntcttagtacttgtaatagaatggaaatttatgtggtggcgctatcatgggaccgtggtatcagagaaagtagtggactggatgtcgaannaaaagtggtattccggcttccgagctttagga

SEQ ID NO: 89943 - protein, 90 aa, Zea mays
  misc_feature: Ceres CLONE 1577783
  misc_feature (10)..(88): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
  misc_feature (50)..(50): Xaa is any aa, unknown, or other
  misc_feature (80)..(80): Xaa is any aa, unknown, or other
MKERSTIAVIGLSVHTAPVEMREKLAVAEELWPRAIQELTSLNHIEEAAXLSTCNRMEIYVVALSWDRGIRESSGLDVEXKVVFRLPSFR

SEQ ID NO: 89944 - DNA, 748 bp, Zea mays
  misc_feature: Ceres CLONE 1577788
  misc_feature: Encodes the peptide sequence at SEQ ID NO. 89945
ctcaccgcggtggcggccgctctagaactagtggatcccccgggctgcaggaattcgtctcacccctagaaaaagccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggatgtgccaaggttacttgggctccttgccatgattctgcataatgaaatctttacatctggtggagaccagaattttgatactaggattctggggcaaaagcgaaagatgaaactaatccctgagaaacaaagatgaatgggaaaagtcccgatggaatgattaatggatggatggaaggaggaccattgatgattgcctgaaaaaccaggaaggaagatgaatgggggtggattgaggggatcccaatggccattggagaattgaggaaaaatgaccattgggaattttttgattagatcccgcgccccccaattggggcaaagggggggaaacccttttcccacccaaaattttattggggggggaaagggatttaaaaaaagggtttttttttcccccccccccccccccctttttgttgggggggaaccaaattggggccttttttggggggaaaaaagggggcggggagaaaaattctcc

SEQ ID NO: 89945 - protein, 73 aa, Zea mays
  misc_feature: Ceres CLONE 1577788
MEALFGSNNHGGHKAADLASLIITQVALDVPRLLGLLAMILHNEIFTSGGDQNFDTRILGQKRKMKLIPEKQR

SEQ ID NO: 89946 - DNA, 789 bp, Zea mays
  misc_feature: Ceres CLONE 1577792
  misc_feature: Encodes the peptide sequence at SEQ ID NO. 89947
gagctccccgcggtggcggccgctctagaactagtggatcccccgggctgcaggaattcgtctcaccccctagaaaaactccaccccgccgcagggctggaatggtctgtcgccttgtcgcgtccgtgatccgtcccttggcctctcgcagcggacagcggccctccgccccctccaaatagcagcgaaacccctcgcgtttaaactattccctgatccaacccctcctcaaactctgacgacgcctccttccgtgcccgtccgtcctctataagggcgccgccgaggagagagaacgatgacttcggctctccggcggaaggcggcgcagatggcttccgcggcgacacagtgcttcagctactcctcgttgccggccacgtgggctctgcggcagcggggcggcggtgccagcgtgctccggctctcttcccggcggaccttctcggtctccgcggcggccgggttcgacaaccagaaccgcgagtatgtgatcgtcgggggagggaacgctgcgggttacgccgccaggacgttcgtcgagcatggcatggctgacggccgcctttgcatcgtctccaaggagccagttccaccatacgagcggccagccttgaccaaaggctatctttttcctccggacaagaaaccggctcgcctacctggtttccatacatgcgttgggatctggtggacagcgacagactgctgaatggtacaaggagaatgggatagaggtgctgtatgaggatccaggtgtagcatttgatggcaaaacgcaaaccttta

SEQ ID NO: 89947 - protein, 137 aa, Zea mays
  misc_feature: Ceres CLONE 1577792
  misc_feature: SWISSPROT Homolog: EC 1.6.5.4 Monodehydroascorbate reductase (NADH)
MTSALRRKAAQMASAATQCFSYSSLPATWALRQRGGGASVLRLSSRRTFSVSAAAGFDNQNREYVIVGGGNAAGYAARTFVEHGMADGRLCIVSKEPVPPYERPALTKGYLFPPDKKPARLPGFHTCVGIWWTATDC

SEQ ID NO: 89948 - DNA, 826 bp, Zea mays
  misc_feature: Ceres CLONE 1577795
  misc_feature: Encodes the peptide sequence at SEQ ID NO. 89949
  misc_feature (524)..(524): n is a, c, t, g, unknown, or other
  misc_feature (590)..(590): n is a, c, t, g, unknown, or other
  misc_feature (591)..(591): n is a, c, t, g, unknown, or other
ccccgcggtggcggccgctctagaactagtggatcccccgggctgcaggaattcgtctcacccctagaaaactcccacccacgaagtacggaaggctgccggaaggagctctcacctcacatccatctctgtcgcgcccgtcatcctcctcctcctcccctcctcaactgctatcggatttgcgctgcagtggagatcgacccgggctgggaatttctttcgttggtaaggaaccctaatttggtcggatgggattttcatcttcgacgaagcccgcgagattgatcgaccttagctgacgcgagggattggaaagcgaacgctcgggcgtagttaattttctaggaagattggggtttcagctcaaacccccatgctcgatgctgaggacgaccctggcgggagatgacgaggatcttcgtgcagcgcgggaccgccggctcctcgtccagctccggccgctcgggctcgcaatcagcgcagcagccggcagcagctgcccgggagggagtgctgttgcaccntcagccacagctaccagaactattggctatagatgatggtactgagcatttaaatgaggggcacgnnagacacagtagcagaattaagttttttgaggacggatgacaccatttcagagagctcgagctacgcagaggaaagggctgccagggagaagcctcctaaggatgactcttatgtaatccaccccccttccttggtagaggaaacggaaagtgctcataccccctgatcagaatggacatgggaaaattcggtgccgttcgggacttatccatcccgggatgggggggtgcagcac

SEQ ID NO: 89949 - protein, 74 aa, Zea mays
  misc_feature: Ceres CLONE 1577795
  misc_feature (40)..(40): Xaa is any aa, unknown, or other
  misc_feature (62)..(62): Xaa is any aa, unknown, or other
MTRIFVQRGTAGSSSSSGRSGSQSAQQPAAAAREGVLLHXQPQLPELLAIDDGTEHLNEGHXRHSSRIKFFEDG

SEQ ID NO: 89950 - DNA, 672 bp, Zea mays
  misc_feature: Ceres CLONE 1577797
  misc_feature: Encodes the peptide sequence at SEQ ID NO. 89951
ggagctccccgcggtggcggccgctctagaactagtggatcccccgggctgcaggaattcgtctcacccctagaaaaaacaacctccttctccaatactctctccctcgccgccggccacctccgcctcctcccacgcgccacctccgcctcctcccacgcgccacctccgcctcctcccacgcgccacctccgcgacaaaccactgaaggagggagaggactcgctcatatcgtccgatggaggaggactcgatcaagggggatgaatctccgcgatatcctgggtgccaggggcgccgcaagagcgtgcccgttcgttgcgacccgcccactcaggaggagattgcccaggccatgaaagactttcaactgggcagaaactccgggagcgaccctaacaaggaggaagatgctgccaccatggaaactccaagggggggggggaaaggggggaagaaggttaaaaagggttccccaaaccaaagggcgtaaccaaagggctttcttgcaagggcccttagaaaggggggggaaaaaactccccctaaaaaaaactccccccaaaaaaaaaaaaaatggggggccccgcctccccgagtgttttaaaaaaaaaaaaaaggaggggggcccaaaattttttttctctcgcgcctctccgggggggcggggga

SEQ ID NO: 89951 - protein, 84 aa, Zea mays
  misc_feature: Ceres CLONE 1577797
MEEDSIKGDESPRYPGCQGRRKSVPVRCDPPTQEEIAQAMKDFQLGRNSGSDPNKEEDAATMETPRGGGKGGKKVKKGSPNQRA

SEQ ID NO: 89952 - DNA, 817 bp, Zea mays
  misc_feature: Ceres CLONE 1577798
  misc_feature: Encodes the peptide sequence at SEQ ID NO. 89953
atacccgcggtggcggccgctctagaactagtggatcccccgggctgcaggaattcgtctcacccctagaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaagaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttggcaaggtcgagccccttgtcaacatgggtcagataacccagagctacctgcccaatgaacttggcccttggggtcgtcgcgagctcacgactcactgtggtggctgatcaaggtacggctcaagggactctcctcttggctttctcaccgtgtccatgagtgtcccaatggcggctcgacacagaacagaccgacttttggtccggccgaactgggtcttctgag

SEQ ID NO: 89953 - protein, 162 aa, Zea mays
  misc_feature: Ceres CLONE 1577798
MADVHEPLVRRKRKKVLVDYLVKFRWILVIFVVLPISTLIYFNIFLGDMWSAMKSEKKRQKQHDENVQKVVKRLKQKNPKKDGLVCTARKPWIAVGMRNVDYKRARHFEVDLSSFRNILEIDKERMVGKVEPLVNMGQITQSYLPNELGPWGRRELTTHCGG

SEQ ID NO: 89954 - DNA, 960 bp, Zea mays
  misc_feature: Ceres CLONE 1577799
  misc_feature: Encodes the peptide sequence at SEQ ID NO. 89955
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnnttcctggaaggagtaaaaaaaaatttaatgtttactatattaagcaagacagataaaaagaccagagaaggaaaaaactgggactccccgcggtggcggccgctctagaatagtggatcccccgggctgcaggaattcgtctcacccctagaaaaaaacctcgtgttcgtgaggagcgcagacagacactaccggatctcccccaaatccacccggcggcacctccgcttcaagatgcagatctttgtgaaaaccctgaccggcaagactatcaccctcgaggtggagtcgtctgacaccattgacaacgttaaggccaacatccaggacaaggagggcatccccccagaccagcagcggctcatcttcgctggcaaacaggttgaggactggcgcacgcttgctgactagcacatccagaaggagagcaccctccaccttgtgctccgcctcacgggaggcatgcacatctttgtgaacaccctgaccggcaagactatcaccctcgaggtggagtcctctgacaccattgacaacgtcaagggcaagatccacgacaaggagggcatccctccagaccagcagcggctcatctttgctgggaagcagcttgaggacggggcgcacgcttgccgactactacatccagaaagagagcacccgtccacttggggctggcgcctcaggggaggacatgcaagatcttcgatgaagaccccagaacgggcaaaaactatcacctctgggaggtgggagtgcttcaagacaaccgtcgaacaacgttcaaaggcccaagaactccacggagaaagggacggtcacttccccccccagaaccagacattcggggcttccgtccttttgcgctgggaaaagaacagctttgcaaggaaacggggacggcacacctcttggcccggaaactaaccaaacagtccccgggtacagggagaaagg

SEQ ID NO: 89955 - protein, 58 aa, Zea mays
  misc_feature: Ceres CLONE 1577799
  misc_feature (6)..(59): Pfam Name: ubiquitin Pfam Description: Ubiquitin family
MQIFVKTLTGKTITLEVESSDTIDNVKANIQDKEGIPPDQQRLIFAGKQVEDWRTLAD

SEQ ID NO: 89956 - DNA, 765 bp, Zea mays
  misc_feature: Ceres CLONE 1577801
  misc_feature: Encodes the peptide sequence at SEQ ID NO. 89957
  misc_feature (569)..(569): n is a, c, t, g, unknown, or other
ctggagctcaccgcggtggcggccgctctagaactagtggatcccccgggctgcaggaattcgtctcacccctagaaaaaaacaaagtggaaagtgtgaccgggatccccatccgttccagcccccccagaacccagagctccaaacctaggccggagccgcggtgcaagcagctacgtggattggacttagacgtctggctctggaggtcccaagttcccaacgcttgctggagttgagatctggtgggcttccggaggagacgccgacggtttgcgaggtttgctggctccgtggcgtcgcggaaggtcatggagcaccgcgccttcgactgcagcgggagtgatgatgatctccctccaacatatcaaattagagtaccgagaatgcatttcagtgggaacagaaggcaattagcaggcccattttctcagccaagaccacacaacaagttggatagcgatatacatcagattgagcaacaggcatatactggtgttcttagagcattcaaaatgcaatcggatgccctgacatggggaaaaagaaagtctaattactgaactaangaagagagttgaaagtctctgatgtggaacacaggatgctattaaacatggtcaaatgaagagaggctatccatagaataaagcagtcaaggcaggggatgtggaaatgcaatctagcttggccttatataagcgtaatttgatcacaaaccttggaacctatcaagcgggcagaaagaaatcacatccccatctt

SEQ ID NO: 89957 - protein, 83 aa, Zea mays
  misc_feature: Ceres CLONE 1577801
MEHRAFDCSGSDDDLPPTYQIRVPRMHFSGNRRQLAGPFSQPRPHNKLDSDIHQIEQQAYTGVLRAFKMQSDALTWGKRKSNY

SEQ ID NO: 89958 - DNA, 812 bp, Zea mays
  misc_feature: Ceres CLONE 1577802
  misc_feature: Encodes the peptide sequence at SEQ ID NO. 89959
tggagctcaccgcggtggcggccgctctagaatagtggatcccccgggctgcaggaattcgtctcacccctagaaaaagcagtttacaaatgctttgagtcctgcgctcctgtcctgctgttcttgtctagcaataaacaacccatttcctttgatgtcacatggtggctcgccgagtgctggtgcacaaattcatctcctcgttccaccttgctgctgctgctgcagttcttggtacaccatcccaggcgcggcagcagcccgcctctggatctctcccaatgctccggcgatggagcggtcctgctacttcccgctgcggtgggagagcacgggcgaccagtggtggtacgcgtcaccgatagactgggcggcggacgacggccactacgacatcgtccgccagctgctgcacctcgaccccaacctgctcatcaagctcacctccctccgacggatccgccgcctcgaggcactgtgggacgacgacgcccgcttcagcgacgcggaccggaaccaagggtctgtcgccatcagcctgctgctggagtgcgagtgcatgaaccaccgacccggcaccggggagaacactctgctccgggacagatactgcggcatggatgatctacccgccggcatcggcacaggactccaagattatgctcgcaactgctgaatagggacccgctgtctcttatacgggatatggcgagaaactgcttccacgtgaatagtactacactgcgtgtcaggtgtaggtgagcagcggaaaatttttcaagattgctggataaacgcgaacctggggtcga

SEQ ID NO: 89959 - protein, 127 aa, Zea mays
  misc_feature: Ceres CLONE 1577802
MERSCYFPLRWESTGDQWWYASPIDWAADDGHYDIVRQLLHLDPNLLIKLTSLRRIRRLEALWDDDARFSDADRNQGSVAISLLLECECMNHRPGTGENTLLRDRYCGMDDLPAGIGTGLQDYARNC

SEQ ID NO: 89960 - DNA, 995 bp, Zea mays
  misc_feature: Ceres CLONE 1577803
  misc_feature: Encodes the peptide sequence at SEQ ID NO. 89961
ggccgctcttaactagtggatcccccgggctgcaggaattcgtctcacccctagaaaaacacccgtccttcggcgacgcggggatgccaccgccgcccaagaagtggaagggcgcctgccagttcaggtccgtcgcccgcggcgggtgcagcaacaaggtcatcggcgcgcgcgcgttcgggagcgcggccatcaacgacacggcgccgcccgtcgacgacgcgggccacggcacgcacacggccagcaccgcggggggcaacttcttgcaaaaaacccgcgtgcggggcaacccgcacggcatggcggtccgggaaggggccccaaccgccccttggccttctaaaaggtgttggaaccgaacccggggtttatttttgaaccttcttcccccgggccgggaaacccaccttaggggaagggggtgggaaaatgctctccccttttcccatagggggccacccgaaaggggggcgccgtttaaacttaggaaaccctcatttgaccattgggccccccttttaaagggccattggaaggccgcgggattttttttgtttaaaaggccccgggggcccgggaaaatgaaagggggcccccgcgccggggggggggggggtgtaatcacaaataggtgaccccacccccttgtgaatatccttaaaagggggttgcgcgaggggggggggacacacaactgaaaaccggggcggaaaaatatgtcgctaccacccttgttagggttcttctgttaacggaggggggagggagttgttctccccggtggcaaaacctcccttttctccctcccccccggaaaaaaaacaaccctcgggggggggccccccgcctagcaaaatttttctttttctcccaaaaagatctccttaatatttaaacaaaagctttgtgttggaaggaccaaagttgtataggggccaagagcgggtttctctttttcaaaaaacaccctttcccttctacagaactatttg

SEQ ID NO: 89961 - protein, 211 aa, Zea mays
  misc_feature: Ceres CLONE 1577803
  misc_feature: SWISSPROT Homolog: EC 3.4.21.25 Cucumisin
PLLTSGSPGLQEFVSPLEKHPSFGDAGMPPPPKKWKGACQFRSVARGGCSNKVIGARAFGSAAINDTAPPVDDAGHGTHTASTAGGNFLQKTRVRGNPHGMAVREGAPTAPWPSKRCWNRTRGLFLNLLPPGRETHLRGRGWENALPFSHRGPPERGAPFKLRKPSFDHWAPLLKGHWKAAGFFLFKRPRGPGKMKGGPRAGGGGGVITNR

SEQ ID NO: 89962 - DNA, 801 bp, Zea mays
  misc_feature: Ceres CLONE 1577805
  misc_feature: Encodes the peptide sequence at SEQ ID NO. 89963
  misc_feature (746)..(746): n is a, c, t, g, unknown, or other
  misc_feature (770)..(770): n is a, c, t, g, unknown, or other
ctggagctccccgcggtggcggccgctctagaactagtggatcccccgggctgcaggaattcgtctcacccctagaaaaaaggctgggcgcatgcatccgaggccgcctcaccccgcgcatctccctcgagctctccctctagggttttccgccggcaccctcagccgccgctgtcgagctctccctctcgtgtctccactcgccctcgagctctccctctccgtctccagtcgtcgtgaactagggtttggcgctctcagccgccgctgttgagctccccctctctccctctcccgtctccactcgccctcgagctctccctctccgtatccactcgttgtgagctagggtttgacgcccttactcgccgctgtcgagctccccccctctccgtcgagctcgcctcagtccccgttgtggagctctcgcactctccaggtttctccgctgcctcagccgccctcgctgtcgctgagccgacagattcattcgaccggtcatggctgacacgttgtgcaacggcgccatggtgtccccgtgcggccgggacgttgctggccgggccaggggcgccgccagggccgcgctcgcggagtccctgcaggtcgccgggcacgccagcaagacctccttctccgctgggaggatgtcggtcaaggacagcaagtcgaggcccctgtcgcgtagcctcgaggccgccgcgccaggacagatgaacctgtcgttcccaaggccatgcggtggntgggaagaaggggctgcaccccancatgcgcgaagtcgagtccgcgcaggactta

SEQ ID NO: 89963 - protein, 100 aa, Zea mays
  misc_feature: Ceres CLONE 1577805
  misc_feature (90)..(90): Xaa is any aa, unknown, or other
MADTLCNGAMVSPCGRDVAGRARGAARAALAESLQVAGHASKTSFSAGRMSVKDSKSRPLSRSLEAAAPGQMNLSFPRPCGGWEEGAAPXHARSRVRAGL

SEQ ID NO: 89964 - DNA, 915 bp, Zea mays
  misc_feature: Ceres CLONE 1577806
  misc_feature: Encodes the peptide sequence at SEQ ID NO. 89965
tccccgcggtggcggccgctctagaactagtggatcccccgggctgcaggaattcgtctcacccctagaaaaatcgaattcttctcccgttcaggcgtccatccctcttttctctcgtggcgacgaagacgaccgacgccgacgctgacgccctacgccaggtgccaggttccgtcgggtccttcgccggcgaagagcatccaccaggcgacccagtgctgttctggtgcggtttcattgcggaagttttgttgtgggattttccggtggcgaagatgatccgactacccatgtacgcggcgttcagcctgctggcgacggcttcggcggcgtactacgcgttcagcagccgggagcagttctacccggcgatggtgtacctctccacctccaagatctgcttcgtgctgctcctcaacacgggcctggttgccatgtgcgtcgcctggcagctcgccaggcgtctcttcctcggctcccctccgggaggccaagggtcaagcgccttcaacaagcagtcctggggggggaggggcatcgagatttctctttcgcccgtcaccatctttccggggagggactttctcgggggcccttcccttggccaggggtccgcttgcactggcttttctttgttaaaggggacctccacctgggcttcgcggcaaaaagaaagggcccaagtacccttcgaggaccccccccccgtccgggtgccccggggggtctccgccacgtcggggggttggtgtcccctttgtggggttgtcccctgggtccggggggccgggtgggccctctttcccgggggaaaagtcccctccgggggtccctctactatcaagaaagggggggggggggcgctgggttgccccttcttttctttctccccctgtggagggagggcggatgagg

SEQ ID NO: 89965 - protein, 208 aa, Zea mays
  misc_feature: Ceres CLONE 1577806
MYAAFSLLATASAAYYAFSSREQFYPAMVYLSTSKICFVLLLNTGLVAMCVAWQLARRLFLGSPPGGQGSSAFNKQSWGGRGIEISLSPVTIFPGRDFLGGPSLGQGSACTGFSLLKGTSTWASRQKERAQVPFEDPPPVRVPRGVSATSGGWCPLCGVVPWVRGAGWALFPGGKVPSGGPSTIKKGGGGALGCPFFSFSPCGGRADE

SEQ ID NO: 89966 - DNA, 790 bp, Zea mays
  misc_feature: Ceres CLONE 1577807
  misc_feature: Translation starting site: 167
  misc_feature: SWISSPROT Homolog: EC 2.3.3.1 Citrate (Si)-synthase
gctcaccgcggtggcggccgctctagaactagtggatcccccgggctgcaggaattcgtctcacccctagaaaaaaagcaaccacttctgctctgcatcccgtctgggcctctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaatagacgacaagggtcttaagatttatgatcctggttaccttaacactgcccctgttcgctcgtccatctgctacatcgatggagatgagggaatccttcgctatagggggtatccaatcgaagaattggctgaaagcagctcgttttgttgaggtggcctaccttttaatgtatggggaacttgcctactcagagtcaattggcaggctgggaatttgctatttctcagcattctgctggtccccaaggactgttggatatcatacaatccatgccccatgatgctcaccccatggggtgtttctgccagtgcaatgagcaccctttctgtctttcatccaaatgcaaacctgctctcaaaggccagatccttataaatcgaaaccggg

SEQ ID NO: 89967 - DNA, 839 bp, Zea mays
  misc_feature: Ceres CLONE 1577809
  misc_feature: Translation starting site: 205
  misc_feature (580)..(580): n is a, c, t, g, unknown, or other
  misc_feature (649)..(649): n is a, c, t, g, unknown, or other
  misc_feature (746)..(746): n is a, c, t, g, unknown, or other
  misc_feature (808)..(808): n is a, c, t, g, unknown, or other
  misc_feature (819)..(819): n is a, c, t, g, unknown, or other
ggagctccccgcggtggcggccgctctagaactagtggatcccccgggctgcaggaattcgtctcacccctagaaaaaaaaaaaagtgtgcgcggtcggtcgcttcccttcccttttgtccgcgatctggactggccctcgtggcctcgtcccgtctccgattccggcgtccgaaccagattcgcccgggccttcgtgccagcgatgaaggagaagcgtgggctcgaggacgccggcgggggcgccggcgacggacgtcctgatgccaagaggtcgcggcctccggcactggccagtgttattgttgaagctttaaagatggatagtctgcagaggctctgctcatcactggaaccaattcttcgtagagtagtcagtgaagaagtggggcgcgcactgggcagacttggccctgcaacaatcgggggaaggtcttccccaaagcgaattgaaggtccagatggaagagctctgcaactccaattccggacaaggctgtcacttccccttttcaccggaggaaaagttgaaggggagcagggagctgcaattcatgttgttttgcttgatgctggcactnggtggtgttgtatcatctggaccagagtcttctgccaaacttgacattgttgttctcgaaggtgatttncacaatgaagatgaagagggctgggacaggggaagagtttgacagccatgttgtgaaagagcgcgagggaaaacggcctattttaaccgggcgatcntacagtcacactaaaagaaggtgtcgggacaattgggggagcttacgttcacagataactcntagctgataanggagtaggaagttcaggctt

SEQ ID NO: 89968 - DNA, 794 bp, Zea mays
  misc_feature: Ceres CLONE 1577811
  misc_feature (698)..(698): n is a, c, t, g, unknown, or other
  misc_feature (699)..(699): n is a, c, t, g, unknown, or other
ctggagctccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagtaatgtctgaccttgccggaaagcgcatcctgcgcagtggccgcaactggcacgcaagcacgtccaagacgggtaagtcatccgtctcctcgccgggtttcaaggtaattcaggtcaggccactctggtccaaaaagacatccaaaaaagaaagaggtgggcggcaattgaggattccattgcggccgacaggaaaaaagtgcctttggggcgggtacaaacttgggggggggctggggggccaccaaacttcggggggggggccccccgggggggaacttcctaccggggggcacaattcccgggaaaaggggggggcccaaaaaaaaaattgtgaccccccgcgtttgttggaaaaaaatacaaacgggggaaaaccccccccctaaaaaaagggggcccccccccccccccccttggggcggcccccaagggggttggggccccccccccccccaaaaaattattctccccccccaaaaatattacccccgggggggggggaagaggtttttccccccccctccaaacccccnngggggggggggccgaaaaaaaaaaaaaaaaaacttttttttttttttttgaggggggggggcccccccggggcaattttttttttctttgcgggg

SEQ ID NO: 89969 - DNA, 780 bp, Zea mays
  misc_feature: Ceres CLONE 1577812
  misc_feature: Encodes the peptide sequence at SEQ ID NO. 89970
  misc_feature (619)..(619): n is a, c, t, g, unknown, or other
  misc_feature (689)..(689): n is a, c, t, g, unknown, or other
ctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccggccaaatgcagccgtctgcgtacgtgcgggcgacaccgtcgctcctcggcgagcagggagaagacaccgagtgggtgacggtgaagttcggctggaaagagccgtcagaggacgactggatcggcgtcttctctccggctgaattcaactcgtccgctacatgtacgaactcatggccagcagaagaacgctatctctgctcagcacccatcaagtatctagtgcgccaactactctgcgaactacatctactggggcaagggcagcatccggctgcaggtcatgcagcagcgctccgacgtctgcttcgtcctcattcatggctggctcatcaaaccgnatgctgatcgcggtgtccgtagccatatcgttcatgaactccgagagcccagtgatcccgacggctggcncaagggcacgtcccacgactacatgatcgtgacgtagcaccatgcgctactcatcagatgagcgtccccgttcttggagtgggcgactgcg

SEQ ID NO: 89970 - protein, 157 aa, Zea mays
  misc_feature: Ceres CLONE 1577812
  misc_feature (156)..(156): Xaa is any aa, unknown, or other
MAVALLAALVASAAMFMLAGTASASPAEGIQPLSKIAVHRATGQMQPSAYVRATPSLLGEQGEDTEWVTVKFGWKEPSEDDWIGVFSPAEFNSSATCTNSWPAEERYLCSAPIKYLVRQLLCELHLLGQGQHPAAGHAAALRRLLRPHSWLAHQTXC

SEQ ID NO: 89971 - DNA, 826 bp, Zea mays
  misc_feature: Ceres CLONE 1577815
  misc_feature: Encodes the peptide sequence at SEQ ID NO. 89972
ccccgcggtggcggccgctctagaactagtggatcccccgggctgcaggaattcgtctcacccctagaaaaagcgcgttgcaagctcccacttcctgaggaacaggaactccatgagatccgcggcatccgccgtcccgttcatctgcacaaaaagaccgtaatccttctttttcctctcctccccatccgcggagtgtaaatcgtctctcgctagcgcgttcagtagaaaccctaaaccccgcctcctcccctcgccggggtaggggctacgggtgtcaacgcccgccatggacgcattccggaagcaactggatgtgctcatgggcgctaaccgcaacggcgacgtcgaggaggtgagccgcaactactacgaccgcgacgtctgccggctcttcctcgccggcctttgcccccacgacctcttccagctcacgaaaatggatcttggtccttgttctaagattcactcgcttcaactgcggaaagattatgaagaagcgaaagcaaagggaacagagaattttgacagagaactcgaggatatgatagaaaagctcatttgtggaatgcgacgggaaaattaagagggggccctggaaacgacttgccgaatgaccaagccaagggctggctattggcaatatcccgtctcgaagggttacttctgagcggaagaacatacctgcagccttttcaaaaccggattcaagggaaaaaaatggttagaaaagtggatggccctttgaatttttggaagggggagaaaccggaatggattaaaaaattaaaggggccccagggaaaaagtaaggtgggaaaaaaac

SEQ ID NO: 89972 - protein, 98 aa, Zea mays
  misc_feature: Ceres CLONE 1577815
  misc_feature (1)..(99): Pfam Name: LUC7 Pfam Description: LUC7 N_terminus
MDAFRKQLDVLMGANRNGDVEEVSRNYYDRDVCRLFLAGLCPHDLFQLTKMDLGPCSKIHSLQLRKDYEEAKAKGTENFDRELEDMIEKLICGMRREN

SEQ ID NO: 89973 - DNA, 795 bp, Zea mays
  misc_feature: Ceres CLONE 1577817
  misc_feature: Encodes the peptide sequence at SEQ ID NO. 89974
  misc_feature (509)..(509): n is a, c, t, g, unknown, or other
  misc_feature (591)..(591): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
ctccccgcggtggcggccgctctagaactagtggatcccccgggctgcaggaattcgtctcacccctagaaaaaggctatacatcccgaatccgacgctccatcgagtgtgtgcggcggcgggaggagacggaagagaacgatgcaggcggtggcacgggcgcgtgggcttgcggctgcggctgtggctgcgcggccgtcggcgatggaggcagggcaccgcgggcaggtgcagcaagcccggggcattgtggtgcaggtgagggacgggaacctggagcgggcgctggcggtcatggagcgcaagatgaggtccagcggcatggagcgccttatccgagcgcgcacccactaccacgtgaaagactcggagaagcgcgtgctcgcgcgtaaggcgcttatgcagcgcgtccggtcccaggagctcggcaagaagctccgcgagatcctcatcaagaaaatcaggggccagtgaggacatcagcgcattggccatttacgggcagcatnctgtgtgggtgctccttttttgagcgtgtggagaataactcaactgcgacctttgagcagagacttttgctatattgcatgnaggacagattgagaataaaactagtttttggcgaacgaactattgtattttattgaacaattagtatctatatatgatttaaccggctgttgtgcaaaaaaaaaaaaaaaaaccaggaagacttcgcctttgcaccagtctgtatgatctgggcacctgccaatagatttcgtnnnnnnnnnnnnnnnnnnnnnnnnnnnnnnn

SEQ ID NO: 89974 - protein, 110 aa, Zea mays
  misc_feature: Ceres CLONE 1577817
MQAVARARGLAAAAVAARPSAMEAGHRGQVQQARGIVVQVRDGNLERALAVMERKMRSSGMERLIRARTHYHVKDSEKRVLARKALMQRVRSQELGKKLREILIKKIRGQ

SEQ ID NO: 89975 - DNA, 832 bp, Zea mays
  misc_feature: Ceres CLONE 1577822
  misc_feature: Encodes the peptide sequence at SEQ ID NO. 89976
cccgcggtggcggccgctctagaactagtggatcccccgggctgcaggaattcgtctcacccctagaaaaagagccggtctcccggcagcagcagtccctcgggttgtccacgcggagcgccagccgatggccggccacagtatgtcggttcacccgaagcctataaattcatcgccgccccgcctctcgccgccccgcctctcgccgccccgcctctcgccgcccatttccctccgccgcctcctaatcctcaacacccgagcccccaaccgcgcacgtcgtatgccaccatgcaccgcgcacgccccagcgcgcacgctaatgaccccgatgctgcgtacaccaccgccgtcgcgatgctgctggagcccaaactcgaggacgaggagttgccactgcagcacctggacgtccccgggccccttgcgtgtaccatggaccagctgatgccgggaagtggccgtgccggccgaaacccgcccgctggaagggctgctgacaaggctgcaggtgccgcccttgctgtcccaagactaacaacttggtgaacaaacccgccctggaaggggtccttctcccgggagccctccccggaaaaagttcccccgtgggggaacccctacaactttccccaaagaaacatgcttgccctataaattttgaaggcaaaagaatttttccccggctttctttgggagggccctaaaacccaattgtgggcgaaaacaaaaaaaccttcccgttacctttggtttttccccctaaacaaaattcaaaagcgggggccctcttttaatgggtttgagaaaatttttccctctttagagggta

SEQ ID NO: 89976 - protein, 85 aa, Zea mays
  misc_feature: Ceres CLONE 1577822
MHRARPSAHANDPDAAYTTAVAMLLEPKLEDEELPLQHLDVPGPLACTMDQLMPGSGRAGRNPPAGRAADKAAGAALAVPRLTTW

SEQ ID NO: 89977 - DNA, 1157 bp, Zea mays
  misc_feature: Ceres CLONE 1577823
  misc_feature: Encodes the peptide sequence at SEQ ID NO. 89978
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (20)..(20): n is a, c, t, g, unknown, or other
  misc_feature (23)..(23): n is a, c, t, g, unknown, or other
  misc_feature (26)..(26): n is a, c, t, g, unknown, or other
  misc_feature (709)..(709): n is a, c, t, g, unknown, or other
  misc_feature (1046)..(1046): n is a, c, t, g, unknown, or other
gagggaaagagnnnntntanaanganacaaaaaatctgattttttttgcgtttcctttttttctcgttttattttgaaaagtgggactccccgcggtggcggccgctctagactagtggatcccccgggctgcaggaattcgtctcacccctagaaaaacatcaccttcacccaccgcccggcgcccgccatgtattcggccaaccactggggcggctcgttcgagatctccgatggggcggcggaggatgaccacagccgcaacttggacctggaccgcggcgcgctgtcggcgcggcagcaccacgagctggacgagacgcaacacagctggctgctaggcccgccggacgccaataagaaggacaagtacgtggacctcggttgtgtcagcctaaagcgcaagctcctctggcgggccttgtggtgcgtcgtccccgctttcgtcatgatcgggctccccgtcatcattgcctaggtccccccccacaaaaagctaggcccgccccccgccagatgagtacacagcagacaccgacacaaggctgctcagtcgtctgtcaaggtcccaagaaatgccgggacaacctttccccaagaaacaaatgggcattcaaagtggggcgacgagaaaatctacagggcccgtgaacaaaaacaaggcttcccacactttcctaaggtgaccgtgctaacggggtgtcggccntacgcaccagtagggggtataaacatacgacgagacaccctttgggcgtcaacaaatccctgccgaaaatttcacaccagacgagttgcaacacagaataggacccctctcacatccgcttggtggaacccacctgtgccctccaatgccctcggcactccactgcttgcatacctgacaactttatccagacacacacccacttacttgatacacctgggccccgagtgaggcccggacacacctatctcaaacgcgtatggctctagggggggagaggcctcctcctacaaagtgtgtggtgagccaaccaccaaaaatcatagctatgtacgtngccggaaacccaccgtgcagactatcaggtctgtgggttttttctcaaacatctagctgaacgcccaccattattttgtccccccagtgaggggcggaaggccgtcaccaa

SEQ ID NO: 89978 - protein, 95 aa, Zea mays
  misc_feature: Ceres CLONE 1577823
  misc_feature: SWISSPROT Homolog: EC 3.2.1.4 Cellulase
MYSANHWGGSFEISDGAAEDDHSRNLDLDRGALSARQHHELDETQHSWLLGPPDANKKDKYVDLGCVSLKRKLLWRALWCVVPAFVMIGLPVIIA

SEQ ID NO: 89979 - DNA, 1208 bp, Zea mays
  misc_feature: Ceres CLONE 1577827
  misc_feature (56)..(56): n is a, c, t, g, unknown, or other
ggtattattgtaaaaacataaacaaaatcgctgagcccttcattcccgaaaaatcnatacttaaaatacaaaaaaaggactccccgcggtggcggccgctctagactagtggatcccccgggctgcaggaattcgtctcacccctagaaaaacttcatcgtcgagagggaaacagcccggatcaccagctaaggcccctaaatgaccgctcagtgataaaggaggtgggggtgcaaagacagccaagaggtttgcctagaagcagctcccctttaaagagtgcgtaatagctcactgatcgagcgcccttgcgctgaagatgaacggggctaagcgatctgtccaagctgtaagacgacaaattgcatcgggaggggagcgttccgcctgagagggaagcaaactcgaaagcgggggtcgaccaatcggaaatcacaatgtgggggttgattaacgaaaaaccttggtgaaaaacctaatgccccgaaaaccccaaggtttcctccggaaagggttccgttcccccggagggatgaagttccgggggcctaaaaaacagggctcggaaagggcgtaagtctattggttcctaccagggtcgaaattatttcccgtgtagtaaacccccttgggtgtgtttcctggatggggaatgtggcagactcaggcttaatggtttcaacccacaaacaacaccggctttttctatggtgcttttaaatggggaccgcttaagagtggcgaacgcccctcatggaatttttattactaacgggtgcgacaacgaaagggggcgggctccaaacaaaggcgaaaaaagatgggctctgtcccgcattatcgcctagaaattgttccccagaaaggtattggcatagagtctgactcctaactatatgcgcgccctgtaaacaaggtatatttctaggctcttcactcatgggagcgacgaaagttcagctgttcgcctgttcctatcccattagtataggggagtctcttttatcaagggcgcgcgctgtttgcttggcgccgcggtcgaaagtgacaatgtttagaaccctctaggtaatctcaaacttggctgcgcaaggataaaataattccttagcaaaactgactggtgtctaacaacagatagatgagtgctcctgatttatccacccgacaaaacagcggtaaaaccagttgttatgtatgattgtata

SEQ ID NO: 89980 - DNA, 815 bp, Zea mays
  misc_feature: Ceres CLONE 1577828
  misc_feature: SWISSPROT Homolog: EC 6.2.1.12 4-coumarate--CoA ligase
  misc_feature (50)..(50): n is a, c, t, g, unknown, or other
  misc_feature (108)..(108): n is a, c, t, g, unknown, or other
  misc_feature (133)..(133): n is a, c, t, g, unknown, or other
  misc_feature (148)..(148): n is a, c, t, g, unknown, or other
ctggagctcaccgcggtggcggccgctctagaactagtggatcccccggnctgcaggaattcgtctcacccctagattatctactgacaagcgccagagcagagaggnagagagagaacaccaagcggagggntggggaagggctccnggccctggtggacgccgccgagccgctctccgccgacgaggaggtcggccccgacgacgtcgtcacgctgccctactcctccggcaccacctggatgcccaagggcgtcatgctcacgcatcgcagcctcgtcaccagcctcgcgcagcaggtggacggcgagaacccgaacctgtacttcagcaaggatgacgtggtgctgtgcgtgctgccgctgttccacatctactcgctgaactcagtgctccctacaccgctgcgcgccggctgcgccatcgtgatcatgcccaacttcgagatcggcgcgctgctggagctggtgcgcgcgcccggcgtgaccgtggccccctccgtgccgccctccctggtggagatcgccaaataccccccgtgggcgccgccgacctcgcctccatcccatggtcctgtccggcgcccccccccttggggaaggacctcccggaaccccttcatggcccagatccccaacccccctccccggcccggggtttcgggtttgaccctagccggggccccctggcttggcccttgtcccctggccctttcacccaaggaacccctctccaaggtccaaatccccagctccccttgtggcaacccctctctcccggtaacaccccgaaaccctgaaaatttccccccccct

SEQ ID NO: 89981 - DNA, 770 bp, Zea mays
  misc_feature: Ceres CLONE 1577837
  misc_feature: Encodes the peptide sequence at SEQ ID NO. 89982
tccccgcggtggcggccgctctagaactagtggatcccccgggctgcaggaattcgtctcacccctagaaaaaagccgattgcttccccgaatctcttcccccaatccggcgcccggcagaatgcgaggccgccacctcctaaaacccatgcccgtcctcctcaacactaccccttcccggccccccgccgcccacttccgcgtccgtgacgcagcccgcccgcccgcgccgctggcagagcccgacgtcggcatctctcgcttcgcctcctccatcccgggcttccgcggcgcgctgaagcagcgctactccgacttcatcgtccacgaggtcgcctgcgacggcgccctcgtccgcctcacttccttcgatctccccgacatcgaggagaacggagataatgcggaggacggtgattccgacgccaccgcggatccatcgcgggcgctcgagtcgttccggctgctctgcggcgaagcggattaccacgccttgaggggattcctggagagggtttcggagggaggtgatggttatttgtcgccaatcattctgtcagctgatgcagataaggcacatcgatccgaggtgcacgagttcatcaagaggaatttcaagttcctgaacacggatacagttgagcacaatgatggtattcagaaatgcattagggtgcgcttgggttcagggccacgctgtggtaggggaaggaacaggagaggcatggacacttcaggctggagagatgacaagccgtttgacagtagaa

SEQ ID NO: 89982 - protein, 216 aa, Zea mays
  misc_feature: Ceres CLONE 1577837
MRGRHLLKPMPVLLNTTPSRPPAAHFRVRDAARPPAPLAEPDVGISRFASSIPGFRGALKQRYSDFIVHEVACDGALVRLTSFDLPDIEENGDNAEDGDSDATADPSRALESFRLLCGEADYHALRGFLERVSEGGDGYLSPIILSADADKAHRSEVHEFIKRNFKFLNTDTVEHNDGIQKCIRVRLGSGPRCGRGRNRRGMDTSGWRDDKPFDSR

SEQ ID NO: 89983 - DNA, 851 bp, Zea mays
  misc_feature: Ceres CLONE 1577838
  misc_feature: Translation starting site: 324
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (495)..(495): n is a, c, t, g, unknown, or other
  misc_feature (497)..(497): n is a, c, t, g, unknown, or other
  misc_feature (498)..(498): n is a, c, t, g, unknown, or other
  misc_feature (501)..(501): n is a, c, t, g, unknown, or other
  misc_feature (502)..(502): n is a, c, t, g, unknown, or other
  misc_feature (504)..(504): n is a, c, t, g, unknown, or other
  misc_feature (508)..(508): n is a, c, t, g, unknown, or other
  misc_feature (509)..(509): n is a, c, t, g, unknown, or other
  misc_feature (514)..(514): n is a, c, t, g, unknown, or other
  misc_feature (525)..(525): n is a, c, t, g, unknown, or other
  misc_feature (544)..(544): n is a, c, t, g, unknown, or other
  misc_feature (564)..(564): n is a, c, t, g, unknown, or other
  misc_feature (569)..(569): n is a, c, t, g, unknown, or other
  misc_feature (582)..(582): n is a, c, t, g, unknown, or other
  misc_feature (586)..(586): n is a, c, t, g, unknown, or other
  misc_feature (593)..(593): n is a, c, t, g, unknown, or other
  misc_feature (673)..(673): n is a, c, t, g, unknown, or other
  misc_feature (674)..(674): n is a, c, t, g, unknown, or other
  misc_feature (694)..(694): n is a, c, t, g, unknown, or other
  misc_feature (752)..(752): n is a, c, t, g, unknown, or other
  misc_feature (754)..(754): n is a, c, t, g, unknown, or other
ctggagctcaccgcggtggcggccgctctagaactagtggatcccccgggctgcaggaattcgtctcacccctagaaaaaactcacgcgcgcgcgctactgaatgagagccggcttctccgacacccccctcttcccacccacacacacacactcacacacaccggccgccgggaaatgttgctgctgttctctgttcctgttggtgttcttctccccacgctgatcccagcgtttccgaaccagatgtgaagccgcttgctctgcgattgctggttgcgggctgcagcgttgtgtgaggtgcgtggtcaagtcgacgcgaagatgagcaaggaggacgtgctcaaggtgcagacctgcgtgctgaaagtgaatatccactgcgatgggtgcgagaagaaggtcaagaagatcctccacaagatcgacggcgtgtaccagagcagcatagatgcgaagggaaaaaagggggaaacggtttnnnnnnntnntnttntnnggnngnggtnntttgnggtggtgttgnttggggggggtgggggggnggtgggtgtgggggtggggntgtgnggggggtggttgngggnggggtgnggggggggtggtggtggggggggggtgggttggtgtgttgtggtggtgttttgggggttggtgggggggtggggggtggnnggggtgttttggtgggtgtntttgttgggggggtgtttttggtgggtggttggggtggggggggaaagatagggtggnantttgggggaataatagagaatggaaaggggagggaaaagggtggaggtaaatagaaaattgagatgtgtaaaataaaaaaaatgaagttaataataa

SEQ ID NO: 89984 - DNA, 807 bp, Zea mays
  misc_feature: Ceres CLONE 1577843
  misc_feature: Translation starting site: 160
  misc_feature: SWISSPROT Homolog: EC 1.4.1.2 Glutamate dehydrogenase
  misc_feature (538)..(538): n is a, c, t, g, unknown, or other
ctcaccgcggtggcggccgctctagaactagtggatcccccgggctgcaggaattcgtctcacccctagaaaaacctctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagcaatgattgttgtccagcacaaggtgaagagaaagcagttgcagctgaagagatctcctctatgggntctatcaagatgcgtgagattgctgaagcttacctgggtagcacgatcaagaatgctggtggtcccagtccctggctacttcaatgactcccaagaggcaggccaccaaagaatcctgggggtgattgcctgggcttaaatgggctggggtatattaaagagaccaacggctggacctttcgcccttaggccttggccaagaaaggctacccctgggccgggaaaaaaaaatggcccccccctttgaaaccttgggagggggggacccc

SEQ ID NO: 89985 - DNA, 903 bp, Zea mays
  misc_feature: Ceres CLONE 1577844
  misc_feature: Encodes the peptide sequence at SEQ ID NO. 89986
  misc_feature (402)..(402): n is a, c, t, g, unknown, or other
  misc_feature (846)..(846): n is a, c, t, g, unknown, or other
caccgcggtggcggccgctctagaactagtggatcccccgggctgcaggaattcgtctcacccctagaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcnctgtggcgctcgctggagctggacctggtccacatcctctgctccgcgttcctggtcgtcttcgtcggcaccgtgtacgtgatgtcgcgccccaggccggtgtacctggggggactacgcctgctacaagccccaccgccagctgccgggtgcccttccgccaccttcatgggaagacacgcgccctcattaggggacgacgaacaagaggggggcgctttccagaccaagaaacctgggaaccgcttcgggggctcgcgcgagagaaaaaattgcctccccgccccgcaaaacaattaaattccccgccccaaccccaaagattgggaaggcccccgcccccgccgaaggagcacaacctccgcaattttttctcccgccaaataaaaagaaaacttcgttccgccccacaaaggggggcttcaataccccccgaggaaaaantgtaaatttccctcggcgtcgtgccaaacgtgggaaacccctccctttattcacacg

SEQ ID NO: 89986 - protein, 152 aa, Zea mays
  misc_feature: Ceres CLONE 1577844
  misc_feature: SWISSPROT Homolog: EC 2.3.1.119 Icosanoyl-CoA synthase
MPSGSVFSGSVNLKHVKLGYQYLVNHFLTLLLVPVMAATALELARLGPGELLSLWRSLELDLVHILCSAFLVVFVGTVYVMSRPRPVYLGGLRLLQAPPPAAGCPSATFMGRHAPSLGDDEQEGGAFQTKKPGNRFGGSRERKNCLPAPQNN

SEQ ID NO: 89987 - DNA, 870 bp, Zea mays
  misc_feature: Ceres CLONE 1577848
  misc_feature: Translation starting site: 200
  misc_feature: SWISSPROT Homolog: EC 3.2.1.21 Beta-glucosidase
  misc_feature (366)..(366): n is a, c, t, g, unknown, or other
ctccccgcggtggcggccgctctagaactagtggatcccccgggctgcaggaattcgtctcacccctagaaaaaaagactcggtaccaagcagagctcaaacagttcttgcttcccgctggctagctcgcaagaaataatggctccacttcttcttgcttctcgcacagcctgtcatcctggccttacaagcagccgccatgataatggccggcacggcctttcttcttcaccgggaagtagtagtaagcgaagccgtagccttagcttcatactacgagctgaaaagacgacgacaggcggtgagggtcatgttgtgagcgaaaagctgagcccctgacaaatctccaggcagaagtgtgtccgngctagctttatctttggtgccaccacttcaccataccaaatgaaaagcgcttagtaacaaatgtagcaggggccaaacacgttggacgaactctgctcaaatttcccggaggggataacggacgggagcactggggatgttgaacgaacttccaaggacctgtatggggaggatggggaaattcctaagggaaagggaattgaacccctaagggctccttaaaacctttgggcccaaaaagggccaaaaggggacccctcaaggaaagctttttaccaataaagggctcggaaaaaaaaaaaaaggggttttcaaatctgttgaaaaaaaaccgggcaaaaaaaacctttggggaaatttttttggggggggaaaacccttaaagggggggggggaaaaaaaaaggggggtcttttttatagaggggccgcggaaaaataaatggcgggttttttccccgggggtggttttttgaatttttttccaaaacctcaaaaaaaaaaa

SEQ ID NO: 89988 - DNA, 1127 bp, Zea mays
  misc_feature: Ceres CLONE 1577850
  misc_feature: Encodes the peptide sequence at SEQ ID NO. 89989
  misc_feature (783)..(783): n is a, c, t, g, unknown, or other
ttttttgtgggtgggggggcctccacaaattctgggtgggtctcgtgactgggtaatttataacaaaaaaaaaaaaatggactccccgcggtggcggccgctcttgtagtagtggatgccctgggctgctgttattcgtctgaccccgagaacaagccgcggagccggctccccgatgcgatctgttctcgagggaagatggcgactccaccgccggcaatccgccccgtcgacgcgctcctcctcctcgtcctcgctggcatcctcgcctccgccgcgagcgccgatctcgtcatctccaaggcagatcggagggttgatctgacctcggatatcgttcgcgtcctcgcttcactcacggctgaaaatgttggaccagaccctggctctcaagtttgactgccttttcccaatattcaagccaagaacttggcagctattagagcattccgcagtgaagggaaactgaagggtcaaaggactgccctcccgattgagggtgtgcaacctactggagctcccccgggagctgacattcattttccaccttgtctgccgaaaccgtttggaaaaaggaaaagacctctggtagttgcaatgtttcttgactgggggtacaggacacttctccttgcaagccatctccccggcaataaaatccacccgcccagcgcgggaagccaccaaaccgtggctttgggcctaattcccggggaatcactgtggcccacaactatagactgggcccggcgccttcaacccactgggatttaaaggggcgtncgacgcaaaacaccttgggcgtgaagaccacgcacatctgccccttgggtatcgccaaaaggagtttacaaaaatccgtttcccgcttgggggggagagtcacccatatagcggacaaaaagagtttgggtgtgggaatgtcctcggaaacacgggagagattattgggggaaccacgctattccactggaacccgtgttgcaccccggtattccctcgcctaagatattgcccggagagaaacttgggtgccctcttctgtgggggaccacccgacccatttcctcttttttttgccggggctgtgcgaataaggtagagggtggtatcagagcgggtggctc

SEQ ID NO: 89989 - protein, 66 aa, Zea mays
  misc_feature: Ceres CLONE 1577850
MATPPPAIRPVDALLLLVLAGILASAASADLVISKADRRVDLTSDIVRVLASLTAENVGPDPGSQV

SEQ ID NO: 89990 - DNA, 908 bp, Zea mays
  misc_feature: Ceres CLONE 1577852
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (29)..(29): n is a, c, t, g, unknown, or other
  misc_feature (70)..(70): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (99)..(99): n is a, c, t, g, unknown, or other
nttggggggggggagnnnnactcctcccngctatcgcggttcgtcatacggttcattattaatatatatntggnnnntggtaaaagctggagctcaccncggtggcggccgctctagaatagtggatcccccgggctgcaggaattcgtctcacccctagaaaaaacaggcggagctgcgatgccaccaggtggagccgtgcctgctcgctcaggcgtcatgacggagccgaacgcgaggagccgagtgttttatccccgccgaagcccatccccatttgataccagcgagcgcagacatcgccggggacgccatcatcctcggctgcctccaagaccggcccaccgttctgcctgcactcccactcccaaaccccatgatgaacctccctttccggctccgccatctccgacgccttctcgctgccccgcccttaccaaccctcgccgccacacactcccatagcccaccctccttccgaccgctgcaccccacccgaatccagccgctgcggttccatctacccaaccccccagtgcggcggctctcctccgagcacgcaatcctccccacccacctccaggacgagcgcttcgccacgctctcggataggatctatgatgccgtgattaagacggggacggaatccaacgagggcaccgaggccgcgctcgacgcgttgggcgctgagctgactacccctctcgtcgccgacgtgcctgcaccgcctccgcctacgaggaaaaaagctgggcgttccgggttctttcggcctggggggtcccaaccggggacgggataccaagccacgaaacccggacggaattttgcaaaccaacattcaattccaacaattttctcttctcggggaaaccgtcgtggtaaccaaggaacgcccgctccaggtt

SEQ ID NO: 89991 - DNA, 850 bp, Zea mays
  misc_feature: Ceres CLONE 1577858
tccccgcggtggcggccgctctagaactagtggatcccccgggctgcaggaattcgtctcacccctagaaaaaatgcctccagtgtccagtccagagtccaggctccaggactaccaccacttcgtctcgtcctcacacctcactccaccacctctgccttgcaaagccttccaccgatccgccgcctcgtccgcgcgctcgcaggcagcagtgtggactacccgccccatactccatcccctactcgaaggtgagcaaaccaaacccggcccggccgcgcgtctcactcccatcgtaattcgtaacctacagacacctgttctcggcaccggtgcacgccggatcttctatcgtcggtaagcccacccagatattatccactgcaaaaagacggcttgatccgcaccccggaaacccagggctaggcgaataaaatccttgtttgggcatgtagggttttagcggctgtagcctataagccagtagcagtgggaaccttttggctttattttggatttgcgaactgcgcgtgaaagctctgtattgatgagggttcttttctcgcttcaattgttgcaggatacaccgtgagtaggcgtgatggtgcttgataccccgttttcgtgcagcttgttgctaattcggtttagttttgagggatcaaaaaccaccctggttcctttctttctttcctttccgggaacaatttatgatggaatcatttgccaaatctcttgaaaaatattttttcacctggaaaaaaaactggccttgcccttttgaacttcccttgggttcacggtggcaaaaggttcctttggcccttccgaaattttggcaggaacctca

SEQ ID NO: 89992 - DNA, 779 bp, Zea mays
  misc_feature: Ceres CLONE 1577859
  misc_feature: Translation starting site: 270
  misc_feature: SWISSPROT Homolog: EC 2.7.11.1 Non-specific serine/threonine protein kinase
  misc_feature (511)..(511): n is a, c, t, g, unknown, or other
  misc_feature (779)..(779): n is a, c, t, g, unknown, or other
ctggagctcaccgcggtggcggccgctctagaactagtggatcccccgggctgcaggaattcgtctcacccctagaaaaagtcgagcacacaacacaccctcctcgtcctccaatccaatcaacctggtagactcgcttctcccccagccgtcggacggagctcctcgcagtcgcagcagccgccgatcagcctgcgctcgggctcagcgctggaaggtgttggaagagaatagcctgaaggttcacagtaaccttcatctgtcggaagatgtatcgggctaagagggctgcattgtcaccgaaggtgaagcgccgcgtcggcaagtacgagctcgggcgcaccattggggaagggaccttcgccaagggtccggtttgctaagaacactgaaaacggggaacctgttgctatcaaaatccttgacaaggagaaggttaagaggcacagattggttgagcagattaagcgtgaaatttgtatcatgaaattagtaaggcacccctatgttngtcgactgtttgaggtgatggggagtaaagcaagaattttcatcgttctggaatatggtacccggcggagagcttttcgaaatcattgctactaatggaaggggtgagggagacgaagcacgtaaatacctccagcaactgattaatgctgttggatacctgccccggtaggggaggtgattcacagaaacttgaaacctccagaatttgcctgcttgatgctgccggaaaatcccaaagtttccggcctttgggtttaagtgctttn

SEQ ID NO: 89993 - DNA, 820 bp, Zea mays
  misc_feature: Ceres CLONE 1577860
  misc_feature: Encodes the peptide sequence at SEQ ID NO. 89994
acccgcggtggcggccgctctagaactagtggatcccccgggctgcaggaattcgtctcacccctagaaaaataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaacaaattcggctcctgtcgtcacgcgaccgcggtccactcgcaggggcagtggaccgtgctgctgccggcgacggcgacggcgaagaattcttggggtccgcggcatggccaagcaaaaaatctcaacgagggccatctcgtcccctgttcctgttccccactgggcaacgctacccaaataagagcttgaagccggggggcgtctgccgccctgccaact

SEQ ID NO: 89994 - protein, 214 aa, Zea mays
  misc_feature: Ceres CLONE 1577860
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTNSAPVVTRPRSTRRGSGPCCCRRRRRRRILGVRGMAKQKISTRAISSPVPVPHWATLPK

SEQ ID NO: 89995 - DNA, 1215 bp, Zea mays
  misc_feature: Ceres CLONE 1577863
  misc_feature: Encodes the peptide sequence at SEQ ID NO. 89996
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (27)..(27): n is a, c, t, g, unknown, or other
  misc_feature (37)..(37): n is a, c, t, g, unknown, or other
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (73)..(73): n is a, c, t, g, unknown, or other
  misc_feature (674)..(674): n is a, c, t, g, unknown, or other
  misc_feature (923)..(923): n is a, c, t, g, unknown, or other
  misc_feature (982)..(982): n is a, c, t, g, unknown, or other
nnnncccgggttaaaatcaatcaacgncacacagccncccctccggtcgggcgaaacatttnntttttncttnaaaaaactggaactcaccacggtggcggccgctctagaactagtggatcccccgggctgcatgaattcgtctcacccctagaaaaagaccggccgttgttgctttgcgtcttcttccaaaaacagaataagcttgtcttgctccgatcaggcgtgttcttaggcttcgctgcccctaccgcgtcttcgccgggatcggtccatggccggcgccgagcgcgcggaggcggtcgcgctggaacaagggctcctcgatccggaggaatccaaccaagtagtatacactggagatggatcagtcgacttttctggaaatcctgttgtcaaggaaagaacgggtagatggaaggcatgtccattcatattacgtaatgaatgctgtgaacgactggcctactatgggcatctgcacaaaccttgttacttacttgacaaaaaaactgcatgctgggaaatgcctctgctgctaagcaagtgtgactacattgggtcgggaaacgttgctaccttaaacctcccaactttattggggaaccaagtccctggggctaggatgccactaactaggggggagaaaggtaacttgcggaaacaattctgancaaaccagtttgtatacccacacgagggaaattaccctttacaatttccgggggaaatttgaaccacaactgtggccggggaacgcttagccttgttgtacggattgcaagtgtgaaagggctaattcgcccatatatatggcgctatggtgaataggcccaaccttcctcccgatccctatagtgggggggagaaaaaggagaaatacccactatgtattgttggtgccccccaaagggccaaaggcnacagagacgcccccccgcgcttttttttctaagagaagagttataccctgggccccccnttcattttactattcaaatttgtgggggtacacttttgttagaacccacgagaaatatggcccccccgcggcgggggataacgctacgagagtaggggataaacattaaaaagagtccccgagggggtggggcctctctaatatctccatactctttggagcaacgcccggacaaaccactatattctttgtgcaagtggagaggagcgagcatattctccgcggtccgtggg

SEQ ID NO: 89996 - protein, 132 aa, Zea mays
  misc_feature: Ceres CLONE 1577863
MAGAERAEAVALEQGLLDPEESNQVVYTGDGSVDFSGNPVVKERTGRWKACPFILRNECCERLAYYGHLHKPCYLLDKKTACWEMPLLLSKCDYIGSGNVATLNLPTLLGNQVPGARMPLTRGEKGNLRKQF

SEQ ID NO: 89997 - DNA, 862 bp, Zea mays
  misc_feature: Ceres CLONE 1577864
  misc_feature: Translation starting site: 199
  misc_feature (628)..(628): n is a, c, t, g, unknown, or other
  misc_feature (645)..(645): n is a, c, t, g, unknown, or other
  misc_feature (695)..(695): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (796)..(796): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (827)..(827): n is a, c, t, g, unknown, or other
  misc_feature (828)..(828): n is a, c, t, g, unknown, or other
  misc_feature (834)..(834): n is a, c, t, g, unknown, or other
  misc_feature (835)..(835): n is a, c, t, g, unknown, or other
  misc_feature (841)..(841): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
ctggagctccccgcggtggcggccgctctagaactagtggatcccccgggctgcaggaattcgtctcacccctagaaaaactctctctctctcctccaagatctgtcgatcacacacaccacaccatacacgcgcagctttttgctgctgcttgctcgtctacttgcccctgcttcttcttcttcttcttccatcgcaatgccatcccctcgccaattcttgcagctgctgttacccatctttctcgccacttgctgcgtcgatggagccaacggcccccacgctcccgccaccgcgaggaggcagctccaccagcccttcttcgtcccggatcagcccgggcagccgtcggcgccgccgccgttctttcccgcgattccggtgacgcccccgcctcctgtgccgacggggcaggaccagccgacgtaccccgctctggtgttccccagcaacggctccagcggtgccacgcccccggccggcaactcgcacgggtccaagaagtcctccaagctcgtcccggccatactgctgccgctgctcacggtggccgtgctcgggctgtccatcgctttcttcttctcgcaccgccggcgcaatgcggccccgcggggaagcggcgggtgcntttggtgggcggggacnccaagttcttgcacccggaaaagacgagccctctcgcgcgtgacgagtcngtgcacgagnnnnnnnnnnnnnnnnnggggagggannnnnnnnnnnnnnnnnnnnnnnnnnnnnnnnnngnnnnnnnnnnnnggnnnnnnnnnnnnnnggnggnnnnnngggggggggggnnnnnnnnnngnngggggnngggggnggggnnnnnggnnnggggggg

SEQ ID NO: 89998 - DNA, 824 bp, Zea mays
  misc_feature: Ceres CLONE 1577868
  misc_feature: Encodes the peptide sequence at SEQ ID NO. 89999
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
ctggagctccccgcggtggcggccgctctagaactagtggatcccccgggctgcaggaattcgtctcacccctagaaaaagagaactccccttctccgccactaccgaagcccttgtacccctcaccgccgccgctgctgctagggagcttccacccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcgccggcggttgtgctgccgcctccgccgcaggtgatccgcatgttcgccgcgcctcccccgccgccgcgtgggggcttcttctccgcgccgcagccccggccgttcgagtactatgcgcctatcggtgaacgcagcggatttgctgccaaggagcaacaggcgccggagctggaagcggagatgctcccgcccgccgcggtgaagacggagccagtggtgggatgggctcgacgaacgagtggtgcacaagatcaccaggcaggtggaatactatttttagtgacatcaaaccttgctactacagaacatctgatgaatctacagatcgagatgtagtnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 89999 - protein, 164 aa, Zea mays
  misc_feature: Ceres CLONE 1577868
  misc_feature (32)..(49): Pfam Name: PAM2 Pfam Description: Ataxin-2 C-terminal region
MPQMEGSTDQIAAGWFAKEPASERPVGLPRTGSSSRLNAQAPEFVPRGPPPPAPAVVLPPPPQVIRMFAAPPPPPRGGFFSAPQPRPFEYYAPIGERSGFAAKEQQAPELEAEMLPPAAVKTEPVVGWARRTSGAQDHQAGGILFLVTSNLATTEHLMNLQIEM

SEQ ID NO: 90000 - DNA, 777 bp, Zea mays
  misc_feature: Ceres CLONE 1577869
  misc_feature: Encodes the peptide sequence at SEQ ID NO. 90001
ggagctccccgcggtggcggccgctctagaactagtggatcccccgggctgcaggaattcgtctcacccctagaaaaagactaccaccagacagacctcgagtgctccattgctcccgtcccccttctctcccgcctcccccccttctctcgtcgctagacctgccgcccggccggcctatatgttctctccttttgagagaagggaggaatagccgcaagcctgcagcgcaaaggaaagcacagcagcggcggtttgcaaaagagcccgccacctctgtctctctgccctgcgctgcgccgtccacaccactcatccggcaacctctctctgtctccactcgtacagtattaatttcctcgcgcctcctccgtcctccattttttttgttgggtgccgtgcgagctccaagtacccctgtctccctcccgtcttgcgggcttgcctttgcctgttccatttccggctcctccagttggtagtgtcgtttcaatgcgagacgccgtccttcacgagcttgattgcccttgaaagcgaagttggtgttggtgtcgttgccggtgaggaggaagaggggatatatggctcccacggaagaggcagcaggggaggacgagcggctgctgaaggatcttctcgcttcttcgtcagataaggaaggagaggatgaagagagtacaaagacacagtccgatgaatctactaggggggattgtgataacggcgggtccgtagccgccttatcgagtgaagatgtcaatgataggcatggtagtg

SEQ ID NO: 90001 - protein, 65 aa, Zea mays
  misc_feature: Ceres CLONE 1577869
MAPTEEAAGEDERLLKDLLASSSDKEGEDEESTKTQSDESTRGDCDNGGSVAALSSEDVNDRHGS

SEQ ID NO: 90002 - DNA, 795 bp, Zea mays
  misc_feature: Ceres CLONE 1577870
  misc_feature: Encodes the peptide sequence at SEQ ID NO. 90003
ctccccgcggtggcggccgctctagaactagtggatcccccgggctgcaggaattcgtctcacccctagaaaaatcacctccgattcgattccttgtcccctcttgatccgagccgccaccaaaccctaactatctaaaacccccgtctcgctgtccgatggccgccgcctcgccgccgccctccccaccccacgcaaagcgccccaagatgtcctcctcctccgacccggaagccgatgctgagcccacctcggcctccgccgccgttgagggcgccgatcctgcgcagcgtcgtcccaggtacaagcgccgcaaggtcgccatccttctcgggtactgcggcgcggggtatcagggcatgcagaagaatccgggcgcgcgcaccatcgagggggacctcgaggaggcgctctaccaggcgggcgccgtgcccgaggccgaccggtccgcgccgcgccgttacgattgggcacgtgctgcgcgcaccgactagggcgtcagcgccgcggcgcaagtggtgtccgggcgcttctacgtcgacccgccgggcttcatcgatcgcttgaacgcgcagctcgcgccgcagatccgcgcctacggctacgtgcgcggttaccaactcattcaacgcgaaaaaagttctgcgaccgccggaggtacctgtatcctgcctccccgtattttgctccttgaccccagcgcacaccccggacccgcgaggcccgtcatggccgaaacatggggggaatggggacccaaacctttcccaaggggccctgggagaggccccacaa

SEQ ID NO: 90003 - protein, 111 aa, Zea mays
  misc_feature: Ceres CLONE 1577870
  misc_feature: SWISSPROT Homolog: EC 5.4.99.12 tRNA-pseudouridine synthase I
MAAASPPPSPPHAKRPKMSSSSDPEADAEPTSASAAVEGADPAQRRPRYKRRKVAILLGYCGAGYQGMQKNPGARTIEGDLEEALYQAGAVPEADRSAPRRYDWARAARTD

SEQ ID NO: 90004 - DNA, 913 bp, Zea mays
  misc_feature: Ceres CLONE 1577871
  misc_feature: Encodes the peptide sequence at SEQ ID NO. 90005
atagctggagctccccgcggtggcggccgctctagaactagtggatcccccgggctgcaggaattcgtctcacccctagaaaaactcgtgtctctgttgggagctccttcaacatctcgtctctctcatcctccgacgccatccgctcccggcccggccgagccgcgcgttgtgtatggattccaaaagcaatcatacaggggctatggcgaggccttacaaacctaagaatatcctcattacaggagctgctggttttatcgcctcccatgtcgcaatccgcattaccaagaagtaccccgattacaagattatcgtccttgacaaacttgactactgctctaatctgaagaacctgcttcctgtgagctcatcaccaaacttcaagtttgtgaagggtgatattgcaagtgttgatcttgtcaacttccttcttgtcacagagaacattgataccataatgcacttcgcggcccagacacatgtcgacaattcatttggggaattcttccgaatttaccaagaacaatatttatgggtacccatgtactttcttgaggcctggcaggataagggggcaaatcaagaagttccatccatgtcaccactgaggagggcctagggggaaaactaaccaaggatgccatttttttggaaacccatgaaagattacagttggttttcttaaaaaacccatttgggggcccccaaacgggggggcggaaaaatcctttaatggccttatgggaagaaccttgggggggcgccgtttataccccccgcggggaaaaaaaaggttttggggcccaaaaatgttcccctgagaaaatttttccccaaaatttttttcctttgggcaaaaaaaaagaggggccccccccccccaccccggggggaggggaaacaaaccccc

SEQ ID NO: 90005 - protein, 138 aa, Zea mays
  misc_feature: Ceres CLONE 1577871
  misc_feature: SWISSPROT Homolog: EC 4.2.1.46 dTDP-glucose 4,6-dehydratase
MARPYKPKNILITGAAGFIASHVAIRITKKYPDYKIIVLDKLDYCSNLKNLLPVSSSPNFKFVKGDIASVDLVNFLLVTENIDTIMHFAAQTHVDNSFGEFFRIYQEQYLWVPMYFLEAWQDKGANQEVPSMSPLRRA

SEQ ID NO: 90006 - DNA, 1134 bp, Zea mays
  misc_feature: Ceres CLONE 1577872
  misc_feature: Encodes the peptide sequence at SEQ ID NO. 90007
  misc_feature (25)..(25): n is a, c, t, g, unknown, or other
  misc_feature (31)..(31): n is a, c, t, g, unknown, or other
  misc_feature (34)..(34): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (917)..(917): n is a, c, t, g, unknown, or other
  misc_feature (986)..(986): n is a, c, t, g, unknown, or other
ggggtgggggggggggggttgggtnatcttncanagccggggggggccgggaggggcggttttttttnnnnnnngnnnaaaggctgggactccccgcggtggcggccgctctagactagtggatcccccgggctgcaggaattcgtctcacccctagaaaaaaacctggttcaaacacctcgcttcactagaggaataatctagcagcttctgttgcctccaaattgtccggagaaaggagttgaagcagtgtgagagggccctgagacgatggcgaacctgttcctcaagcaggcaaagcagtacgtggcgacgcggccggtctacccgccggagctcttcgacttcatcgcctccaagacccctcgccgcgacatggcctgggatgtcggcaccggcaacggccaggccgcagcgtcgctggcgaagctgtacaaacacgtggtgggcacggacacgagcgcgcagcatctcgcctacgcgacgcgcctcagcaacaccccggctacgtgcacaccccagcggacccggccctttggaggggatccactgccaccgttggcccccggcccggccttcccgttcgaacccttcgtcaacccgtgcgcggcaggccccttgtccacttgggtttcggacccttcaccggggcctttcttagcgcgcgcaaggggccccgccttccggtgggcttggcggcgcccccggggcccaccggggaggagggcgttccggccccgccccctgtggggtggcgctaacgcaccccggaaaaggcgccaagcgagcggattctgaaaacgggctccgcccccgtgtacaaaaagcaaccccgtgtggttactcttggcggcgcgcccgctgtttaaacccatacgcggggttctcccgcaggcggggaaataacgtgtgggagncggtccccgcgaaccgcggtcccggggggatgggggttccgcaatatacaccaaactttatccccgggngaaacatgtcgcataatcttttcctccctgtttgccgacacccccgcgggttctcagagagggggggaagaaaaacccacgccgcgtggggcaccccggttctcccaggtgttctgtcgacaggcacacccacgcccgaggaatggga

SEQ ID NO: 90007 - protein, 175 aa, Zea mays
  misc_feature: Ceres CLONE 1577872
MANLFLKQAKQYVATRPVYPPELFDFIASKTPRRDMAWDVGTGNGQAAASLAKLYKHVVGTDTSAQHLAYATRLSNTPATCTPQRTRPFGGDPLPPLAPGPAFPFEPFVNPCAAGPLSTWVSDPSPGPFLARARGPAFRWAWRRPRGPPGRRAFRPRPLWGGANAPRKRRQASGF

SEQ ID NO: 90008 - DNA, 819 bp, Zea mays
  misc_feature: Ceres CLONE 1577874
  misc_feature: Translation starting site: 150
  misc_feature (560)..(560): n is a, c, t, g, unknown, or other
ggagctccccgcggtggcggccgctctagaactagtggatcccccgggctgcaggaattcgtctcacccctagaaaaactctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacngtggagtccggcgtggcggtcggttccggcgaatacctgatcgaactctacgtcggcacgccaacgcgggcgtttccggatgatcatggacaccggcaggcacctcaactggctgcaatgcgcgccgtgccctggactgcttcaagcaacgttggcccggtggttgaacccccccggcgtcctcctccctaccggaaacgtcacctggcgggggaacagcgcctgcgggcccttgtgggggcccgcccaaaaggggccg

SEQ ID NO: 90009 - DNA, 1132 bp, Zea mays
  misc_feature: Ceres CLONE 1577876
  misc_feature: Encodes the peptide sequence at SEQ ID NO. 90010
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (38)..(38): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (72)..(72): n is a, c, t, g, unknown, or other
  misc_feature (93)..(93): n is a, c, t, g, unknown, or other
  misc_feature (801)..(801): n is a, c, t, g, unknown, or other
  misc_feature (1074)..(1074): n is a, c, t, g, unknown, or other
attgttttttttnnntattatgtttttattttaaaaancaaagaagcagtgagcgccggngnnngggaattnattaaaaactggaactccccncggtggcggccgctctagaactagtggatcccccgggctgcaggaattcgtctcacccctagaaaaaaccgtccaccatcaccgcctcgtgtgcagcgtgctcgctcacctcctctgtcgacgcaccaccccgaagcccccccgccgcgctcgcagggtgttcgacccttcgcccgcgcgccctcacgacatggcctcctccgtctccgccgccgccaaggccgccgcggcgttcgcgcacaaggtccagaaggagctggccgcgccggcgcagcgccgcgcgggcttgacccgccgggacaagccctgcagcgtgcgcgccgtcgctttccccacgcgcgccctgtcgtccaccggctcggggaagagcgcaatgacgactaaccgaaaataaactgggcgccgggcttcctgaacccccccgcagtttggaaaccccggggtaaaaacctgtgggggtcctaatttctaaaatgtgcctccatggacctcaacgaaccttttttacgggggcccccgggcggccccttccaaacaaaaccctttaaaaaaaaaaggaagttttctcggggggaagaggaaaaccccgcacagtgggggttccgtgtgggtacaccccccccgttataaaaaaagagtttttcggtgcgcccggatgtaaattcccccctgcggggaaacccccgacctttgtaacttatgcttttntaccctccctaggtagcgtaaaagaggaagtagaggggtccccacaataaccctgccgttaatgtgtgtcacgataaaaaatatcccctttctaatagaggagaaatctttctttcgtcttgccaggagaataccaataaaaatacatctccgaggagtactgttcttccttgttataacaaatttcacagaggacaccctcccatagacgtatattttccaggagggtgttatattcccgcgggaaccatccaaaaggaatgcttgcttgtnccacacataatatcaaaatcttcgctatatgggagaaggggccacttttcggtaatag

SEQ ID NO: 90010 - protein, 67 aa, Zea mays
  misc_feature: Ceres CLONE 1577876
MASSVSAAAKAAAAFAHKVQKELAAPAQRRAGLTRRDKPCSVRAVAFPTRALSSTGSGKSAMTTNRK

SEQ ID NO: 90011 - DNA, 844 bp, Zea mays
  misc_feature: Ceres CLONE 1577877
  misc_feature: Encodes the peptide sequence at SEQ ID NO. 90012
ggagctccccgcggtggcggccgctctagaactagtggatcccccgggctgcaggaattcgtctcaccccaggaaaaaaaaggcccaacacaacccaatccggaaccccaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccagggcctcctccgccaccagctcgacatgtgctcccgcaacgccgacctcaccaccgcgctccgcctctacgacgacgccctctccccggacaaccccatcccgctctccctccaccactacaactgcctgctctacctctgctccaacgccgccgctaccgactctgacagccatatctccgccaccggcgctcaacgcggcttcgacatcttcgccaggatggagggccgacggcgtccagcccaacgaggccaccctcaccagcgtcgcgcgcctcggccgccgccacccggggacgctgccattgggccttctccgtccttccagccgcaatggccgcctgcggggaacccccggcggggccttcagcaacttaagggccccgccccttctttcgccttactgcggatggccaaaaaaattgccgaacgggcagcccaagacaagggccaaagggcttccacaaggggaacggcaa

SEQ ID NO: 90012 - protein, 230 aa, Zea mays
  misc_feature: Ceres CLONE 1577877
MAAAVLRPTAATLRFLSTPPHQRRRVLVGHLPFARRRRHSSTATAPALEDSSPRSGEGKAVRRRRARESPQGLLRHQLDMCSRNADLTTALRLYDDALSPDNPIPLSLHHYNCLLYLCSNAAATDSDSHISATGAQRGFDIFARMEGRRRPAQRGHPHQRRAPRPPPPGDAAIGPSPSFQPQWPPAGNPRRGLQQLKGPAPSFALLRMAKKIAERAAQDKGQRASTRGTA

SEQ ID NO: 90013 - DNA, 880 bp, Zea mays
  misc_feature: Ceres CLONE 1577878
  misc_feature: Encodes the peptide sequence at SEQ ID NO. 90014
gagctccccgcggtggcggccgctctagaactagtggatcccccgggctgcaggaattcgtctcacccctagaaaaagaacgccaatcggcacgaccatggctgccatccacctgcgcccgctccgctccgtcgccgtctcctccgcgaggtaccgctcgcttctccaccttctcgcccgccccctctcctcttcccaatcgtcccacgcctaccaccctttccccaccccggccgccgccgcccccaaccatgttcaccaccaccaccctacccaccacagccagcagcagtcggcgccgccgaggaacccgcctccccttggcccctctccgcagtggtccccgcagcctccgccgccccgcggctatgggcctccaccgccgcagcacccgcatgtgccgccgccgccgccacgcggctacggacctctatcaccgggacagcacttgccgccttcgccacacggctacggccctccactgccgccgccgccaccaccacacggccacggacctccgccaccaggacagcatgttgtgccgccgctgcctccatcacacgggcacagacctccaccattcgtgccagcagggggccaccgtcggccgccattcgaagggtcagcggaacttccgccaccggggccaaataacgtgccggtctggcccttgccacggcgaccagggggcctttcaccctcccgaaacaggaaggtaaccggccttccaacggcccgccggccctgaaaccttggaagcggggggccctgggggaaacgctaaaggggaatattgtggcccgggagagggtccgcgggtaaaagggaaaccccagtggaaacctttcctggggaaaaaggggggggcggtgcgcccccc

SEQ ID NO: 90014 - protein, 216 aa, Zea mays
  misc_feature: Ceres CLONE 1577878
MAAIHLRPLRSVAVSSARYRSLLHLLARPLSSSQSSHAYHPFPTPAAAAPNHVHHHHPTHHSQQQSAPPRNPPPLGPSPQWSPQPPPPRGYGPPPPQHPHVPPPPPRGYGPLSPGQHLPPSPHGYGPPLPPPPPPHGHGPPPPGQHVVPPLPPSHGHRPPPFVPAGGHRRPPFEGSAELPPPGPNNVPVWPLPRRPGGLSPSRNRKVTGLPTARRP

SEQ ID NO: 90015 - DNA, 771 bp, Zea mays
  misc_feature: Ceres CLONE 1577881
  misc_feature: Encodes the peptide sequence at SEQ ID NO. 90016
ctccccgcggtggcggccgctctagaactagtggatcccccgggctgcaggaattcgtctcacccctagaaaaaaccgtaccccgacccctcgacaacaatggccaccgtcctaggcagcccccgcgcgccgtccttcttcttctcgccgtcctccctccgtgccgcgccggcgcccaccgccgtggcgctgcctgcggccaaggtgggcatcatgggccgtagcgccagcagcaggggcaggctgcgcgcgcaggccacctacaacgtgaagctgatcacgccggagggggaggtggagctgcaggtgcccgacgacgtgtacatcctggaccaggccgaggaggacggcatcgacctgccctactcctgccgcgcggggtcctgctcctcctgcgccggcaaggtcgtctccggctccgtggaccagtccgaccagagctacctcgacgacggccagatcgccgccggctgggtgctcacctgccacgcctaccccacctctgacgtcgtcatcgagacgcacaaggaggaggagctcaccggcgcataatcattcatgcccatccatctctatctctgtgggtcgtcgttgtgtgtaatttgagtacgcgcgtacacgtactgcttttgtttcatttgagcactgttcgtgtaagcgtcgagttcccccctggagctgatgctgatgccctcacacacaatgccaatgccgctcaccactctcaggcctccaagaggtttcaccgattgggagcgcgtccacagtgcc

SEQ ID NO: 90016 - protein, 150 aa, Zea mays
  misc_feature: Ceres CLONE 1577881
  misc_feature (60)..(135): Pfam Name: Fer2 Pfam Description: 2Fe-2S iron-sulfur cluster binding domain
MATVLGSPRAPSFFFSPSSLRAAPAPTAVALPAAKVGIMGRSASSRGRLRAQATYNVKLITPEGEVELQVPDDVYILDQAEEDGIDLPYSCRAGSCSSCAGKVVSGSVDQSDQSYLDDGQIAAGWVLTCHAYPTSDVVIETHKEEELTGA

SEQ ID NO: 90017 - DNA, 875 bp, Zea mays
  misc_feature: Ceres CLONE 1577882
  misc_feature: SWISSPROT Homolog: EC 6.3.4.2 CTP synthase
acggtggcggccgctctagaactagtggatcccccgggctgcaggaattcgtctcacccctagaaaagagctgtcttctccccccttcccatggggctgcggtatatccccttctgcgtcctcccgcctgccgtcatgtcttcgccttcgccctagccgccggcgccggaggaataagagggccgggcgcctaccaagtacatgctaatcaccggcgggtgtcctcagcggtctcgggaagggcgtcaccaccagcaccatctgcgtcgtcctcaagggctgaaggctccccgtcacttgcatcaagatcgatccatacttgaacatctatgctggtacaatgaccccctttaagcatggcaagatgattgttcttcatcacggtggagaggttaacttcgactttggggaattataagccttgtcatacattttgctttttaccagggaaaacaaccctgcccgctgggaaaaaaaggtcccgccctggccactttgaagggagagaaaggggtttattattcttgggaaaccactgttcaaaaattatcccctccctggcccttgatggaaaaaaaaaaaaggggggaaaacccgtttgggaccccttccgaaatctccggtggaattgggaaaaatttcgcccccaaaaaaaaagttctcgttccccatttaaaatagagaaagggcccggggaatgtaaaaatttatttttccaaggcacacatcctttcaaaacctttgccgccccaattttgcccccttcccccgtgggtgaaaggggaaatattttgtgggcccccaacaaccggttagggcgtctttccccccttctttcggggcggccggtgggtgggagaaaaaaaacttatacc

SEQ ID NO: 90018 - DNA, 824 bp, Zea mays
  misc_feature: Ceres CLONE 1577883
  misc_feature: Encodes the peptide sequence at SEQ ID NO. 90019
ctccccgcggtggcggccgctctagaactagtggatcccccgggctgcaggaattcgtctcacccctagaaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcagtaatcatagtaataacgagttcccgtcgggatatggctaagcggaaggacctgaatgtgcggacccaacaaaatctcccgcaaagacaacggcgagccaaccaccaccagcgtcccgcgctagctgcggcaccgcatggctgccgtgaccagcaccgccctcatcgtgccagccgcagccggccccctctcttcgttgccgtctttcatccgcgctagcccaccagcggaaacaggagggtgcatcaaggcatcagcgacgaacggctgccactgccggttctgctccgggaacaacttcagtactcttatcgggcggcacctggtattgcggga

SEQ ID NO: 90019 - protein, 58 aa, Zea mays; identical to SEQ ID NO: 46528
  misc_feature: Ceres CLONE 1577883
  misc_feature (6)..(56): Pfam Name: UPF0057 Pfam Description: Uncharacterized protein family UPF0057

SEQ ID NO: 90020 - DNA, 790 bp, Zea mays
  misc_feature: Ceres CLONE 1577886
  misc_feature: Encodes the peptide sequence at SEQ ID NO. 90021
  misc_feature (760)..(760): n is a, c, t, g, unknown, or other
ctcaccgcggtggcggccgctctagaactagtggatcccccgggctgcaggaattcgtctcacccctagaaaaaagccggtccagcccacagtccacgaggacacgatccccgacctcatatcaggttcccctccccatcccggagagcaaaagcgcttctctcgctagcgagttcggcagtagaaaccctaaaaaaagacaccgccctccccttcgctagcggaaccgccctcccctcgccggggtaggggtttcgggggtagacgcccgccatggacgcgttccggaaacagctggacgtgctcatgggcgccaaccgcaacggcgacgtcgaggaggtgagccgcaactactacgaccgcgacgtctgccgcctcttcctcgccggtctctgcccacacgacctctttcagctcacgaaaatggatctcggtccttgttctaagattcactctcttcaactgcggaaagattatgaagaagcgaaagcaaagggaaacagaaattttgatagagaactcgaggatatgatagaaaggctcatttgtggagtgtgacaggaaatttcagagggccctaaaacggcttgcagatgatgatgccaatgctgctattgcgatatcggtctctgaaggtactctgacggatgacatactgcagctgtcaaaacagataaaggagaaaatggcagaagttgatgccctttgattttgaaggggagaactgatgaccaaataaaggccccaggaagtagtgggngaagctaagagcaaaaagagctgatatgcc

SEQ ID NO: 90021 - protein, 94 aa, Zea mays
  misc_feature: Ceres CLONE 1577886
  misc_feature (1)..(94): Pfam Name: LUC7 Pfam Description: LUC7 N_terminus
MDAFRKQLDVLMGANRNGDVEEVSRNYYDRDVCRLFLAGLCPHDLFQLTKMDLGPCSKIHSLQLRKDYEEAKAKGNRNFDRELEDMIERLICGV

SEQ ID NO: 90022 - DNA, 1144 bp, Zea mays
  misc_feature: Ceres CLONE 1577889
  misc_feature (1)..(1): n is a, c, t, g, unknown, or other
  misc_feature (12)..(12): n is a, c, t, g, unknown, or other
  misc_feature (72)..(72): n is a, c, t, g, unknown, or other
  misc_feature (73)..(73): n is a, c, t, g, unknown, or other
  misc_feature (747)..(747): n is a, c, t, g, unknown, or other
  misc_feature (897)..(897): n is a, c, t, g, unknown, or other
  misc_feature (898)..(898): n is a, c, t, g, unknown, or other
nttttttttttnttattattatgataaatgtaattaggggaggggagggggggggggggggggtgggtgggnnttttatttgggactccccgcggtggcggccgctctagaactagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcacggcaacttcggggcgggtgcacgcgggcgcggggacctgcgcacgggcccgcagcgtccgcgggtcaagggggggtggcccaaaggaccaaagctgggaagcgcgccggggccatgggccgggatccaaatatcaaggcgggggaagaattccgcccgtccatggaaaaagaatggggtgagtccccccacccccccaaaaacaattcgggtggggaaaacccttgccaacacagaaggggtgggaaatgggggccccnacacccccggggcctttcccaaaaaagagatattctttaacccctttccgggggggagctctcgggaaaaaatcctctctgtgctcccacacctggggcgggggggagagaaaatttttttttttcctttcccccggagaaattcctcanntgccacacccacccggggggcacgagagattcccccggagagagagagagaaagtggaggccgccgcgcctttgttttaaccttttccaccggagggagtgttctctttccgcgcccgcgcgggtgtccaaactctcttgtgcaccacccggcgcccagcggggggggtgtttctcccacccggaaaaaccctgggaaagctccgcgagagaaacccgggcgccccccgggaaaagaggagtaggg

SEQ ID NO: 90023 - DNA, 855 bp, Zea mays
  misc_feature: Ceres CLONE 1577891
  misc_feature: Encodes the peptide sequence at SEQ ID NO. 90024
tggagctccccgcggtggcggccgctctagaactagtggatcccccgggctgcaggaattcgtctcaccccctagaaaaacttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtccccctgatataatgatgacatattcttgaaaaaaaaacggcagtgttgccaatggactcgcgctgcccccatctgctactgctcctccctctcctcctcttgggcggcctcctggcccccgcgtcttcgggggtgcccgaagtcattctgcctgcaacaaaccgggggacggggcccttgtcctggccccccccggacccccccgggtacaacccccccgtttttggaattgttttgcacccagggaaacgggggggggcgaaaatataaaaaacaaccccggacccctcta

SEQ ID NO: 90024 - protein, 62 aa, Zea mays; identical to SEQ ID NO: 5990
  misc_feature: Ceres CLONE 1577891
  misc_feature (1)..(62): Pfam Name: TMA7 Pfam Description: Translation machinery associated TMA7

SEQ ID NO: 90025 - DNA, 869 bp, Zea mays
  misc_feature: Ceres CLONE 1577893
  misc_feature: Encodes the peptide sequence at SEQ ID NO. 90026
  misc_feature (869)..(869): n is a, c, t, g, unknown, or other
ctccccgcggtggcggccgctctagaactagtggatcccccgggctgcaggaattcgtctcacccctagaaaaaattcactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccttcggaaatccctcgaagggactggttcccctccgacttcatctttggtgccgccacttcagcgtaccaaattgaaggtgcttggaacgaagatggaaagggggaaagcaattgggatcacttctgccacaattttccggaaaggataatggacgggagcaatgcagacattggagcgaattcgtaccatatgtacaaaacggatgtcaaatggctgaaggaaatgggcatggacgcatataggttctctattctcttggcctaaaataccggccaagggaacgggtcgaagggggattatcccaggatgggatccgattactacaaaaggggtccataaacttggttgctaagaaaaatggcaaaaaaagcccaagttaaaaaatttttcccctggggaaggccccctccagccattggaaagaaaaagtaccggcgggaatatcttagaaaaataacattcataaaggagggattgttaaaaagggattacaaaaaaccctctggcgaaaagggggggcgttttgaaacaatttttttgtgttgtan

SEQ ID NO: 90026 - protein, 145 aa, Zea mays
  misc_feature: Ceres CLONE 1577893
  misc_feature: SWISSPROT Homolog: EC 3.2.1.21 Beta-glucosidase
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVKWLKEMGMDAYRFSILLA

SEQ ID NO: 90027 - DNA, 772 bp, Zea mays
  misc_feature: Ceres CLONE 1577896
  misc_feature: Encodes the peptide sequence at SEQ ID NO. 90028
ctcaccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcggggtcaccgtaccctttgcttg

SEQ ID NO: 90028 - protein, 170 aa, Zea mays; identical to SEQ ID NO: 73340
  misc_feature: Ceres CLONE 1577896
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 90029 - DNA, 1031 bp, Zea mays
  misc_feature: Ceres CLONE 1577897
  misc_feature: Encodes the peptide sequence at SEQ ID NO. 90030
  misc_feature (69)..(69): n is a, c, t, g, unknown, or other
ctgggagaagtgggtgagggataagatgaggtataagaatatggaggtgtgtcgggtgcgtgaccacantagttttttttttttaaaactggagctccccgcggtggcggccgctctagaactagtggatcccccgggctgcaggaattcgtctcacccctagaaaattcgcccgttccagcgacgcactactgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacggatgcttgattttgacttcctctgtgggagagaaacaccttctgttgctggaataatcaaatcctggtttctgaatggtttttcaaaaaaccttttcctttgggaaaaaagaaagaaaaattggctaatttcccgggttttcttccccccacaggtttggaaaaacccttgatcagtgaaagaaaggggcaacaaaccccccaagaaaaaaaggggttaaataaaactcttttctttctattattaagaagggagcttgttttgggggacgatattgtcccttcactatatcccacacttacaagaaaaaaaaagggagcggagcaaacacgaaaactactgccacatactgcaccatccactctgacgataataataaaagagtagtatagagaagacaacggcaagctatttatgttaatagagaaaaagagaggtatatactctcccaccccaccgtaataatataatacaagtggcggggggattgccgactgaaaaaaaaccaccaccaccctatttatgaataaaagaccgcccaattaaaattagaaagggggagcgcttatcaccccccgcggcccggtggaaagaaaacatcatacataaaagttgaccaacggataaaatcagcagaacgatataaagaaatggagaataacggagaaaggcagaggcagagtggta

SEQ ID NO: 90030 - protein, 53 aa, Zea mays
  misc_feature: Ceres CLONE 1577897
  misc_feature (23)..(23): Xaa is any aa, unknown, or other
WEKWVRDKMRYKNMEVCRVRDHXSFFFLKLELPAVAAALELVDPPGCRNSSHP

SEQ ID NO: 90031 - DNA, 835 bp, Zea mays
  misc_feature: Ceres CLONE 1577898
  misc_feature: Encodes the peptide sequence at SEQ ID NO. 90032
  misc_feature (819)..(819): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (826)..(826): n is a, c, t, g, unknown, or other
  misc_feature (833)..(833): n is a, c, t, g, unknown, or other
  misc_feature (835)..(835): n is a, c, t, g, unknown, or other
tccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaagtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccggggcagcgactagaccgcgcccagccggccgcccccccgccgggctagctatagctcctggcgtgagcttataagctagctagtgccatgccgtcgtctctgttcgttccgttttgcttccggggtcaccgtaccctttggcttggctggggttccctccttcccttgttccctttatttacncnnnccnttggccncn

SEQ ID NO: 90032 - protein, 182 aa, Zea mays
  misc_feature: Ceres CLONE 1577898
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWIPCLEFSKVGFVYRENSTSPCYYDGRYWTMWKLPMFGCNDATQVYKELQEAIKSYPDAFHRVIGFDNIKQTQCVSFIAYKPPGQRLDRAQPAAPPPG

SEQ ID NO: 90033 - DNA, 1129 bp, Zea mays
  misc_feature: Ceres CLONE 1577904
  misc_feature (74)..(74): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (723)..(723): n is a, c, t, g, unknown, or other
aacattttttagggtagtaaggccgtttgtgggcgtcatatatttatggagatcgtgcttgccccggcccgcgnggnnnntttatatgggaaaagtgggactcaccacggtggcggccgctctagaactagtggatcccccgggctgcaggaattcgtctcacccctagaaaaagtctgagctcgccagaaaagaccctgacagtccgacacccgcaagccacaaagtgcagcctcggttgctacaggaatgctcgagaaatgtctgaccttggccggaaagcgcaacctgcgccagtggccgcaacctgccacccgcaagcacgtcgaaggaacgggtagggttcatccgggcctccgtccgcccggggtttttcagggtaaaaagtcaaggttcagggccccaactctcttgttccaaaaaaaaggggaaaaaatttcaaaaaaaaaaaaaaagaaaggtgggctggggcaaaggggaagaaatgccaaagggcgcgccgaacagggaaaaaaaaaccttttttttccggggggggggatcccaaaacctggggggggcgggggtgttttgggtggccaccggggaaaactttttgggggggggggggtttccccccgcggtgccggggggggaaaattgttggacttaggggggggcgcctaaaataggcgcccccccccccaacaagggggggggggggtggcgacacagagaggaaanaaaaaattctgtgaagacccccccccgccggtggagttatttgttgtgcgtttttctctcttattaatttcacgagggggggggggaatagtaatccctccccccctcccttctataagagaagaggggggggccccgcgcccccccccccccccactaaaaaaaaatattctgggagaaacactctccccacccagaggtgggattggggggtgcgaattcacccccgcgcggcgcacaaaaaagaaaataaataatctcgcctggaggggagaaaataaaaaagcttcgctccccggggggggggggggagggggagagcgcccttccttctccccccacacaatattccaccccccccccccctccgtagggtgtgaggttctcgggcaggatagaaaaaaat

SEQ ID NO: 90034 - DNA, 822 bp, Zea mays
  misc_feature: Ceres CLONE 1577908
  misc_feature: Encodes the peptide sequence at SEQ ID NO. 90035
ctccccgcggtggcggccgctctagaactagtggatcccccgggctgcaggaattcgtctcacccctagaaaaaagcgtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgctctgttcactgcactctttagcactgtgtccttcttgcttggagccatcacctctctggtctctggtttccttggcatgaagattgccacatatgcgaatgccagaactaccctggaagctaggaaaggtgttggcaaggcttttatcactgcttttcgctctggcgctgttatgggttttctgcttgcatcaagtgaacttgtggttctgtacatcccaataaaggtatttagttggtattacggggaataacgggagggta

SEQ ID NO: 90035 - protein, 214 aa, Zea mays
  misc_feature: Ceres CLONE 1577908
  misc_feature (6)..(215): Pfam Name: H_PPase Pfam Description: Inorganic H+ pyrophosphatase
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGAITSLVSGFLGMKIATYANARTTLEARKGVGKAFITAFRSGAVMGFLLASSELVVLYIPIKVFSWYYGE

SEQ ID NO: 90036 - DNA, 1016 bp, Zea mays
  misc_feature: Ceres CLONE 1577911
  misc_feature: Encodes the peptide sequence at SEQ ID NO. 90037
aaatgggggaagaggagagggggtagaaaaaaaaaaaaagggggcgcgggaagaagagtgttggctctttttttaaactggtactccccgcggtggcggccgctctagaactagtggatcccccgggctgcaggaattcgtctcacccctagaaaaagttgctgttttattcgggtacagaacacccattggtttggatttggaagccatcaccacctataataaattgcacgagatttgccgcgagaccgcatctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagcttcttcccggcgatgaccaaaatcgtcgggacgctcggccccaagtcggggctccgtcgaaaaccttctccctccttgcctcaagggccaggcatgttccggtacgcgcggttacgaattttctccgggggggagaacgccccgccttatcaaaccgaggaagtacgccttctggaaaaacactccaaggctttcggccattcaaagtcccatcccaaagaaagcctggtggcggcctgttttatgccatttgaaaacggggtttgagaacccggaaaacgttgcaagggttgggttcaaacaaagaagttgaaaaacccccccaaatcatcccccttgaaagaaaaaaaaaggggggaatgattcatgtgaccccaaccggcccccaaattaaaggggtcccaaagaaaagtacgttacattccaaaacttttgggttgtgcaccaaatctaaaatctttcctgaatggggaaatcctccccc

SEQ ID NO: 90037 - protein, 112 aa, Zea mays
  misc_feature: Ceres CLONE 1577911
MHSTNLLLEEPIRMASILEPSKTSFFPAMTKIVGTLGPKSGLRRKPSPSLPQGPGMFRYARLRIFSGGENAPPYQTEEVRLLEKHSKAFGHSKSHPKESLVAACFMPFENGV

SEQ ID NO: 90038 - DNA, 779 bp, Zea mays
  misc_feature: Ceres CLONE 1577912
  misc_feature: Encodes the peptide sequence at SEQ ID NO. 90039
  misc_feature (632)..(632): n is a, c, t, g, unknown, or other
  misc_feature (679)..(679): n is a, c, t, g, unknown, or other
  misc_feature (763)..(763): n is a, c, t, g, unknown, or other
ctggagctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctccctcatggttctcatcaagatgcgtgagatcgctgaagcttaccttggcagcacgatcaagaatgctngtgtcacggtccctgcctacttcaacgactcacagaggcaggccacntaagatgctgggggtgattgctggcctcaatgtgctgttatcatcaatgagccaaccgctgctgctattgcctatggtcttgancagaaggcaaccagcg

SEQ ID NO: 90039 - protein, 162 aa, Zea mays
  misc_feature: Ceres CLONE 1577912
  misc_feature (9)..(163): Pfam Name: HSP70 Pfam Description: Hsp70 protein
  misc_feature (147)..(147): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAAEEISLMVLIKMREIAEAYLGSTIKNAXVTVPAYFNDSQRQAT

SEQ ID NO: 90040 - DNA, 926 bp, Zea mays
  misc_feature: Ceres CLONE 1577914
  misc_feature: Encodes the peptide sequence at SEQ ID NO. 90041
ctccccgcggtggcggccgctctagaactagtggatcccccgggctgcaggaattcgtctcacccctagaaaaagcttccactacaacagcatcatcgatcgccgagcgtgcgtgctctagctctagcaatagcagcgaggagacggtcgaggatggatcagaacaacagcaacaggcagcagcagcaggcgccgccgccaccacccgcgggctacccgacggcaggcgcggagcagcagggaggcagcggcaggaagcagggacgccgggggaagacgacctcgcgcggggagaagggcttcatcgaaggatgcatcgcggcgctctgctgctgctggatctgcgagatgtgctgcgactaggcagcccccccttccctccgccggcagggttttgagcctttgacaggaacggagagatctgctcccacccatacctgcaatttgtggctgcacctaacttgttgaaactggtggtgtttgtggtccattcccgggaacctttttgaatttggttatttaagaaaaaacctggtaataaaacaaatccagggggcgggcctttgttcttttggggcaggtcctaaggatatttaaccccgccccaagctaaagcggggggggggggtgggaaaccccttttttaattttggggggggggaaaccttaaagagggggcccccgggggaaatttaaaaacacccctcctaataatagggcaaaaaccccctggggggcccccaaaataacacaaaagtgggataaaactccctcccccgaaagaaaaacggaaaaaaaggcgcccccccccacagttggggccacgggtgtttttttctccctcccaaggggtttttaaatgcccttcacgaaaaagtctccccgcaagaaacgggggggggagggagaaaaaaaaaaaccccccg

SEQ ID NO: 90041 - protein, 69 aa, Zea mays
  misc_feature: Ceres CLONE 1577914
MDQNNSNRQQQQAPPPPPAGYPTAGAEQQGGSGRKQGRRGKTTSRGEKGFIEGCIAALCCCWICEMCCD

SEQ ID NO: 90042 - DNA, 865 bp, Zea mays
  misc_feature: Ceres CLONE 1577917
  misc_feature: Encodes the peptide sequence at SEQ ID NO. 90043
  misc_feature (389)..(389): n is a, c, t, g, unknown, or other
  misc_feature (865)..(865): n is a, c, t, g, unknown, or other
ggcggccgctctagaactagtggatcccccgggctgcaggaattcgtctcacccctagaaaaaacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcgggcagccaagggaactatgggctcgagggctggctccaaanccaaaactggctcatcgcccatgagctgccctccccgtcaccggaaaccgaaccccaaggccgtattttgatctggaaacggcctacaagggacccggaataaattgggggcttggggcttttgggggcgcgggccctgggggccctgaaaaccccaattattggtgggcccaaaaaaagggaaaaaaagaaaattttggcaaaatcagcccccccgaaacgggtttaaaaaaaaaactgggggggccacaaaaaaagtgcgccaaaaaaaaaaaaaaaaacccccttttgcccccccaaaaaaaaaattttttaaagaaccgggggttttttcgggagattcccgccgggcccaaaaaagtttttttctcccccccgaggaattaaaaaaggggggagccccctcttttttttttttaaaaagagggggcgcgggaaaataaaatcaacggaaaaaaatttttctgaggaaaaan

SEQ ID NO: 90043 - protein, 75 aa, Zea mays
  misc_feature: Ceres CLONE 1577917
  misc_feature: SWISSPROT Homolog: EC 4.1.1.19 Arginine decarboxylase
  misc_feature (68)..(68): Xaa is any aa, unknown, or other
MILRFPDVLKNRIETLHNAFNSAMESTGYTSRYQGVFPIKVNQNKHVVQDMVRFGQPRELWARGLAPXPKLAHRP

SEQ ID NO: 90044 - DNA, 770 bp, Zea mays
  misc_feature: Ceres CLONE 1577918
  misc_feature: Translation starting site: 251
  misc_feature: SWISSPROT Homolog: EC 3.2.1.4 Cellulase
  misc_feature (545)..(545): n is a, c, t, g, unknown, or other
tcaccgcggtggcggccgctctagaactagtggatcccccgggctgcaggaattcgtctcacccctagaaaaagcctgtccctccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcagcagagctggctcctggccgggcccggcgaccaggcgggcaagaagaagaagaggtacgtcgacctgggctgcgtcgtcgtcgaccgcaagatcttcatgtggaccgtcggcaccatcctcggcctcggcgtcttcatcggcttcatcatgatgatcgtcaagctcgtcccgnaaaagcgcccgcggcggccgcggcccgacagtacacgcaggcgctgcacaaggcgctcatgttcttcaacgcgcagcgatcccggtccgctgccgaaacacaacggcgtcagcctggagggggcaatccctgcatgaaagatgggccttctccgaaagcaccccgtcggcccggagctttggtccggaaggctcctaccaatgccgggggaacgccctcccaggt

SEQ ID NO: 90045 - DNA, 841 bp, Zea mays
  misc_feature: Ceres CLONE 1577922
caccgcggtggcggccgctctagaactagtggatcccccgggctgcaggaattcgtctcacccctagaaaaaattcccttccttccttgctcctcccctgcctcgcctctctctctcccctctcctcgcctccagctcctgctcggcccgctcgcgtcgagctgcgcgcgcgcctgcggtggccgtgaaggacagcccgagggacgcgccgggtgcactgatctgggggccgcgtgtccccggtggtggggcgaggcggcgccggcttccaggaatgggcaacttgtagcgtcggtttcttttgcatatgcactttctattgttgttgtcatttccaaggaggccatagtctcctggattttgtatgccttgttatctggaattggtgaccatacaccccattccgtagcatagtccgtgatgttagggatggctttggcagcttgtcgaggagaagctttgaggtgaccctcgcaagcatttatggccggaccgggcatcacaaaaggaagaccccgagctcatcccatgttctcaacgactcaacgttcattattcgtggaaagtcgatggggcgaagctacctcctgaaactccttccgggatatcactccggagaacggcagggctgatgaagagcccctgggccagcggccggaagcaacgtgcgtttgcctttcgcgggctgtttttggggggaaccttggaaaaggaaaaggttgttaaagaagaaattggggttggaggcccccagaagtttcctggtgggcaaagcctttacccccttcccccgggggtggccctccaaaaaaagaagcttggggcacccccgcaagaaagg

SEQ ID NO: 90046 - DNA, 836 bp, Zea mays
  misc_feature: Ceres CLONE 1577923
  misc_feature: Encodes the peptide sequence at SEQ ID NO. 90047
ggagctccccgcggtggcggccgctctagaactagtggatcccccgggctgcaggaattcgtctcacccctagaaaaaaaccaaccctccttggctggactggacccccaacccaacaacagcagcaggaacaggaaaaagaaaaaactctctcccattcccatctcgcctcccacctcctccgcctcgccgccgcggcaggcaccgccaccaatcttctcttccgccccctcgttcgttcgctcgctcgctcgccaggagatcgactcgaggcgaggccatgaagtacgtgctggtgaccggcggcgtggtgagcgggctcgggaagggcgtgacggccagcagcatcggcgtcgtgctcaaggcctgcggcctccgcgtcacgtctatcaagatccacccacacctcaacaccgatgccggaaccatgtccccattcgagcacggcgaagtgtttgttttggacgatggtggtgaggtggacttggaccttggaaactatgagagatttctggacgtcaagttgactcgtgacaacaacataaccacgggggaaatataccagtctgttattgacaaggaaactaaaggagatacccaggaaaaactggtccaggcccggccccccatccgggaatgaaattcaagatttggattcaaccgggggggaaatgaaatccggttgagagaacacccaaagaacccccccggaatttttggtgcccaaaaaaaatttggggaggagaatcttggggggaaaaaggggaaatccaccggcccttttcatataaaaacacaatagggcgccaatttttttctaaccccggtgagaggct

SEQ ID NO: 90047 - protein, 119 aa, Zea mays
  misc_feature: Ceres CLONE 1577923
  misc_feature (1)..(120): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTSIKIHPHLNTDAGTMSPFEHGEVFVLDDGGEVDLDLGNYERFLDVKLTRDNNITTGEIYQSVIDKETKGDTQEKLVQARPPIRE

SEQ ID NO: 90048 - DNA, 941 bp, Zea mays
  misc_feature: Ceres CLONE 1577927
  misc_feature: Translation starting site: 161
  misc_feature: Pfam Name: EPSP_synthase Pfam Description: EPSP synthase (3-phosphoshikimate 1-carboxyvinyltransferase)
  misc_feature: SWISSPROT Homolog: EC 2.5.1.19 3-phosphoshikimate 1-carboxyvinyltransferase
  misc_feature (854)..(854): n is a, c, t, g, unknown, or other
ccccgcggtggcggccgctctagaactagtggatcccccgggctgcaggaattcgtctcacccctagaaaaaagtccagtccacgccaccaaccgcgaggcgaaccaaaccaaccccctctccccaatcccgcgcgccctaccaaccatcggcgtcggcaatggcggccatggcgaccaaggccgccgcgggcaccgtgtcgctggacctcgccgcgccgtcgcgccgccaccaccgcccgagctcggcgcgcccgcccgtccgccccgccgtccgcggtctgcgggcgcctgggcgccgcgtgatcgccgcgccggcggcggcggcagcggcggcggcggtgcaggctggtgccgaggagatcgtgctgcagcccatcaaggagatctccggcaccgtcaagctgccgggggtccaagtcgctttccaacaggatcctcctgctcgccgccccctgtccgaggggacaacagtggttgataacctgtttgaacagtgaggatgtccactacatgcctcgggggcccttgaggactcttgggtcttctctggtcgaaagcggacaaaaagcttgcccaaaaaaagacttaagtttgttgggctggtgggggaaaagtttcccccagtttggagggatggctaaaaagagggaaaagtggcagcctcttttccttggggggaatggttgggaaacttgcaattggcgggccatttggaacaaccaaccctggttaactggctggcctgggggggaaaaaatgcaaactttaacctggctttggaatgggaattaccccaaaaaaatggaggggagaaaaaacccccctttggggcaaaaatttgggttttgctcnggaaatataaaaaacacacctctgggggggccacaaaattattgaaaaatgtgttctccccctgggggagacccgtagacttggccc

SEQ ID NO: 90049 - DNA, 777 bp, Zea mays
  misc_feature: Ceres CLONE 1577928
  misc_feature: Encodes the peptide sequence at SEQ ID NO. 90050
ctggagctccccgcggtggcggccgctctagaactagtggatcccccgggctgcaggaattcgtctcacccctagaaaaaaccgcatacggctagagcccagaagccttatcccatcgtgtgctcccctcctctgcctccatggccatcggcccttcctttgaggtcgcacctctgctcatcctcactactccccagagcccgccggtggccgccgctccaagtcccctactcgccaccgcctattgttgcctcctctgcctccgatctgtggcgccgtcgtgggctcgccccagcccggtagccgtcagttgtcatcgccctgcccctctgcacactggtgccctctctcgtagctcaccccgtcaaccgtgcccggtgctcctccaccaagcctcgctagggtgctcttcatggtgcgcctctggtcctctgctcgccgtgaagctctatctgctccagttcgagtccctgtctacttgcccaaatctccgacctcgcccctccatggagctcgctccggactccagctccccttagctccctctgccagatcggccatggtgagtccctttccgcgttcccctacgcgtgcggtgggtgtgtctcccagccgtcagctcggctccaacagcatgtacaccgaccaccgcttctctccaagccacgggatctgcgctcacctcggcatcgaactcgtcgtcatcctccaatttcagcaactctgccccagccctactcgacctcgctgaacactcatggttgaagacaccccggc

SEQ ID NO: 90050 - protein, 132 aa, Zea mays
  misc_feature: Ceres CLONE 1577928
MAIGPSFEVAPLLILTTPQSPPVAAAPSPLLATAYCCLLCLRSVAPSWARPSPVAVSCHRPAPLHTGALSRSSPRQPCPVLLHQASLGCSSWCASGPLLAVKLYLLQFESLSTCPNLRPRPSMELAPDSSSP

SEQ ID NO: 90051 - DNA, 851 bp, Zea mays
  misc_feature: Ceres CLONE 1577932
  misc_feature: Encodes the peptide sequence at SEQ ID NO. 90052
acccgcggtggcggccgctctagaactagtggatcccccgggctgcaggaattcgtctcacccctagaaaaaatctcttctccccccttcccaatcgggctgcggcatatccccttctccgtcctcccgcctgccgccatgtcttcgccttcgccctcgccgccggcgccggcggaagaggagggccgggcgccgaccaagtacgtgctgatcaccggcggcgtcgtcagcggcctcggcaagggcgtcaccgccagcagcatcggcgtcgtcctcaaggcctgcgggctccgcgtcacttgcatcaagatcgatccatacttgaacacagatgctggtacaatgtccccctttgagcatggcgaggtgtttgttcttgatgatggtggagaggttgacttggatttggggaattatgagcgtttcatagatgttactctgacaaaggattacaacattaccactgggtagatataccagtctggtcattgagaaggagagaaggggtgattatcttggaaaaaactggacagggttattcctccaggtccctgaggaaaataaaacagtgggatacagtccagtgtccttcggttccctgtgggaggggcagaactcctcccggctgatgtttggtgttattgaaattggggaggcactggtaggggaatttttgagtcgatgccctttgatttgaaagctttgggcccatttatcctttttcctcttgggcagggaaaatttccgggccccatatccccgtttgcgcttgtttccaatatttggggattgtaggttgggtggagcagaaaacattaaaccagccccaaccttggtggtccgaggaaccg

SEQ ID NO: 90052 - protein, 110 aa, Zea mays
  misc_feature: Ceres CLONE 1577932
  misc_feature (20)..(110): Pfam Name: CTP_synth_N Pfam Description: CTP synthase N-terminus
  misc_feature: SWISSPROT Homolog: EC 6.3.4.2 CTP synthase
MSSPSPSPPAPAEEEGRAPTKYVLITGGVVSGLGKGVTASSIGVVLKACGLRVTCIKIDPYLNTDAGTMSPFEHGEVFVLDDGGEVDLDLGNYERFIDVTLTKDYNITTG

SEQ ID NO: 90053 - DNA, 1269 bp, Zea mays
  misc_feature: Ceres CLONE 1577934
  misc_feature (60)..(60): n is a, c, t, g, unknown, or other
  misc_feature (62)..(62): n is a, c, t, g, unknown, or other
  misc_feature (71)..(71): n is a, c, t, g, unknown, or other
  misc_feature (72)..(72): n is a, c, t, g, unknown, or other
aaagtaatagagggtggggtctactggatgtgttgaccttcaaattccgatgaggcgccntnttataatannaaaaagctgggactccccgcggtggcggccgctgtgcagcgcgcatggggcagttcctcggctagaagcgtacgacaaggccgcgatcaatgcaacggtagagaggccgtgacgaacttcgagcccagcacgtacgacggggagctgctgctgactgctgaagctagcgcagaagttgctgactacgttgatctgaacttgagcatctcgcaaccggcatcgtcccagagccccaaaagagacaagaactgccttggtccgcagctccaccaccaccatgggcggccgtttgacggctccgccggttctgaagaaaaccagatcgatgctccgtctgagctgtcgtcggcgggccgccctcaccggtcattcctccctcatcacgtggctgccgagcatctaccgcccccccctcaccccttctttataagacagccatgagaagggaagcattcaagaaaaagatcccagcctggggcaatcagcaagcaggcctggggaaaggtggaccgccaaggttgaaactttccctccctcccgtaacaaacaacccctttgttttgccgcttttccgcgcttggcgccgaagaaaaacatatggtgcaacgccgtgggaagggatactcttggtagagggagatttcgttccccgcaaataaagcgcgggggcgacatataaaaagagaattgtagggctgcgatactaaagagcccccccctatatgtgtgggggggggggggcctgttatgtttcattcttccgccctcgcgcgagggtggtgtgtttgagagaaattgcgcgggggcgagtaataaaagagtgaaggtatgagccgcacggagtagacacctcctcgcaccttcccacgagggaaggtccgatatgtttgtagaacacgcgacactcgttaacgctcaatgtggagtgggtggtggggagaacgagggggaggagacaaagcacgcgcaccaccccgggatgaaaatatcctccgccacgggaaaacaaaacagagctgggggaagggaagtaaaatatagaaagtgcgagacctgcccctctacgtgggggggggaggggcagagaaaatttttgttctctacacacgatgagtgtttatgaccacccaccacgaggcggaggtgggggttggcagttacaaacaggtacgtctgcctcacaacgaggggatgggg

SEQ ID NO: 90054 - DNA, 786 bp, Zea mays
  misc_feature: Ceres CLONE 1577936
  misc_feature: Encodes the peptide sequence at SEQ ID NO. 90055
  misc_feature (768)..(768): n is a, c, t, g, unknown, or other
ctccccgcggtggcggccgctctagaactagtggatcccccgggctgcaggaattcgtctcacccctagaaaaaactctgactctcatctgaagcgcgcgagagaaacgcgtatacccaggcggcggttgaggaagaggaggagaagaagaagaagatggcttcctccgcatacgcctcatggtccaagcggtggatccgtcccgaggtgtacccgctgttcgtgccgatggccgtggccttgggcatctgctcgtaccagcttgtgcgcaacatcacgggcaaccccgaggtgcgggtgaccaaggagaagagggcggccggcgtcctggacaaccacgacgagggcgagaggtacgctatgcacggcctcaggaagttcgtccgcgggaagaagcccgagatcatggcctccatcaactccttcttcgccgaccctcccaaggacgattaagctagattccgtcatggatggatggatgggatggattcccgattcccgatcgtccatagtatgttttaccattcattagctgccggcggcgcgccttgattcgtagccgtcgtcggtacattttttttttggttctaaaattctaattctcccatataaatgggacatcatgcattttgtcgtgttaaaaagagtcacttcggcacgaaccaaaagcgcatccgatctcgctgtcgtcactcctccgtcacccaggccccgaacagaagcaccaccccagcatgggccctgcaagcgggggctcctcccattcanccctcttcatccggtccc

SEQ ID NO: 90055 - protein, 98 aa, Zea mays; identical to SEQ ID NO: 57637
  misc_feature: Ceres CLONE 1577936
  misc_feature (10)..(96): Pfam Name: B12D Pfam Description: B12D protein

SEQ ID NO: 90056 - DNA, 827 bp, Zea mays
  misc_feature: Ceres CLONE 1577937
  misc_feature: Encodes the peptide sequence at SEQ ID NO. 90057
cgctctagaactagtggatcccccgggctgcaggaattcgtctcacccctagaaaaaaatctcaccccacgcctgccccgagctccaaccctaaaggaacacacccctgcttgcggcggcggggagcggtcttgggcgtccgccgttgctgtggcccagccgtgacagatccgggccccgcgccgttaggtcggtgtttcttcggcgacggtgcagccgctggatgttagtctggcggatcggggcccgttgttcgcgtgattcgagctaggcggtgttgagttgtaacatttgtatcacatgaatgaactcagagcatctcagtgttaaagctgtgagcatatcaattcccctcctttaagcaatatgggagctaattgctccacttgctgcaaaggagaggacacaaccatgcattactccattagaagtatcagcgtacaggaatgtgagacattcaccatcatgggagctttcggtgggacaatcgcacacatatggaagacataatggaaatccctactctgttctccaccatagtagtgggaagcattcggcctgatacaaagaagtgggttccattgccccaactgaaggggttttctaatggaaatagcctttggaaccttaccccttccaatggggctgccgggaaacaaatggccccaaatctgaacaaaagaatggaaggcttctaagggttccaaagggctgatccttcggggctgacccaccccatctggcaaggaaacttcttccccttggaaggcgaaaagctttcccagggaaaatcgcctggggaaatgggtcaaggtggttggcttgta

SEQ ID NO: 90057 - protein, 66 aa, Zea mays
  misc_feature: Ceres CLONE 1577937
MEDIMEIPTLFSTIVVGSIRPDTKKWVPLPQLKGFSNGNSLWNLTPSNGAAGKQMAPNLNKRMEGF

SEQ ID NO: 90058 - DNA, 841 bp, Zea mays
  misc_feature: Ceres CLONE 1577941
  misc_feature: Encodes the peptide sequence at SEQ ID NO. 90059
  misc_feature (500)..(500): n is a, c, t, g, unknown, or other
ctccccgcggtggcggccgctctagaactagtggatcccccgggctgcaggaattcgtctcacccctagaaaaagttcgtcccctgcgcctttttttcttcttctctgccaccccgcaccccgcaccccggtaataaaagttgaatttctcctcgcgttacagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcatcgtgctctgcgccttctccttctacctgggaggcatctacagcacgggacggagcctgctggactccatccagccggcgccgacggctctcctcgccctcggcgccgccacgacgactcgccgtccctccgacgacagccaggctcggccggcactggcgtccacggccgccgtggcgttccccgagtgccccctgcgactacangactacagcccctgcaccgaccccaagcgctggcggatgtactgcaactaccgcctcagcttcatggagcggcactgacccgcgcccgccggacgggaagcattgcctggtgccccccgcccaaagggttacaaggccggcaatccgggtggccccaagaacaaaggacccattggctgggtccgggaaacgtccccctcccaactgggttccacccccccgaaaagttccacccaacccttggggttcggtaaagaggaaaggcgaaacccgctttccggggtttcccccggggggggcggggacccaggggtttccccacaaccgaggggtgtgtggcg

SEQ ID NO: 90059 - protein, 122 aa, Zea mays
  misc_feature: Ceres CLONE 1577941
  misc_feature (97)..(97): Xaa is any aa, unknown, or other
MKYSKEDKPERAGGAGAGSRAVPVALVVIVLCAFSFYLGGIYSTGRSLLDSIQPAPTALLALGAATTTRRPSDDSQARPALASTAAVAFPECPLRLXDYSPCTDPKRWRMYCNYRLSFMERH

SEQ ID NO: 90060 - DNA, 864 bp, Zea mays
  misc_feature: Ceres CLONE 1577944
  misc_feature: Encodes the peptide sequence at SEQ ID NO. 90061
gcggtggcggccgctctagaactagtggatcccccgggctgcaggaattcgtctcacccctagaaaaactagaaaaaaaaaaagtgcaccgtgttctgcctccaacgtcctctcgcccacgcgctccgtcaatcacgcaagttatgccaccgatgtcgcccgaccgccccatccgcattgcccccacccccgtccgccgctagatgcggatcccgccgcttccagcatccagccaagcccgtgagccgcacgccgctcctgctcccgctccgagcgccttaggtcaggcggcgttggcccgacggcggggggaggcatcacgctgccatccatgggggcgcccccggcgccgctgcatccgacgcccacctctcccacggggcgcccgcaccaccaccaactacctcttctccatcaagcagctcaacacgctgggcgccggcggccgtgctcgccttctccaccacggtcccgctctcggagacggccttcgcggggctcctcccccctacctcctcgtcctcgccggggtggccttccgcaacggccaaggccgtcgaaaaaccggatcccgcctctacccctcgggaaccatcgtaaggggtcttcaagggccaaaagggccccaaaccccccccccgaaaaaaaaggggaccccccttccgctcggggggggtggggggcccccctaaccctttaaatttcctcccccaccggggggcccctttcccaaggcccaaggaaaaagggccccccccctttctaaaggggggggcctgggaaaaacatttgggcccaagaccccccccctggaaaaaggggaaaaaaacaaccccctttttattttcttttggccccaaaacc

SEQ ID NO: 90061 - protein, 162 aa, Zea mays
  misc_feature: Ceres CLONE 1577944
MRIPPLPASSQAREPHAAPAPAPSALGQAALARRRGEASRCHPWGRPRRRCIRRPPLPRGARTTTNYLFSIKQLNTLGAGGRARLLHHGPALGDGLRGAPPPYLLVLAGVAFRNGQGRRKTGSRLYPSGTIVRGLQGPKGPQTPPPKKKGTPLPLGGGGGPP

SEQ ID NO: 90062 - DNA, 1023 bp, Zea mays
  misc_feature: Ceres CLONE 1577947
ccccgcggtggcggccgctctagaactagtggatcccccgggctgcaggaattcgtctcacccctagaaaaaagcgacgaagtccactgccgagttgccgactcaccgactcccctcgcaagtcgcaatctcaactctccttattccaaactgccgatcctcaccgatgatgggaagaatagctaaggaaagttcgcagtggtggcattgagccaagcattaggaccgaagtttggcccttcttactaggagtctatgatttgaatagctctgaagaggaaaggaactctgttaagataaagaaaaggaaagagtatgaaaagctgaggaggcagtgccaacaaattctgaatggctacaagggaaattcgttgaacgcaataactgaagttaataatgagggcgtgttccagtttacaaaggaactgcctgatggggtcagaatcacctttgtttttgaagatgccagtggctaatacttgcttcctgttttccctccgagggagcctgaagccctggaacaggaatgaaattttgaaccaaccccgtaaaaaaaattccccctgttgcctgggtgggtttgaatgggggtttgagaggaaagattggcggaaaggaaattttaggcccatattgccatgtttcccctttgcactttagtcagtgaagttctaggatatccgttggggggatttcccgggaaactcatccccctatatgaggggattgaaaccccctgataaaagggaatggccccggtggctccccggtgcgaagggaaaacaacctggtggttctccccaaatatccccgtatagattttagattgaaggggaggcgactctctcctttttcataatggcaaacattcgttgtttgtgtaggaggctatagggcgtgaatacccccacagaaaggaaaattattgggcccatgaatggggtatcagcatacattttatgatagtggattgggagagccccactgtccggtggttgcacaaaacggtggggagagggggaa

SEQ ID NO: 90063 - DNA, 809 bp, Zea mays
  misc_feature: Ceres CLONE 1577948
  misc_feature: Encodes the peptide sequence at SEQ ID NO. 90064
ggagctcaccgcggtggcggccgctctagaactagtggatcccccgggctgcaggaattcgtctcacccctagaaaaaagcccactccagcgctgaaggcctgcagcgccagcgcagcgcctctctgctactgtgctggctgacgccggtggggtgtgagccaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggcccctccatctgggattcattcgcgcacgtcccaggaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaagggaaagtcaatccagaaagtgtagcgtattacaataatttgataaactatctgcttcagcaaggcatgactccttacatcaacctttaccactatgatcttcctcttgcggctgaagagaaatatggagggtggtttaacgccaagaatggcggatttgttacagactatgctgacctctgttttaagactacggcgatcgcctaaaccacgggtttt

SEQ ID NO: 90064 - protein, 192 aa, Zea mays
  misc_feature: Ceres CLONE 1577948
  misc_feature (36)..(193): Pfam Name: Glyco_hydro_1 Pfam Description: Glycosyl hydrolase family 1
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPESVAYYNNLINYLLQQGMTPYINLYHYDLPLAAEEKYGGWFNAKNGGFVTDYADLCFKTTAIA

SEQ ID NO: 90065 - DNA, 1071 bp, Zea mays
  misc_feature: Ceres CLONE 1577949
  misc_feature (12)..(12): n is a, c, t, g, unknown, or other
  misc_feature (13)..(13): n is a, c, t, g, unknown, or other
  misc_feature (58)..(58): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
tttttttttttnnttttttttctttattttggggaagcacagagacagagaggggttntgttnnnnnaggggnnnngggaaaactggagctcaccgcggtggcggccgctctagaactagtggatcccccgggctgcaggaattcgtctcacccctagaaaaaagcgaagaggagacgacgactgctctgcctttcttccctacaggaacaggacgaatctatcaatcattcccctctgcagccgccggccctcagcaagcaagcaagggacagacgcggcggggatgggcagcggggtccgggcgctgatgcgccggaagcaggtagactcctagcggacgcgcgccgccggcagcgcccaccagctccgcaaggagctctccgtcacccagctcgtcgccatcagtgttgggtcgacgattggagctggcgtctacgtccttgttggcacagttgcaccggagcattccggggccggcattgacgctttcatttctgattgccctgaatagcagctgcgactttcaggccttcctgctatgcaggagcttggcttacccgtttgccccttacggcaaagaaaccgccctatccattgattgcggtaccatcttggcccttgggggaaaagggaacttggccaatgggtctggaatttgggcttgggggcctttttgaataccgttgggaaaataccaccgaaactgtgtgtgggggaattcacaggctccgtttttgcccccctgttggggaagtattttgcaacccccttaaactccttaagccaccgtttatttattgtttttgtagcaagggaaccccgggtattatgcttgctgggccccgtgtgggaatctcttttagcccacccataccattggaggaatatcccccctgggagccctggaaattcgccaatcctaataacatatcacccttgtggccccttcccttatcccacctcgtttttttctcaccgcctcacaaataagcacactttaccacgggggggggggaggatataaaaaaagaatagtatttcccacttttggtgccaacacgaagttttg

SEQ ID NO: 90066 - DNA, 827 bp, Zea mays
  misc_feature: Ceres CLONE 1577950
  misc_feature: Encodes the peptide sequence at SEQ ID NO. 90067
  misc_feature (662)..(662): n is a, c, t, g, unknown, or other
  misc_feature (778)..(778): n is a, c, t, g, unknown, or other
  misc_feature (789)..(789): n is a, c, t, g, unknown, or other
ctccccgcggtggcggccgctctagaactagtggatcccccgggctgcaggaattcgtctcacccctagaaaaaataatgcccagtgcggcagtgcctgccaccgtctaagcccaccccaagtctccgccgtcaacccgtcctccccatggccgccgccgccgccatctctctatccttccactttcgtttccgcccgccccttccatctccacgtacccccacgcgccacgctcccttttccttgttctccccttcccttcttgccccctgccgcctccgcgtcgctcccggccgcccctcaccgtccccgtggcgccccgacgtgcgggcgcgcgctggaagcaccatcggggcgccgcctgcgcttgtgcgcccaggcggagccgtggagacggaccgcctcccctccgacgtgcgggaccgggccatggaggcggtcgaccacttcggcggtcgcgtcaccataggagacgtcgcttctcgcgctgggctgcagctcgcgcaggcggagcgcgcgctccaagcactcgccgccgacactgaaggcttcctggaggtatcggaggacggggaggtgctatacgtcttcccaaaggactacagggcaaagctggctggcaaatcgtttaggatgcgggtcgaagcctctggttgacaaangcaagcaagtgggtggctattctggtacgtgtttcatttggcactgcgctcattgcctcaatttgtgctggtgtacactacaatcattgccattctctcaagctcaagtagtgatnaaaaatggtcntgggaggccgccgaaaatcttatggttctactatcata

SEQ ID NO: 90067 - protein, 75 aa, Zea mays
  misc_feature: Ceres CLONE 1577950
MEAVDHFGGRVTIGDVASRAGLQLAQAERALQALAADTEGFLEVSEDGEVLYVFPKDYRAKLAGKSFRMRVEASG

SEQ ID NO: 90068 - DNA, 863 bp, Zea mays
  misc_feature: Ceres CLONE 1577951
  misc_feature (564)..(564): n is a, c, t, g, unknown, or other
  misc_feature (658)..(658): n is a, c, t, g, unknown, or other
  misc_feature (724)..(724): n is a, c, t, g, unknown, or other
  misc_feature (739)..(739): n is a, c, t, g, unknown, or other
ctggagctccccgcggtggcggccgctctagaactagtggatcccccgggctgcaggaattcgtctcacccctagaaaaaaggctcaggattgcacggctccgccgcgctcgaattccccccaccttccaccaggccagcaccatggccactaccgccctcctcctccgcactcaccaccatccctgcaagccgccggcgccgcgcgcgtccgtactctgccgcgccacggcggggaatggggctggggccggcgttcgggccggcgggggccttgcggttcccctggggccccccccccccaaccccgggcccgggaaaaaaaatgtttttttccccccaaaaaaaaggggggccccccccggtatttaaaaaaaaaaaaaaagagtgccccggcccgtgcccgccccccgaccggggggggaaaaaaaccacccccccccccccctttttattttaggaggggaaaaggcacgggaaacgagatacccccccccccccccgacggggggagcaccgccaacccacaaataattatagtttgtgttggggggggggggggggnaaaaaaaaaaggaaaaataagacgcaagactctgttcccacgacctcttttgtctttgttaaaaaaaaaaggaggggagggggggggggggggngaaccggccccctcaaccaacaacgttaaataataaagttttaattgggaggtgaggtagagtggntggtattttcagggntatataaaccacaaaaaataatgattgaaagaaaaggcagctcggggggcccggatgtcattattccgacatacaatccgaagtgggggaggacccacacaaatgggaaaatcaagagggtgta

SEQ ID NO: 90069 - DNA, 889 bp, Zea mays
  misc_feature: Ceres CLONE 1577954
  misc_feature: Translation starting site: 279
  misc_feature: SWISSPROT Homolog: EC 2.7.11.1 Non-specific serine/threonine protein kinase
  misc_feature (370)..(370): n is a, c, t, g, unknown, or other
  misc_feature (375)..(375): n is a, c, t, g, unknown, or other
  misc_feature (382)..(382): n is a, c, t, g, unknown, or other
tggagctccccgcggtggcggccgctctagaactagtggatcccccgggctgcaggaattcgtctcacccctagaaaaacccccgtcgagcacacaacacaccctcctcgtcctccaatccaatcaacctggtagactcgcttcgcttctcccccagccgtcggacggagctcctcgcagtcgcagcagccgccgatcagcctgcgctcgggctcagcgctggaaggtgttggaagagaatagcctgaaggttcacagtaaccttcatctgtcggaagatgtatcgggctaagagggctgcattgtcaccgaaggtgaagcgccgcgtcggcaagtacgagctcgggcgcaccattgggggaagggaccntcgcnaaggtcnggttttgctagaacactgaaaacgggggaacctgtgctatcaaaatccttgacagggagaaggtttagaggcacagattggttgagcagataaagcgtgaaatttgttcccggaaattagaaggcccccctatggttgttcaacggtttgaagggatggggaaataaaacagaatttttccccgttcggggaaatgttcccgggggaaagctttttcaaaacttgggtccctaggggagggggaaaggaaaaaaaacccctataactctcccccacccagaaaagggggggggattcgccccccggggggggggggtttccaaaaaaattgagaccccgaaattttggcgtttggggggggggaagaaaccaaaatttccaacttggggtttgggggtcaacccccaaagaggggggggggtgggggggccttcaccaaggggggggccccccctttttttttccccccaaagggttataagggaggggggcttttggggcccccct

SEQ ID NO: 90070 - DNA, 777 bp, Zea mays
  misc_feature: Ceres CLONE 1577956
  misc_feature: Encodes the peptide sequence at SEQ ID NO. 90071
cccgcggtggcggccgctctagaactagtggatcccccgggctgcaggaattcgtctcacccctagaaaaacttctccattcgtgcatgtggagtactgtggaccgaggaagtagccggagagatgaacgcgaaattccagcaccattgtaagagatggctgagctgagctgaactgaatctgcgacggcgcctctgcactttcatctgattccggcgaattaggagacagacacagacgcgttgttttctgtagtcgagccggtttccccacgttgacaagtgatcgcgtcagatccgatcaggacgacgccatggccgccaaccaggaggagcaggagcaggagcagcgccgccgccttatcgccgccgcgacccgcttccctctcccaagcggctgcaggttctcctatggcacggcgggcttccgcgccgacggcgccaccatggcgcctgccgtctgccgcgccggcatcctcgccgcgctccgctccgtcaagctcgcaggcgccgccgtcgggatcgtcatcaccgcctcccacaaccccatcggcgacaacggcgtcaagatcgccgaccccgacggcggcatgatggcccagcactgggagcccttcgccgacgcgctcgccaacgcccccgaccctgacgccctcctccagatggtgcttcagtttgccaaggacgaagggcttccattgggaggggaagacacagcgcaagtgctgcttggcagagataccagacctacaggagcttacctccttcgacgctggat

SEQ ID NO: 90071 - protein, 154 aa, Zea mays
  misc_feature: Ceres CLONE 1577956
  misc_feature: SWISSPROT Homolog: EC 5.4.2.3 Phosphoacetylglucosamine mutase
MAANQEEQEQEQRRRLIAAATRFPLPSGCRFSYGTAGFRADGATMAPAVCRAGILAALRSVKLAGAAVGIVITASHNPIGDNGVKIADPDGGMMAQHWEPFADALANAPDPDALLQMVLQFAKDEGLPLGGEDTAQVLLGRDTRPTGAYLLRRW

SEQ ID NO: 90072 - DNA, 842 bp, Zea mays
  misc_feature: Ceres CLONE 1577959
  misc_feature: Translation starting site: 502
  misc_feature (243)..(243): n is a, c, t, g, unknown, or other
ctggagctccccgcggtggcggccgctctagaactagtggatcccccgggctgcaggaattcgtctcacccctagaaaaaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcnttgcgtcggtgtgtggcagcacgaccgtgtcgagatctcgccaacgaccagtgtaaccgcccacaccctcgtacgtcgccttcaccgactccgagcgcctcatcggagatgcggccaagaaccaagtcgccatgtaccccatcaacaccgtctttgatgccaagcgtctcatgggcaggaggtttagtgatgcctctgtccagagtgatattaagctgtggcccttcaaagtcattccctgggccccggtgagagccaatgattagtgttcagcacaagggggagggaaaaacagttggcagcccgaggagatctcctccctgggttctcatcaagatgcgtggagatcgcctgaaccttaccctgggcagcacgatcaagaaatgctgttgtcacggtcccctggcttacttcaacgactcccagaagcaggccaccaagggatccctgggggtgattgctgggccccaatgggccggcgtttcctcaatggaacccaaccgctgccggctattggcccttggggcctgaaccagaaggcaaccccgccgccgggggaaaaaaaaaggcccccatcctttggaccctgggaagggggg

SEQ ID NO: 90073 - DNA, 839 bp, Zea mays
  misc_feature: Ceres CLONE 1577961
  misc_feature: Encodes the peptide sequence at SEQ ID NO. 90074
ctccccgcggtggcggccgctctagaactagtggatcccccgggctgcaggaattcgtctcacccctagaaaaaccactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaaagttcgacaagacagcctggcggttcaggtcgcgtcttgctggccaagtccggcatcggcggacaagccgaacatgcccgccgctggcgtgttcaagcccaaaggccagattgggcccaccatgaaaggaagggcccccgcccaagggcgtcccccgggccatggtttcccggggccctgggaacgaactt

SEQ ID NO: 90074 - protein, 216 aa, Zea mays
  misc_feature: Ceres CLONE 1577961
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEATYDLATVLAFLAVLAFTISVYIMSRPRPVYLIDFACYKPADELKVSKAEFIDLARKSGKVRQDSLAVQVASCWPSPASADKPNMPAAGVFKPKGQIGPTMKGRAPAQGRPPGHGFPGPWERT

SEQ ID NO: 90075 - DNA, 759 bp, Zea mays
  misc_feature: Ceres CLONE 1577962
  misc_feature: Encodes the peptide sequence at SEQ ID NO. 90076
ctggagctcaccgcggtggcggccgctctagaactagtggatcccccgggctgcaggaattcgtctcacccctagaaaaaatacacaagcagagctcaaacaattcttgcttcccgctagctagctcgcaagaaataatggctccacttcttcttgcttctcgcacagcctgtcgtcctggccttacaagccgccatgcccatgataatggccggcacggcctgtcttcttcaccaccaggaagtcgtagtaagcgaagccgtagccttagcttgaggccacgagctgaaaagacgacgacaggcggtgggggtcatgttgtgagcgaaaagctgagcccctggcaaatccccaggagggagtggttcccccctagctttatctttggtgctgccacttcagcataccaaattgaaggggcttggaacgaaggtggaaaggggccaagcacttgggacgacttctgccacaaccatccggagtggatagcggacgggagcagtggggatgttggagcaaactcctactatctgtatagggaggacgtcagattgctgaaggaaatgggtatggacgcctacaggttctccatctcttggcccagaatattgccaaggggacactcgagggaggcatttaccataaaggcatcgagtactacaaaaagctgatcaacttgttgaaagagaacgcatagaaccatatgtgacactttttcactgggacacactcaagcactggtgggacagctacggtggc

SEQ ID NO: 90076 - protein, 177 aa, Zea mays
  misc_feature: Ceres CLONE 1577962
  misc_feature: SWISSPROT Homolog: EC 3.2.1.21 Beta-glucosidase
MAPLLLASRTACRPGLTSRHAHDNGRHGLSSSPPGSRSKRSRSLSLRPRAEKTTTGGGGHVVSEKLSPWQIPRREWFPPSFIFGAATSAYQIEGAWNEGGKGPSTWDDFCHNHPEWIADGSSGDVGANSYYLYREDVRLLKEMGMDAYRFSISWPRILPRGHSREAFTIKASSTTKS

SEQ ID NO: 90077 - DNA, 861 bp, Zea mays
  misc_feature: Ceres CLONE 1577963
  misc_feature: Encodes the peptide sequence at SEQ ID NO. 90078
  misc_feature (426)..(426): n is a, c, t, g, unknown, or other
  misc_feature (545)..(545): n is a, c, t, g, unknown, or other
gcggtggcggccgctctagaactagtggatcccccgggctgcaggaattcgtctcacccctagaaaaacttcgtagttcgaaaccaaaacgaagaacaaggcgtaacgcaaaagtcaaactaaagtcaacgcggcggcggttaggcgcccacccacccacccaccccaaagcccgatggatgcgccccgcggcggccacgcgcggcggccgggcccctccggcgaggcggcgaaccagcgccgcgccgccgcggcgcaagcgatggcgcgcatggaggagatgatgctcgcgcacgcaggcgccgccggcgagttcagcatcatcctcgacgcccctctgccttcgctgcagcagtaccgccgccaccccacgccgccgtcgggggccccctcggcctcgtccgccaactcctccccgttccgacncggcggcggcggagggcgggacaagggagtccccgcgcgcttgcgccgcgaacgaagcgggcacgacgccctcggggacccgggaaacgccggggggggcttctgggcaagccgggggngaatggaaaggggcgcaggcgcttgccggcccccaacgggtgggccccccccccccaaccccaaacaaggaaaaaccccttaaaggcgccccgtgccggtttaaggaaccccggggaacgtgggccagggcttttttttcccgggggaaaaaccccttcccccaaagggccccacaaaggtaaaaaccgtgggcggtttctggggggggagaaaaaaaaaccccttttttaaattttttgggccccgggggggggaaatcctaaaaaagggactcgctcttaaaaaaaccctccaaggggtaaaaaaaggggcccc

SEQ ID NO: 90078 - protein, 121 aa, Zea mays
  misc_feature: Ceres CLONE 1577963
  misc_feature (55)..(55): Xaa is any aa, unknown, or other
  misc_feature (95)..(95): Xaa is any aa, unknown, or other
MARMEEMMLAHAGAAGEFSIILDAPLPSLQQYRRHPTPPSGAPSASSANSSPFRXGGGGGRDKGVPARLRRERSGHDALGDPGNAGGGFWASRGXMERGAGACRPPTGGPPPPNPKQGKTP

SEQ ID NO: 90079 - DNA, 1239 bp, Zea mays
  misc_feature: Ceres CLONE 1577964
  misc_feature: Encodes the peptide sequence at SEQ ID NO. 90080
  misc_feature (73)..(73): n is a, c, t, g, unknown, or other
  misc_feature (74)..(74): n is a, c, t, g, unknown, or other
  misc_feature (1150)..(1150): n is a, c, t, g, unknown, or other
  misc_feature (1239)..(1239): n is a, c, t, g, unknown, or other
ggatgaagagaacaaatccaactaaaagtgggtgggtaaccaacagcacgcattgatagaaaccgcgactaannaaaaaactgggactccccgcggtggcggccgctctagaactagtggatcccccgggctgcaggaattcgtctcacccctagaaaaacccctagaaaaaagcgaagaggagacgacgactgctctgcctttcttccctacaggaacaggacgaatcaatcaatcattcccctctgcagccgccggccctcagcaagcaagcaagggacagacacggcggggatgggcagcggggtccgggcgctgatgcgccggaaggaggtagactcagagaggacgcgcgccgccggcagcgcccaccagctccgcaaggagctctccgtcacccagctcgtcaccatcggtgttgggtcgacgattggagctggcgtctacgtccttgttggaacagttgcgcgggagcattccggggcggcattgacgctttcatttcggatagccggaaaaacaggtgtgctttcaggctttctgcctatacggagctgggcgacccgttcgcccctttcgggagggaagccccttaatcattaagtcggacaatacttgcctttgctccaaagggagtttggcaaggggttgaattgaggctaggggccttgggaaaaacttctgaaataacaaccaatttggggtgggaaaaccaaaccactttttagccttcggtaggggaaatatgttcgtcgcacaataaagttcctagtgacgcctcttaataatttatgttggtggcggatgcgcggacactagtgtgcaaaaatatgctcttccgtcggccccacatgtcgagaaatattttttgtgtcagcgagatagaggaataaatgtggatgagaatatttacccggccgggggagcccccgcctgggaagtagaattcgaaaatttgcggcaaagcagaaactaccactattggggtgcgccatcatgtgtcctttctcactgactccaagtgtcattttccccacgaacagaatctccacggtagtggcgacacccatcacatatttctctgttagatgttgcgggggaagcaccgtgacgagacgcacggagcgttccgtacccgattatttatcgncgcctccccaactgaaggaagtcattaacgaagccacacaccgagcactatagtgacccaggtatgtgataagtatgataagtgctggn

SEQ ID NO: 90080 - protein, 102 aa, Zea mays
  misc_feature: Ceres CLONE 1577964
MGSGVRALMRRKEVDSERTRAAGSAHQLRKELSVTQLVTIGVGSTIGAGVYVLVGTVAREHSGAALTLSFRIAGKTGVLSGFLPIRSWATRSPLSGGKPLNH

SEQ ID NO: 90081 - DNA, 1156 bp, Zea mays
  misc_feature: Ceres CLONE 1577965
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (511)..(511): n is a, c, t, g, unknown, or other
  misc_feature (916)..(916): n is a, c, t, g, unknown, or other
  misc_feature (1058)..(1058): n is a, c, t, g, unknown, or other
  misc_feature (1092)..(1092): n is a, c, t, g, unknown, or other
  misc_feature (1096)..(1096): n is a, c, t, g, unknown, or other
ttattttttattntnnnttcnttgtctcatttttaccttcgggaggtaggatggaaggtgttgtgggtgcgctgaggggaatgttggtgctcccctcggtggcggccgctctagaactagtggatcccccgggctgcaggaattcgtctcacccctagaaaaaacgggaagcccaagaagttagctgcgaggtctttaaagaggagttgttgcattgcagttgcatgctgcacaggcgcggaagccatcacctcaaagccatggcgtaggtggaccacctcgctgccgagagggccaccgcgcgcttccatgttgaggagatcaaggtcgcgtgggccggttcacgcgacgccggcctcggtcgccgaccgtgttggggcgcctcatcgcatcggaccctgtcttccgcggggataaaaggacccatggtctccaggaaaggagtgtccaaggacacgcgtaggaaaaagcagcgcttggggtggggaagcgggattgtccaaccctaccncccttaccgaagaaggaaggcgggaattggcagagaacaattttggttggaacgcaaccctggcgtaaaggtggagcctccatttggggggcaaggggtccgtgttccagccctttctaaaaggggcctggggaaaccctggagggagggcaacccaagcctccaatgggggaggtggagacaaaaggggggcccctaaccaaagtttcccccgaagatataaatttttgcggaggtacccttatttgcggatacgatgaaaacccgcgagagaattctaggggggtgaccaggggggcggtatgaaatagcgatcttaccgacgggggtggcgcccttgtgaataaagcctgaaccaggcttgtacccattgatgggcgatacgcgcgggaaagaggccggganggggaaaaggtccgggggatataccccgggcgagagtgccgacaaccccggtcacagtgtggacccagcctcaaatagggggaggggggccctcggaaggtgcgctgttagggagaaacacaaagtttcccaccacgcgcanggacgtgacggtggtgatgacggcggctggcgcnttgntattaagcagtgagagggcaagaggaacttttggtggtcatagaacaggaaatctcacac

SEQ ID NO: 90082 - DNA, 836 bp, Zea mays
  misc_feature: Ceres CLONE 1577966
ctccccgcggtggcggccgctctagaactagtggatcccccgggctgcaggaattcgtctcacccctagaaaaagttcatctccgctttccctcgtcgactatgcctagccgacaggaaaaggggacaaacgaccaacttcgactatatggtatgcatctccgttgggtctttgtcatatatcgccgccggcgccgcctggggcgcggaatctgacaggtctccctattctatcctacgacgaggtgcatttatatctgcatcgcgagcgagattgggaagacagccatggctgtcggtcggggcctcgtgccacaggacgggtgatctatcctcttgccagtacgcttgcttggtgggggaagacaggatgccgtcgcagatgtcgcctcaccaggtgctctgcttggctgctctcccgtgctgtctggggcaggcgattaaccccaggaatgatcagtgaataaccttgacgtcgatctgatctatctcgcgagcctacagtgtcgggggtgtatgctctgtgtaatctgataagagttacactggggtgtgcattgcaaaatcgacaagagcatcatctgcgtatgcactggcagtggtaacgatcacggcagcttgctctggcacagttggtgaggatgatggaacataagggcacggattcctcgagtcgtgagcaggaaaatgtgccgtagggctatgtatccaaggacttccaaacctgggttccacgtagatttgattggcctgccaacgcgggatctcccttgaaaaaaattaatttgctaggcccggggaacacggtaaatttttgggagggcttgtacttatcca

SEQ ID NO: 90083 - DNA, 781 bp, Zea mays
  misc_feature: Ceres CLONE 1577968
  misc_feature: Translation starting site: 230
  misc_feature (457)..(457): n is a, c, t, g, unknown, or other
  misc_feature (719)..(719): n is a, c, t, g, unknown, or other
ctggagctcaccgcggtggcggccgctctagaactagtggatcccccgggctgcaggaattcgtctcacccctagaaaaaagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagntggggtttattcggatgataataaccttcagcttgaggccaccacacagttccgcaaattgctctctatagagaggagtcccccccatcgagaagtatcaaaacaggtgtagttcccagatttgtgcagtctctcaccagagaagatttcccccagctgcagtttgaagctgcatgggctctcacaaatattgcttctggcacttcagaaaatacaaaggttgttattgatcatggagctgttcctatatttgtgaagctcntgggccgggtagtgatgatgttcgtgagccagctgtgtgggctttgggtaaagttgcttgcc

SEQ ID NO: 90084 - DNA, 846 bp, Zea mays
  misc_feature: Ceres CLONE 1577969
  misc_feature: Encodes the peptide sequence at SEQ ID NO. 90085
  misc_feature (487)..(487): n is a, c, t, g, unknown, or other
  misc_feature (488)..(488): n is a, c, t, g, unknown, or other
  misc_feature (577)..(577): n is a, c, t, g, unknown, or other
  misc_feature (660)..(660): n is a, c, t, g, unknown, or other
  misc_feature (846)..(846): n is a, c, t, g, unknown, or other
tccccgcggtggcggccgctctagaactagtggatcccccgggctgcaggaattcgtctcacccctagaaaaagcccacgcctcctcctccagtcctccctttcgtcgtcgcttccctccccttcccgttcgaatcctctgaccaccgcagagcctcccccctgaggaaaccctagcgcagccgccgaccgccgccgacccgtagcatggtcgtccccgggcccgggccccggtcgccgcgttccgttctccgggggggctttcggggccttttgggcccggaacccaaagggggggggggctccccttttgaaaaacaagggggggcctcccggggggggaaaaagggggggaaagcggcgccccccggggggtccccccccctcccaaaaatgtggggggccccccttttgtttcccccccccggggggggggaaaaatagggggggggggggggggggggtcacaaaaccccacccgccggagnncacctaacttcccacccccccggggagacgggggggggtatttagttggtacacggaggggtggtgtgtttttgttgttttgagggganggcccaccccccccccaaacaaaacaccagattctttttttttattttctttttttctcccccctagtgcaagcagggggaanacaatcttttttttttattttaaatattaccccccacgcccgtttcaccccaacaaaagggcgggtgagatgttgtggataatattcggcacgatgagggggagtgaggggggggggggggggggaatgggcatggggggcggggggggcggcggggggggttgtgtgtatgatgtcttggtgtan

SEQ ID NO: 90085 - protein, 78 aa, Zea mays
  misc_feature: Ceres CLONE 1577969
MVVPGPGPRSPRSVLRGGFRGLLGPEPKGGGGSPFEKQGGASRGGKKGGKAAPPGGSPPLPKMWGAPLLFPPPGGGEK

SEQ ID NO: 90086 - DNA, 871 bp, Zea mays
  misc_feature: Ceres CLONE 1577971
ctcaccgcggtggcggccgctctagaactagtggatcccccgggctgcaggaattcgtctcacccctagaaaaagtgcaccgcacttcacaccccaccaaccttctccccccctgaaaaactatctaccccaccccaaaccacccctacccgccgacgagcgcgatcgattgattcgtttcgcgccgggcggcggcggagggagcccaccagatccggctaccgccgcggctacgatgaagtcgctgctgccgcggagcgagctgctgcgctcgtaggcggcggccgtgcggtcgtcggccggcggcgccgcgcggggagacggtgctgtggccgacggccgcgggaatgggccgcgagcgcccgcctcctccactttctggtttcctgctgcacgcagctctgctgccgtcatctcggttctttctgcggcttcgcgcttcctcagggactcctgcttcttgcatggcttttctccacccaaccggggctcttacactttcaaaattccttcctcccttctttgggggggggggggccctgggggggccaccccccgcggggaaggaacctgcgaacccggccagggcggcccgcccacggaacggaacccaccgaaaaatccttttggggggtttcttccctttttggggggggggccaaaaaagttccccccccctttcgggggcccggggctttaaccgcaaaaggggccctttgggaaggcggcgcacgccggggagcccccccaaaaggggtggggggggcgggggtttctggggagaacccccgcaaaggacccacagtctggggggtcccggagaggggacctcggggtattttgggaattccgggcccggggggcccgccca

SEQ ID NO: 90087 - DNA, 809 bp, Zea mays
  misc_feature: Ceres CLONE 1577977
  misc_feature: Encodes the peptide sequence at SEQ ID NO. 90088
ctccccgcggtggcggccgctctagaactagtggatcccccgggctgcaggaattcgtctcacccctagaaaaaactgcggcctcttcctcgtgctcctcctccagtcctcccttcccaccatgattaccacccacctctccccagccctcaagcaccgctccccgtccccgctccactccacctaccactcccaccaccacctccccgtgcacctcccgctccccctcccccgccgacactgccacctcgctaagcccgccgccgccacctcggcagaccttctcgcgagcatcgagtccgtggcctccgcggcctccgtgctggccgacatcatgctggtccacgagtcggggcacttcctcgcagcggcgtcccggggcatccacgtctcccagctctccagcggattcagccaggcgctggaccgcttacgcctcggcgccgtcgagtgcacgctcacgcgcatcccgatcggtcgctacctgcgcgtccccgacgactacccggagtacagcttgacgcccgacgaccccgtactcctccgcaaccgacgcgtcacagaccggctgctacttgtctgcagctggcagtgacggcaaacgtcgccttccgcttcctcgtcgtgtacgcgcaagggctcacctgcaggggtgcccgtccaagctccgtctccccggggtgcatggtaacgaaagatcctcccggggtacaacgacacggcgagggtgccggcctccccgaggaaaatcatgcttggacccgccccgggggccgcggcccggaacacatacgtgacccagccctggg

SEQ ID NO: 90088 - protein, 86 aa, Zea mays
  misc_feature: Ceres CLONE 1577977
MLVHESGHFLAAASRGIHVSQLSSGFSQALDRLRLGAVECTLTRIPIGRYLRVPDDYPEYSLTPDDPVLLRNRRVTDRLLLVCSWQ

SEQ ID NO: 90089 - DNA, 943 bp, Zea mays
  misc_feature: Ceres CLONE 1577979
  misc_feature: Encodes the peptide sequence at SEQ ID NO. 90090
gcggtggcggccgctctagaactagtggatcccccgggctgcaggaattcgtctcacccctagaaaaagacgagcggtgtctatggcaacgggtccagcattttactgcgcacctccagcaatggctgcctccaccatggcgatctcctccacggccatggccggcaaccccgtcaaggtgggctctttctgccaggggcgtatctctctggcctccagcgagggtgagcccagggtgggggggtgccgccgcccctggtactggccctaccgcgtcacgtaactcgggaccttctcttgagaggcgccgagctacctcagcggcggagttcctcggcgtactactgatgggtactccccatcggatgtccaccgacgccgagaccttcgcaagagaactcctcagtctgcaggtgatccactcaccgctgggccatgctcctgactggtccgctgcgggcttccctcgagctggctctcccgcaatgaacctcaaattcggacggaggcacgtctcggttaaagggccgggccttccagatctttatgggaggcgcgcgggctgggactaccttcggtggaccccaaccctggatcccgggcggccacagcagtccttcggccatctttggggctttgcccaggactccggcttggtggggtgtcctttccagggggtacactggagttgggctgggtggagacggcttcggccgaaaggtggttcctagcccccccagtttccccgtggccgggggaagcttccaaatccccccttcgggacagttggccgagaaaaaccccctagaggacctctccgccccttatcttcccaggggggtgaagggaagatctttggtgaagggggcccgctccaccccccaagtgggtttttcccagggtgttccgcggtttttgttttcggggcaaatgtgcccattag

SEQ ID NO: 90090 - protein, 53 aa, Zea mays
  misc_feature: Ceres CLONE 1577979
MAASTMAISSTAMAGNPVKVGSFCQGRISLASSEGEPRVGGCRRPWYWPYRVT

SEQ ID NO: 90091 - DNA, 769 bp, Zea mays
  misc_feature: Ceres CLONE 1577980
  misc_feature: Encodes the peptide sequence at SEQ ID NO. 90092
ctcaccgcggtggcggccgctctagaactagtggatcccccgggctgcaggaattcgtctcacccctagaaaacccccactccacgcccggccgcacctctcctatcttgctccaagtagcaagttccaactcgagtagattcacttcgccactccgttgccctctcctccgccgcccgatcctttccccgtctgagatggcatctccggcatcggcgtcgcttaaggaagccgtgggcagcctcgaccgcgacggctttgttggtctcctctccaacctcatcggcgagaccgcacacctgcagaacgacccgccgacctacaggcctcaagaggagcgcgtggcgcagcacgtagtcgacgtgctccgcccggtgtccgcggacaccgggggcggccccctccttgtgcggaagataagctacgccgagggcaggagcaacgtcatcgttgaataccccggcaccgtcccaggccgcgttgtctccttcgtcggcatgcacatggacgtcgtccctgccaacggcagcgagtgggactttgatcctttctcactatcctttgatagcgaggataaggacaaacttcggggacgtgggacaaccgactgtcctggacatgtcggaacggtgggctcagctaatgcggcgggcttggtgaagttcaacccacccccggaaacattcgggccattgccggtggttcatttgccaaatgaaggagaaccccatctgggtcactgggcaatggagggtttgatgggcccccc

SEQ ID NO: 90092 - protein, 190 aa, Zea mays
  misc_feature: Ceres CLONE 1577980
  misc_feature: SWISSPROT Homolog: EC 3.5.1.16 Acetylornithine deacetylase
MASPASASLKEAVGSLDRDGFVGLLSNLIGETAHLQNDPPTYRPQEERVAQHVVDVLRPVSADTGGGPLLVRKISYAEGRSNVIVEYPGTVPGRVVSFVGMHMDVVPANGSEWDFDPFSLSFDSEDKDKLRGRGTTDCPGHVGTVGSANAAGLVKFNPPPETFGPLPVVHLPNEGEPHLGHWAMEGLMGP

SEQ ID NO: 90093 - DNA, 828 bp, Zea mays
  misc_feature: Ceres CLONE 1577983
  misc_feature: Encodes the peptide sequence at SEQ ID NO. 90094
  misc_feature (605)..(605): n is a, c, t, g, unknown, or other
  misc_feature (706)..(706): n is a, c, t, g, unknown, or other
  misc_feature (755)..(755): n is a, c, t, g, unknown, or other
ggagctcaccgcggtggcggccgctctagaactagtggatcccccgggctgcaggaattcgtctcacccctagaaaaattagccagctcgaccgacgagacgacaacgccgccgcgccgcgcgcacgcccgacgccgacgccgacgccgacgacgacacgccctccgcccggtcccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgggcctcctcgaccgcggcgccacctccctcgtccgctgcaccttccgcgactcctgcccgccgccgaaccagcagctctcacggaagctgggaggcgtggcggcgaacaaggtagcggaggaggagcgcatcgtgaacgcggggcgcgcgccggccatgttcgacgagctccggggccggctgcggatggggctggtgaacatcgggcgcgacgagctgctggcgctgggcgtggagggcgacnctgtgcgcgtggacttcgagcgcgtgtcggacgcgttccggtggtcggacctgttccccggagtggatcgacgaggaggagggacgacgagggcccgtccntgccggagctgcccatgccggactgggcccggtacggcggcactgtacnttggggggggggggggtccctgccggtgcaacgcagcggcggccggtggtaaacccgaactgggtcaggcggc

SEQ ID NO: 90094 - protein, 200 aa, Zea mays
  misc_feature: Ceres CLONE 1577983
  misc_feature (127)..(127): Xaa is any aa, unknown, or other
  misc_feature (177)..(177): Xaa is any aa, unknown, or other
MGVTTAGEAVCKSPARASVIVRLNAAFLAFFLFAYVALLLHPKYSGLLDRGATSLVRCTFRDSCPPPNQQLSRKLGGVAANKVAEEERIVNAGRAPAMFDELRGRLRMGLVNIGRDELLALGVEGDXVRVDFERVSDAFRWSDLFPGVDRRGGGTTRARPCRSCPCRTGPGTAALYXGGGGGPCRCNAAAAGGKPELGQA

SEQ ID NO: 90095 - DNA, 836 bp, Zea mays
  misc_feature: Ceres CLONE 1577986
  misc_feature: Encodes the peptide sequence at SEQ ID NO. 90096
  misc_feature (359)..(359): n is a, c, t, g, unknown, or other
  misc_feature (361)..(361): n is a, c, t, g, unknown, or other
  misc_feature (365)..(365): n is a, c, t, g, unknown, or other
  misc_feature (366)..(366): n is a, c, t, g, unknown, or other
  misc_feature (712)..(712): n is a, c, t, g, unknown, or other
  misc_feature (723)..(723): n is a, c, t, g, unknown, or other
  misc_feature (725)..(725): n is a, c, t, g, unknown, or other
  misc_feature (726)..(726): n is a, c, t, g, unknown, or other
  misc_feature (728)..(728): n is a, c, t, g, unknown, or other
  misc_feature (808)..(808): n is a, c, t, g, unknown, or other
ctcaccgcggtggcggccgctctagaactagtggatcccccgggctgcaggaattcgtctcacccctagaaaaaaaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcgggtgatgcgctaccgctgccgatccggcacacgaacctcatcttctcggcgctgttcgccgcgtcgctggtgtacctgatgcgtcggtgggcgggggggaagatncngcgnnctccacgcccgctcccacgtggggtctccccccgcccgagatctttcgccaatctgccgggccctcggtcgcgttcgcctcaatctaccctccctcagcttttctttcggggaatcgccctttcgttgccaagtccggttcgtcctccaggcagggcgaccaaacaaaccgaagggactttctctttcgggggcagaaatccccccccccccccccccacctgggggggcggggggggggggggcccccccccaaaaaaaaaacctggggggggaaaaaaaaaacccccccgggtgtgggggcgcccctccttttggggggggggggagacaaaaccccccccccnccccccccggngnngngaggggggggggtaaaaaaaaaataataaaatccccccccgccgcgaggtggggggaagacaacacacaacacgagaaanaatagtggttgttttgtggggtggcccc

SEQ ID NO: 90096 - protein, 196 aa, Zea mays
  misc_feature: Ceres CLONE 1577986
  misc_feature: SWISSPROT Homolog: EC 1.1.1.34 Hydroxymethylglutaryl-CoA reductase (NADPH)
  misc_feature (69)..(69): Xaa is any aa, unknown, or other
  misc_feature (70)..(70): Xaa is any aa, unknown, or other
  misc_feature (72)..(72): Xaa is any aa, unknown, or other
  misc_feature (187)..(187): Xaa is any aa, unknown, or other
  misc_feature (191)..(191): Xaa is any aa, unknown, or other
  misc_feature (192)..(192): Xaa is any aa, unknown, or other
MDMDVRRRVPPPHGSVPRRQQATGAEGERVRVQAGDALPLPIRHTNLIFSALFAASLVYLMRRWAGGKXXRXPRPLPRGVSPRPRSFANLPGPRSRSPQSTLPQLFFRGIALSLPSPVRPPGRATKQTEGTFSFGGRNPPPPPPTWGGGGGGGPPPKKKPGGGKKKPPRVWGRPSFWGGGETKPPPXPPRXXEGGG

SEQ ID NO: 90097 - DNA, 788 bp, Zea mays
  misc_feature: Ceres CLONE 1577987
caccgcggtggcggccgctctagaactagtggatcccccgggctgcaggaattcgtctcacctctagaaaaaagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctccttccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacaggatggccgccgcgccgcccccccaagccgacgagctccagccgttcccgcccaaagagcagctgcccggcgtcgcccttctgcatcaccagccccccgccctggccggaggccatctttgcttaggttccagcattttcctcctcatggttgggcacccccct

SEQ ID NO: 90098 - DNA, 761 bp, Zea mays
  misc_feature: Ceres CLONE 1577988
  misc_feature: Encodes the peptide sequence at SEQ ID NO. 90099
  misc_feature (584)..(584): n is a, c, t, g, unknown, or other
  misc_feature (603)..(603): n is a, c, t, g, unknown, or other
  misc_feature (604)..(604): n is a, c, t, g, unknown, or other
ctccccgcggtggcggccgctctagaactagtggatcccccgggctgcaggaattcgtctcacccctagaaaaacctgactggggctaaattgctagtttagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagctccaacttgtgggttccctcatccaagtgctacttttcgatagcgtgctacttacaccacagatacaagtcaaccaagtcgaagacttacacaaagaatggagaatcttgtacgataacatatggttctgggcaaatcgctggcttcttcagtgaggacaatgtngttgagtgggtaaccttgnntgtgcaaaatcagtaattttattgagacaactcgagaaaccagccctactttcatcattggggaagtttgatgggaattcttggtctcggatttccttgaaaatttctgtagaagaagccctccaatttggcagagcatgaaacagcagaaactggt

SEQ ID NO: 90099 - protein, 171 aa, Zea mays
  misc_feature: Ceres CLONE 1577988
  misc_feature: SWISSPROT Homolog: EC 3.4.23.40 Phytepsin
  misc_feature (167)..(167): Xaa is any aa, unknown, or other
MGQTHLLLLACFWVLSTCSLLLDASSDGLLRINLNKKRLDKEALTAAKLAKKESHLRRSVGADQYLSASTDDIVPLDNYLDTQYFGQISIGTPPQNFTVIFDTGSSNLWVPSSKCYFSIACYLHHRYKSTKSKTYTKNGESCTITYGSGQIAGFFSEDNVVEWVTLXVQNQ

SEQ ID NO: 90100 - DNA, 893 bp, Zea mays
  misc_feature: Ceres CLONE 1577991
  misc_feature: Encodes the peptide sequence at SEQ ID NO. 90101
  misc_feature (308)..(308): n is a, c, t, g, unknown, or other
  misc_feature (361)..(361): n is a, c, t, g, unknown, or other
  misc_feature (750)..(750): n is a, c, t, g, unknown, or other
  misc_feature (751)..(751): n is a, c, t, g, unknown, or other
  misc_feature (893)..(893): n is a, c, t, g, unknown, or other
ccccgcggtggcggccgctctagaactagtggatcccccgggctgcaggaattcgtctcacccctagaaaaaagcccgggaggctctcacctattattagaatccacctcgcaccccgcgggcggtgactcccctagggtttcgtcgctccgccgccgccgaaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaancacgcgacattcctgccgcactccgcggggcgctactcccaaaaccggttccnacaggcgcagtgcgccatcgtcgagcgcctcaccaacttggttcatgatgcacggggcgcaacgacgggaaagaagggcatgggcccgtcctcttcattgaagtcccccccctggaagatcaaccccccctgcctccatggacgcccaatccccattcccagggtggggtcggtgggaacccgaagttatttaaccccggtgggacccccccgggaggggaaggccccccccgcgatattgggttcccccccccgggggtttgtgagaacaaagggcggggcgtgtttggaataattttccccccccccgtaaaaaaaagggtggaaacacaaggggcatattatcaccctaccctaaaacacctcgtggggcccacaggggagaaatnnccccccttttttggggaaaaaatgatccaaaagaccttttgtgcgtagggtgcgcctcttcccggagttatgggtttggtgctatctacagccagttcgcaaaagaggggccttttttctgtaagaaattctgcatcgcccn

SEQ ID NO: 90101 - protein, 154 aa, Zea mays
  misc_feature: Ceres CLONE 1577991
  misc_feature (39)..(39): Xaa is any aa, unknown, or other
  misc_feature (57)..(57): Xaa is any aa, unknown, or other
MAEVEQPQDAVKLFNRWTFDDVQVNDISLNDYLAVTAAXHATFLPHSAGRYSQNRFXQAQCAIVERLTNLVHDARGATTGKKGMGPSSSLKSPPWKINPPCLHGRPIPIPRVGSVGTRSYLTPVGPPREGKAPPAILGSPPRGFVRTKGGACLE

SEQ ID NO: 90102 - DNA, 905 bp, Zea mays
  misc_feature: Ceres CLONE 1577992
  misc_feature: Encodes the peptide sequence at SEQ ID NO. 90103
  misc_feature (484)..(484): n is a, c, t, g, unknown, or other
tccccgcggtggcggccgctctagaactagtggatcccccgggctgcaggaattcgtctcacccctagaaaaacctattcctcctcagcataccccttcttccttcgtccccattgatccccttcccccctccactcgtctcccaaatcgccagcgagcgccatgccgccgcctcccctgccctcgccgcccctgaccggctgacccgacctccccactgttctttcccttccacctgggcgccacagcgtttcccttcccgtcaccacgaaatcccggagggacgaggagggagttcgtcgcctgatcgatcggccgatccacgccgccggcctcccaatccttcgctgccgccatgttcaacaagataatcaagaggggaaaccgcaagggcgcgcgcggggacagcgcggaggtcgccgcgcgccccgcagcgccctcgtcgtcctctgggagcggcggcggcggcgcggggggagcctcncccgtcaccgtcaaccacgcctcccgggccacagcgccctttctcgtcgtcgcccaccttctcgcacgtcgcgcccgtccggcgtttgcgaccaacccggcgggggggggggcggcgtaccggccaattccttgaagccggttcccggctcttccggggaagttgcccgccccaaaaccggtcgggggcttcattccttcgcaaagcttccggcttcgttgcggggggctctttcgagctttttcggaactcccttcaaacccccctcccaaaaaaaaagggagggccaaaacgccccgggggcgttccctccaaggctggtaaaaatacctgtgcaagggctcccagcctcaagggccgggggggggggccaaaaaggggcccccagggggcccttccccgggaacaccctcgtccaggg

SEQ ID NO: 90103 - protein, 87 aa, Zea mays
  misc_feature: Ceres CLONE 1577992
MFNKIIKRGNRKGARGDSAEVAARPAAPSSSSGSGGGGAGGASPVTVNHASRATAPFLVVAHLLARRARPAFATNPAGGGAAYRPIP

SEQ ID NO: 90104 - DNA, 1125 bp, Zea mays
  misc_feature: Ceres CLONE 1577999
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (75)..(75): n is a, c, t, g, unknown, or other
  misc_feature (76)..(76): n is a, c, t, g, unknown, or other
  misc_feature (843)..(843): n is a, c, t, g, unknown, or other
  misc_feature (902)..(902): n is a, c, t, g, unknown, or other
aaaggagggaattaaattggagaaaaaaggggggaaaaaaaggaaaaaaggaggggggggtgggggggnnngggnnaaaactggaactcacctcggtggcggccgctctagaactagtggatcccccgggctgcaggaattcgtctcacccctagaaaaagtgatcacacaacaagcgtcgatggacgtcccacctaatcctttctcgcactcgcaccgtctgtggagaagcgagaggaggaaggagacaaggaaaggaagggaggggaatctccgtagagcactaggcagcgacagagtcagcgcaacttcatctccttccttccttcccctttcgctggccgctggccgtcggcaccatcacctacggccacgggcgcagcgcggcgccgctccataccgggtccgcgggcctctcgccaaggaaacccgataagcctccgctgctctgctcggatgctcttgccttctctcaacgtccacggcccacctagctagaaacacacaacaaacaaggagaaatcgcaagggaagagcagcgccctgcccgccgcgcccgtattccagtcgaggcaagccccccccgggccccgattctggccgggcccccgacaacggcttggggaatctttcctttttccctttaaacgcgaaacccggttcaaacgcgccgccagaaaatatttcctggccctatccccctggacggggtttccctgtggaaagggttttcccccccttaaaaaaacaccccttgtcggcacacccacccacttcacccttttgctgtaattttccccctctggccaaaggggggtggaatatctcaaagccctgtttagnaaccaccccttttttgccgctcgagttatcccatcccactttgcccccctttacagtancgtgccccccccccaaggaaaatcctctccgccctttccgcctacgggtgacgcttttccacaatatttccggagggccacgggggggggggcgagaaactcccacggctctgctgtgagaggtggggaaacgccaagaggaaagtgcgggcaaaaaaaggtggccgaattttgtgaatccgtggtgtttcgcggggccccaccgtggggcataatacgggga

SEQ ID NO: 90105 - DNA, 1204 bp, Zea mays
  misc_feature: Ceres CLONE 1578001
  misc_feature: Encodes the peptide sequence at SEQ ID NO. 90106
  misc_feature (28)..(28): n is a, c, t, g, unknown, or other
  misc_feature (31)..(31): n is a, c, t, g, unknown, or other
  misc_feature (34)..(34): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (838)..(838): n is a, c, t, g, unknown, or other
tggagttttggggggtttgggggggggnagnaanannnggggggggggagaaaggggggatcacaaaccttccccaaaaacggaactccccgcgtggcggcctctctgaacagtggatcccccgggctttggcaattcgtctcacccctagaaaaatcttcacttcggcccccggacccgttcacccgcaaatatctgtcgccgtctcgccaacagcaccaaccgcgcctcctcgaattcgaccgtcatggcgagccaaggcgagccgtcgtcctccgatccgaaggggaagaaggattactctacggcgatcctggagaggaagaagtcgccgaaccggctggtggtcgacgaggccaccaatgaggacaactccgtcgtcgctctgcaccccaacaccatggagaggctccagctcttccgcggtgacactgtcctgatcaagggtaagaagagaaaggacactggcggggagggggcccccccacgaacacatggggagggagcccaaaggtcccggaatgaaccaagatggggcagggaaggaaccttggaggggtaaccggcttggggtggaatgttgggaatactggtcccgaatcaggtgggccgccaggaggggctcataaagtaccggggggaaaaggccggtgggggccgaccgaggaggcgggggctcagaggtgtggggaatgggacacacccccgaattgatagaaaaaagggggccaaatgtccaaacccttggggggtcgcaaaacgagactgatgaagtgagcgtatggggaaaatgggccccgcgcattcgttgccacgagaagaaaaaacacccccaggntaatggccctgtgcccccctgtcttgagaaaaagagagccccgtgaaaggccgggagcacccccctagttatggggcaggggctatataaggggggtgggggacgcgcggttaatgtcgccccgataagcgtgtacagggggtgcgtgcgtgggggcaacagtgaaacatgatagatgggccgaggggaaagagacttcggagataagaggtgctagttaggggaaggaacctgggaaggcccccgcgccaaaaaatatgaactgtgggggggaagccgtgcgacgcgcgactcaacaaggccatacaccataaatagtatattggtgtggtgggaaagggctcgcaagccgccggagtgaggaga

SEQ ID NO: 90106 - protein, 104 aa, Zea mays
  misc_feature: Ceres CLONE 1578001
  misc_feature (28)..(96): Pfam Name: CDC48_N Pfam Description: Cell division protein 48 (CDC48), N-terminal domain
MASQGEPSSSDPKGKKDYSTAILERKKSPNRLVVDEATNEDNSVVALHPNTMERLQLFRGDTVLIKGKKRKDTGGEGAPPRTHGEGAQRSRNEPRWGREGTLEG

SEQ ID NO: 90107 - DNA, 880 bp, Zea mays
  misc_feature: Ceres CLONE 1578002
  misc_feature: Encodes the peptide sequence at SEQ ID NO. 90108
ctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacaagacggacgggagcggcgccggccagcgaccccgacaagctcttgagcctgctgccgtcgccgcccatgaagctccccatcatcgggcacctgcacctgatgggggacatccccctacgtgtccctcgccgcgctcgccaacaggtacggccccggacctgatgctgctccgcctcggcgccgtgccgaaccgtggtgggtctcgttcgccgcgcgtcgcccgaggccgtgctccccaacttacgaacacgtttttgtcctcccgacccggggctcccctggttgtccgaaaatcatacatgttacgggggcccaccgaacctcgggccttcgggggcccttaggggggaactacctttccgcaaaaggggccgggatatactgggtcaccccggtggacaccgggctcaaaacgcccaaggaaggggggccgggttccacaccgggcccgcgccggggaataaaatatata

SEQ ID NO: 90108 - protein, 103 aa, Zea mays
  misc_feature: Ceres CLONE 1578002
MAAQLHHALYELLHEAAAAQRALLLAIPFSLLLLPLLLRYLAASASASATRRTGAAPASDPDKLLSLLPSPPMKLPIIGHLHLMGDIPLRVPRRARQQVRPRT

SEQ ID NO: 90109 - DNA, 1058 bp, Zea mays
  misc_feature: Ceres CLONE 1578004
  misc_feature: Encodes the peptide sequence at SEQ ID NO. 90110
  misc_feature (1)..(1): n is a, c, t, g, unknown, or other
  misc_feature (12)..(12): n is a, c, t, g, unknown, or other
  misc_feature (70)..(70): n is a, c, t, g, unknown, or other
  misc_feature (653)..(653): n is a, c, t, g, unknown, or other
  misc_feature (725)..(725): n is a, c, t, g, unknown, or other
  misc_feature (931)..(931): n is a, c, t, g, unknown, or other
  misc_feature (994)..(994): n is a, c, t, g, unknown, or other
nttagctttttntttttttttcattatgagtctgttctggtgaggtaggaggggtggatgtttttttttntttttggactccccgcggtggcggccgctctagaatagtggatccccgggctgcaggattcgtctccccctagaaaagtcggatatcatacgaaaaccctcgcggcgaggagcgctctccgtcccacacacgcgcgccgcagcctccgcagtccgcacctgcctccacgacttgtcgtgctcgtgcgctactctcctcgagcgcggcgcggagcacggggacatcaaatggcggcagcggcggagatcggtggtttcgcggcggcgagagtggcggtggcgacgctcatgccggctgcgcacccagccccggcggcggcaccgcagcagcctaaggagggcggtgggcggccacaattctcttgcggacaaacccgccacccaagggccgcttgaacgggcgggaattttccccccgggctccggaaccaaaaagggggaccccttggtggcaaatggacccccccgggaattgggaaaattaaggggtggggggggggggggctttttaaacaaaaggagggtgggaaagaaaatacatacactcacgcctttttctaccagacgaaaggacgggggacagncgggtttgtttataggcgcgtcggcgacgcaaatagagataagatcggcgtctttacctccacgccgggcgngcggggggtgtaggccaaggaaagaggatcaagcatcagaagacgcccttagtatcatggggagttgcgcccggtgggatgggggcgcggtggcgtacttcccgtccccgcattcaattgtgttggggagcgggctgggggtcgcacgcgcaccacgcaaacagcgaaaaacacaaacctcacacggcagctagccgcccgcttcnattggtggacgcgggaggcgtattagccctctgatggtgagtatgggagcagggagaaggggnactccgcatacgtcgcggttgcgggactattgtagcgcgcacggggatgtggacgggggaaggg

SEQ ID NO: 90110 - protein, 55 aa, Zea mays
  misc_feature: Ceres CLONE 1578004
MAAAAEIGGFAAARVAVATLMPAAHPAPAAAPQQPKEGGGRPQFSCGQTRHPRAA

SEQ ID NO: 90111 - DNA, 779 bp, Zea mays
  misc_feature: Ceres CLONE 1578005
  misc_feature: Encodes the peptide sequence at SEQ ID NO. 90112
ctcaccgcggtggcggccgctctagaactagtggatcccccgggctgcaggaattcgtctcacccctagaaaaaaactcgccgtctgccttctgcgcctccatttcggcctctgtcccttgcaagttcaatctcacctccaaccatgggtaaagagaagtcccacatcaacatcgtggttattggccatgtcgactctggcaagtcgaccaccacaggacaccttatctacaagcttggaggcattgacaagcgtgtgatcgagaggtttgagaaggaggctgctgaaatgaacaagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaagcacgttatgaagagattggtgaaggaagtctcatcctaaccccaagaaagttgggtacaaccctggataatatgccctttgttcccatttccgggttttgaggggcgacaacatggatgaagaggtcccccaacccttggac

SEQ ID NO: 90112 - protein, 197 aa, Zea mays
  misc_feature: Ceres CLONE 1578005
  misc_feature (5)..(191): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYEEIGEGSLILTPRKLGTTLDNMPFVPISGF

SEQ ID NO: 90113 - DNA, 775 bp, Zea mays
  misc_feature: Ceres CLONE 1578007
  misc_feature (485)..(485): n is a, c, t, g, unknown, or other
aaagctggagctccccgcggtggcggccgctctagaactagtggatcccccgggctgcaggaattcgtctcacccctagaaaaacccgtcctcctccatctgtaaccactcctcgtcatctctttcgcggtctcgcctcctgcagcctctcgcccagaaagggaaaccgcatctgctcccgtctcccgcctcggcgccgccgcctagtcgacctgagcccagactcccagagagggggggcgtcgaggccgtcgggcgctcaggtgagctcgaatggtgtgcaatttccgttgttcacttgctctcttctcgcaactcgttaaaattggcgtgtctcgggctcggctacccaattagcccttctccagcatccaccctgtgcgctgcgcgcgcgtgagttttctagctaggctgccgcagtagctgcagctgctgctggcctcagatcaagcaattcttgggatgtgctggcctcagaagcgccngtacttgcccctggaccaggccctgaattctgattccggattcccatcttccccctggttggaaaaccccaagttccctttacccccttcctttttccccaatttaaggtaggcccggccaaaaaattcccggggaaccccccggaaaaattccccccgaaaaataaggtggtggttttaaaaaaaaatttttttttttttgggggcgttttgggggtttcccccccacttttttttttcccggcccccccctctctccgaaaaaaaagagatttttttttccctttcct

SEQ ID NO: 90114 - DNA, 1085 bp, Zea mays
  misc_feature: Ceres CLONE 1578011
  misc_feature: Translation starting site: 241
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (19)..(19): n is a, c, t, g, unknown, or other
  misc_feature (737)..(737): n is a, c, t, g, unknown, or other
  misc_feature (875)..(875): n is a, c, t, g, unknown, or other
tgggggggggggnnntngnggggaggggtgggcggggagaaagagtatgtggtgagtttaactgaccaatgggtaaaaaccgaaacttcccgcggtggcggccgctctagaactagtggatcccccgggctgcaggaattcgtctcacccctagaaaaactctgactctcatctgaagcgcgcgagagaaacgcgtatacccaggcggcggttgaggaagaggaggagaagaagaagaagatggcttcctccgcatacgcctcatggtccaagcggtggatccgtcccgaggtgtacccgctgttcgtgccgatggccgtggccttgggcatctgctcgtaccatcttgtgcgcaacatcacgggcaaccccgaggtgcgcggtgaccaaggataagagggcggccggcgtcctggacaaccacgacgagggcgaaaggtacgctatgcaccgccccaggaagttcgggccgcgggggagaagccccaagattcagggcctaccatcaaactcctttcgtgtgcccgaaccctcccaaagggacgaattaatgcttggaatttcccgtccatggggatgggatggggaatggaatgggatttcccccaaaatcccggggagcggtccccaaagggaaggggtgttttaaccccttttagatttaaaacacgggccgcggaagggggatgtggcctcttggagagtatcacgaagaccccgcccctccctgccggggncacacatattttagttgtcttgtcgagcgtttcgccctgataaatgttgtctataaatttgtctcccccccctattataaaagtaatgtggaaccaaatatatcatagcggaaattttaggctccgcgagcgcccganaagaagaagaccaagcccaattgtgtccccctcgggtaaaaaaataagtgggctcattcccaaaatatttttctaatgtgatcgtaaatacaaatccccataaagaagacaacccaaaacgctttaaaaaacaacaaagtggggggcacctcccccccggtgacaggggggtcacgccttggaagaggcggggaaggagccgcacccgcc

SEQ ID NO: 90115 - DNA, 1093 bp, Zea mays
  misc_feature: Ceres CLONE 1578016
  misc_feature: Encodes the peptide sequence at SEQ ID NO. 90116
  misc_feature (1015)..(1015): n is a, c, t, g, unknown, or other
  misc_feature (1035)..(1035): n is a, c, t, g, unknown, or other
  misc_feature (1036)..(1036): n is a, c, t, g, unknown, or other
ttgtcgtgttgatgcgtggtaacaaaagaaagggagaacagtagaagagtgtcgggggggggaaggggaagagatagtggggctccccgcggtggcggccgctctagaactagtggatcccccgggctgcaggaattcgtctcacccctagaaaaaaaaaccccacttcatccgtcactccacgccctaaaaccctaatcgagaattcccgttgtcattcgtcagcgccccccactcaaccccgtctcagcctagcgcgccgccacaatgcaggccgccgccgccgtccgccacccgcgcctattcccgccgtccccgggcagctccgcgcagcaccggcgcgcacccagcaccgtgcgcatggcgctgcgcgaggacgggccctcggtggccatcgtgggcgccacgggcgcggtggggcaggagttcctccgtgtcatcaccgaccgggactttccctaccggggggctccgcctcctccccaaacgagcagtcccgcgggggaagcgcctccccttttgagggacgcggagtaccccgtccaaggacctccgcggccccccgggggcggttcgaacgggggtcaaacaaccggcgcttattcaagcgccccgggcgggaagcgctcacacccggaaagttttgggggccccccggggccggttcccccaggcgggggccccccgtaaatttttttgaaaaaaaacaagcttccccgcgttttcccgggaaagggggagccccccagaggggggggcccgcctctcggttcaattcccccccagaggggttcaaaacccccccaaaggggcccatgggggggagaaaaggttccccccctctccggggacaaggggggggcggaatattgtgtggggcaaaaatacccaaaaattgtgcctcgaaaacaattttatattggggcccccaagggggggggggcgaaaaggcccggttgtccatttggccaaacgggttaagggggggtataaaagaggaggggggtgtgtccanccccctttcctcaaagcggnnaaaaagggggggccctgtggtgctccccccccccaatggagaagaaaccccccccgg

SEQ ID NO: 90116 - protein, 109 aa, Zea mays
  misc_feature: Ceres CLONE 1578016
  misc_feature: SWISSPROT Homolog: EC 1.2.1.11 Aspartate-semialdehyde dehydrogenase
MALREDGPSVAIVGATGAVGQEFLRVITDRDFPYRGAPPPPQTSSPAGEAPPLLRDAEYPVQGPPRPPGGGSNGGQTTGAYSSAPGGKRSHPESFGGPPGPVPPGGGPP

SEQ ID NO: 90117 - DNA, 809 bp, Zea mays
  misc_feature: Ceres CLONE 1578018
  misc_feature: Encodes the peptide sequence at SEQ ID NO. 90118
ctccccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgtagccggcggctggtatggatcccattggcctcaaaactggaggccttttgctcccgtacatcgagaggcggtgcacgtcgccctcatccgtcattgtcatcggggggtgcatctcgggcgttgcaactgcccgtgccatctccaattcttcatttaaggtgactgttttggaatccgaaaaaccgtattggccgggcgccttcctactggataacccgtttgggatgccccatttgattttggggagccctcaggccttccccgggggggggccatggagaaatccccctgggcccccattggataacccttcccttggggcgggaagggttatccccccaaccaat

SEQ ID NO: 90118 - protein, 111 aa, Zea mays
  misc_feature: Ceres CLONE 1578018
MDPIGLKTGGLLLPYIERRCTSPSSVIVIGGCISGVATARAISNSSFKVTVLESEKPYWPGAFLLDNPFGMPHLILGSPQAFPGGGPWRNPPGPPLDNPSLGAGRVIPPTN

SEQ ID NO: 90119 - DNA, 893 bp, Zea mays
  misc_feature: Ceres CLONE 1578019
  misc_feature: Encodes the peptide sequence at SEQ ID NO. 90120
cggccgctctagaactagtggatcccccgggctgcaggaattcgtctcacccctagaaaaaaagttgttgtctcttccccacaacggcgagtttgagctgagctcacgctcgtgatctaactctcgcgccattcgcaatctaaaaagcttgcgcgctactcatctggtccattacttaggcactcagttctgcgagtgatcactgagcagccatggagaaatttggatcggaagttgcagcgcgactaatacggatgcatggacgaccgcgccgcaacctcgatgtgtctaggcggcgacgcgcacgtcctgctcctgccgttccctgggatgcagggccagtcgaacccgatgctccagcttggccgggggctgggcttccacggcctgcggccccacttggtgggctcccgacacgtgctctccaccacctcgagctccaggtcgtgccccatgcccgtgggccgacatctacggacgggttcgacgaacagggggaacttcctcatgggcgggaaaccggcggaagtactttgctccggaaagggaggcccccggggttcggaaaacacatggcgtggggccccccggtaacgcccgaagggcccggcccggggagcggacccggtccggaacgggtggggggtaacaaaatgggaaccctggcctaggggggcggggccccacgttgtggcccgagggcccccccggacttgggacagcccccccgcggtttccttgaaacctgaatggtggcggggggtggtggccttcccctaaaaggagggaaagttggggggccagggcccggggggggtccctggcaaccgtgggccggaagaggggtccccaacatagcgccgtgataaggcctccccccttgggaaacttag

SEQ ID NO: 90120 - protein, 111 aa, Zea mays
  misc_feature: Ceres CLONE 1578019
  misc_feature: SWISSPROT Homolog: EC 2.4.1.121 Indole-3-acetate beta-glucosyltransferase
MDDRAATSMCLGGDAHVLLLPFPGMQGQSNPMLQLGRGLGFHGLRPHLVGSRHVLSTTSSSRSCPMPVGRHLRTGSTNRGNFLMGGKPAEVLCSGKGGPRGSENTWRGAPR

SEQ ID NO: 90121 - DNA, 1035 bp, Zea mays
  misc_feature: Ceres CLONE 1578020
  misc_feature: Encodes the peptide sequence at SEQ ID NO. 90122
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
tttcttatttnnnnnntacagataggcaagggtagcgcaaaacgccagcgcgggggcccttctttctagttaaagatggggctccccgcggtggcggccgctctagaactagtggatcccccgggctgcaggaattcgtctcacccctagaaaaagcaccagaaacccgcgaatcaatcccgaatcccgatcgaccggcggcgcgggaggcgatgccggacaaggcggtggacgacgtcatggaggccgcggtgggggcccacttcagcggcctccgcctcgaggcgctgcgcctctccacctctgcgccctcttccccttcctcctcccccgccgccgcggcgcacacgcactccaacggagccgtctacgccaacggcaccaccgagcttacctctcctgccgctgcccggcagccattcatcatcggggtttctggagggacggcgtcggggaagacgacggtgtgcgacatgatcatccaccagctgcacgaccaccgtgtcgtgctcgttaaccaggattcgttttaccgagggcctttctgctgaagagtctgcacatgcacaagaccgataattttggatcaccctggaggcctgttgaatacatagccaactttcctagaaatggcatggggggaagctgaaaaatgtgcctccaaacctggttaaatggttgccctaatcatagggaagtgtccgaggaaagccactgcaaacgggggggtttccttgaaaaaggccctttgagaaaaaaggggtcccaaggggccattcccgaaatggctccctttaattttttggggaaggggccaatgttctaagggtggatcccgtggcaccccggagaagggtgccgccaagttctggatggggaacctttgaaaaaattttttttggtaggaacacaaaaatggcctgtacaccattaggggacttggcccccgaccggaatccaaaacgggggaatacacggttgaaaaccaaggaatggagaattcccgacctcccggggctctggacccaaataagg

SEQ ID NO: 90122 - protein, 112 aa, Zea mays
  misc_feature: Ceres CLONE 1578020
  misc_feature: SWISSPROT Homolog: EC 2.7.1.48 Uridine kinase
MPDKAVDDVMEAAVGAHFSGLRLEALRLSTSAPSSPSSSPAAAAHTHSNGAVYANGTTELTSPAAARQPFIIGVSGGTASGKTTVCDMIIHQLHDHRVVLVNQDSFYRGPFC

SEQ ID NO: 90123 - DNA, 790 bp, Zea mays
  misc_feature: Ceres CLONE 1578021
  misc_feature: Encodes the peptide sequence at SEQ ID NO. 90124
ctggagctcaccgcggtggcggccgctctagaactagtggatcccccgggctgcaggaattcgtctcacccctagaaaaagccgcgacacacgtacaaactgcagccatcaaaagccatggaaggccgcgcgcgcctctccctcctccacgtcgtcgccgccacagcgctggtggtcctgctgcaactgcatggcggcgccgtagtggttgcgtctgagccgccctacacctgcggcgccggcgcgccgcccaacatcccgttctacgacgcggggctgcccatcgaccggcgcgtcgacgacctcgtctcgcggatgacggtggcagagaagatctagcagctcggggaccagtcccctgccatcccgcggctcggactgccggcgtacaagtggtggtccgaggcgctgcacgggatctccaaccagggccgcggcatccacctagacagcccgctccgcgcagccactagcttcccgcaggtcatcctcaccgccgcgtccttcacccgcacctctggtacccatcgaacaggtgatcggcgtccagcaagggcggtgtacaacaacgggcaagccgaggggctcaccttcggggaaccaaacatcaaaatggttcccggacccacagtgggggccaccgggaaggagaacccccgggcgagggacccccacaaatgaccgggccagttacggccgcccgttcttcggtccggggggcggggaaagggcctaacgggccctccaccaggcccaccgtttaaattttccaaaggggacccttcaaagg

SEQ ID NO: 90124 - protein, 73 aa, Zea mays
  misc_feature: Ceres CLONE 1578021
MEGRARLSLLHVVAATALVVLLQLHGGAVVVASEPPYTCGAGAPPNIPFYDAGLPIDRRVDDLVSRMTVAEKI

SEQ ID NO: 90125 - DNA, 831 bp, Zea mays
  misc_feature: Ceres CLONE 1578022
  misc_feature: Encodes the peptide sequence at SEQ ID NO. 90126
  misc_feature (214)..(214): n is a, c, t, g, unknown, or other
tggagctccccgcggtggcggccgctctagaactagtggatcccccgggctgcaggaattcgtctcacccctagaaaaagttaggagtacacacttctccttagaattggagctgtacgagccacccagcaactttcttcatcatcttcttcagctctctctctgtccgtcgacacaccaagctagccatgcaggaggagtaagggtacaaccngtagaagagagagagagagagagagagctaacaccacccaccactgtccctagctagcttatttacaggcgttcgtgatcaccaacagcttctcgtcagaaagagtgcaacgggccggccgggcagaagaggtagctgggagctagagagaaaaaaagggtgcaccgacacccccagggccaggggaggaaggggaggagtgagccatcagtcgaccgtttccggcgaactcacaggcagatggcaggcggcggattcgtggaggacatgatgagggagcagagcctcctggaggcgacgtgcggcgacctcttcgaccacatcgacgacctcctcgacttccccaacgaggactccgccgccgccgtgctcctcctggacgcgccggcgcccgggagcccgctgtcggcgcgcatcatcgacgtcggccgcgccggctatgcgctcgtcccgcctgctgcccccgcgcagcacgacgcttccgctaagcgcttctttcgcgccgcgggggaacgatgtgttcgacaccaaggacgtcgtcggcgcaaacattcggctcgggcgaacgacattgaaatggaacatggcgcacctggaagtggctgtcgggggctctc

SEQ ID NO: 90126 - protein, 125 aa, Zea mays
  misc_feature: Ceres CLONE 1578022
MAGGGFVEDMMREQSLLEATCGDLFDHIDDLLDFPNEDSAAAVLLLDAPAPGSPLSARIIDVGRAGYALVPPAAPAQHDASAKRFFRAAGERCVRHQGRRRRKHSARANDIEMEHGAPGSGCRGL

SEQ ID NO: 90127 - DNA, 779 bp, Zea mays
  misc_feature: Ceres CLONE 1578024
  misc_feature: Encodes the peptide sequence at SEQ ID NO. 90128
  misc_feature (619)..(619): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
ctccccgcggtggcggccgctctagaactagtggatcccccgggctgcaggaattcgtctcacccctagaaaacagatccgtgttccgtgtccgcgtccagtgtgtccgctactccgctccccctcagtcctcagttcctcacctagcggtagcgtgcgcgcgggagacgtagatggcggcttcggaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgttttcctgaaagttgatgtggatgaaatgaagaccattgctgagcaattcagcgtagaggccatgccaacattcctgttcatgagggagggcgacgtcaaggacagggtcgttggcgcagcaaaggaagagctagcaaggaagcttgaactacacatggcctcgtagatcagtgatgccgtaatgtagtattcgcctaaataagaggacgcctcgcctcaactctngagaaactagtgcttctgtgaatgggaattcgtatgaaagagtgcccccctttgggggacctccttcgtatgggagattaacctcctgtgcttaaannnnnnnntngnnatttnnnttgaggaatagtaagaaaggaattaattcccccttccttccccc

SEQ ID NO: 90128 - protein, 128 aa, Zea mays
  misc_feature: Ceres CLONE 1578024
  misc_feature (21)..(125): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MAASEAAAAAATPVTPTEGTVIAIHSLEEWSIQIEEANSAKKLVVIDFTATWCPPCRAMAPIFADMAKKSPNVVFLKVDVDEMKTIAEQFSVEAMPTFLFMREGDVKDRVVGAAKEELARKLELHMAS

SEQ ID NO: 90129 - DNA, 870 bp, Zea mays
  misc_feature: Ceres CLONE 1578025
  misc_feature: Encodes the peptide sequence at SEQ ID NO. 90130
tccccgcggtggcggccgctctagaactagtggatcccccgggctgcaggaattcgtctcacccctagaaaaactccgatcgcccgaccgatcgccgagcttccccgttccctccccgccccccgcgacgccgcgacgccatggagctgccgcacgccgagcaggccgtcgccgctgtagcagcaggaggagagggcggcaccgcaagcccgggcaccgtcctcgaagggccggtgcttaggcgggggctggacggcggtggggaaggggaggacggggagctgggggcggggcaggaggcggacgcacggctaccggagcggcctggcgaggcggactgtggctactacctccgcacgggcgcctgcggcttcggggagcgttgccgctacaaccatccccgcgatcgtggtggcactgagtttggtggaggtaccaagaatggtgcagcacaagactttccagaacgacagggccaacctgtatgcgagtattatctgaagactggaacttgtaaaatttggttcccattgcaaatatcaccatcctaagcaagatggatctgtgcagtctgttatattaaacaacaatggattcccctctacgcctggggtggagaaagaatgctcctactatatgaaagactgggcaaaggcaagttttgggtccaccatgtaaatttcctccatcccacaaatttggggggtaattccggggaaccccctgggaaaataatccaccatttaccaattcccctttctggggccccccccccctcaaaacaataatggcttcccaaaatggggccaaaaggggagaaagaatcccccgggcagtgttcctctgggatacattaatattacccagggg

SEQ ID NO: 90130 - protein, 136 aa, Zea mays
  misc_feature: Ceres CLONE 1578025
  misc_feature (62)..(88): Pfam Name: zf-CCCH Pfam Description: Zinc finger C-x8-C-x5-C-x3-H type (and similar)
MELPHAEQAVAAVAAGGEGGTASPGTVLEGPVLRRGLDGGGEGEDGELGAGQEADARLPERPGEADCGYYLRTGACGFGERCRYNHPRDRGGTEFGGGTKNGAAQDFPERQGQPVCEYYLKTGTCKIWFPLQISPS

SEQ ID NO: 90131 - DNA, 739 bp, Zea mays
  misc_feature: Ceres CLONE 1578027
  misc_feature: Encodes the peptide sequence at SEQ ID NO. 90132
  misc_feature (593)..(593): n is a, c, t, g, unknown, or other
  misc_feature (599)..(599): n is a, c, t, g, unknown, or other
ctccccgcggtggcggccgctctagaactagtggatcccccgggctgcaggaattcgtctcacccctagaaaaagtgtcccgttcctcctcgcccaccaccaccgcacgccggacaaaaccgctctcctcgccacattcgcaggctcgcagccccccctcgctcgcgcacacgccacaccacaccacaccatcagtacactgctctacgccacagtacagcagcatccagcgggcggctggctgcctaatctctccagctctttcgtcccctcgccacgccgcccaccgctgccgcatcatccgcccgttgcccgccgtcgtcgcctggccagcggcttccgcccccattcgccgtcgcagcgcgccgagccccgtcccagatcgccgctgcgcttcctgccgccgtcggcgcggcgcagggttgaaatctatttgaccactcagttataaccatttctggtctgaagatgcttcgtcaatgacatctggaaactgtaatagtatgcgctgatcttctatgcttcaccacctgactatcaatgggctctttcctgtggaaacagcccagctacctcttcattttgataattcntcaccntgttgctcatgaggcaagaacgctgaagtcagatggtgaagcacttcttgccttcaagaaggcagttacaaatccagatggagtcttttcctaaatggcgtggagaaagatgcagacccctgcaatttgaaaggggtgta

SEQ ID NO: 90132 - protein, 50 aa, Zea mays
  misc_feature: Ceres CLONE 1578027
  misc_feature (18)..(18): Xaa is any aa, unknown, or other
  misc_feature (20)..(20): Xaa is any aa, unknown, or other
MGSFLWKQPSYLFILIIXHXVAHEARTLKSDGEALLAFKKAVTNPDGVFS

SEQ ID NO: 90133 - DNA, 1253 bp, Zea mays
  misc_feature: Ceres CLONE 1578029
  misc_feature: Encodes the peptide sequence at SEQ ID NO. 90134
tttgtcattttcagggggaactattcctttaaataccagagcgcgggccgggatggagcgcgcgggacaaactgggagctccccgcggtggcggccgctctagaactagtggatcccccgggctgcaggaattcgtctcacccctagaaaaaactccgatcgcccgaccgatcgacgagcttccgcgttccctccctgccccccgcgacgccgcgacgccttggagctgccgcacgccgagcaggccgtcgccgctgtatcagcaggcggagagggcggtgccgcatgcccggggaccggcgtcaaagagcaggtgcttatgcaggggctggaccgcgcctgcggatgcggatgacaggtgagctgggcgtgggccagggggcgagacgcccgggcaacccgatcggtccccgcgaggccggacctgggctgccaaactcctacccggggcccccgcggctgtcgggggagttttcgcgcgcgtagaatctccccccgccacactgtggtgcgccccagaaattgagccggccaggcaacccgaacccgtgctcttggcctcaatcgacttttcactcagccggatctggtgttctagcatggtgcggcgccagggatccttgctgatgttgatcccgctcagccgcgggtcgtgtgtcgggggtccacaggtatttttatacattaataatttccttctcttcgcgctcgacgtatcgtgaccataagattccgttccgcaccttcccccactacgtgtatagacacacgggtctgtggtgatgtttcgcggggcgtcgacactactactttaccagccgacctgaaattataagcgtatatatccgcttgttgcatgacgaagtcatcgtcgttcttgtggctcttccgcgacgcacacagtgagactgatagaggtccctaggaggacacgcgccgctcgctgtgaatcaattcttcgcacgatgacggctattgggcggctcccggagtactttagcgaggaaatgcaacccctcccatggggaatgccataactatccagacgcaaccaccagcccatacaaccagacacgagtctgttgtagccgcccggcacgcgcgcgaggaggcgccctaaggtgtgtccaacgagagacctgttccacgttggcgtggaataagaacgactggcgcaagtctcatatgtacttgtgtccctttccttcctgtgtttggcggcgagtggcgggtgcttgcgttattcgtagtga

SEQ ID NO: 90134 - protein, 66 aa, Zea mays
  misc_feature: Ceres CLONE 1578029
MPGDRRQRAGAYAGAGPRLRMRMTGELGVGQGARRPGNPIGPREAGPGLPNSYPGPPRLSGEFSRA

SEQ ID NO: 90135 - DNA, 781 bp, Zea mays
  misc_feature: Ceres CLONE 1578030
  misc_feature: Encodes the peptide sequence at SEQ ID NO. 90136
  misc_feature (501)..(501): n is a, c, t, g, unknown, or other
  misc_feature (522)..(522): n is a, c, t, g, unknown, or other
  misc_feature (548)..(548): n is a, c, t, g, unknown, or other
ctcaccgcggtggcggccgctctagaactagtggatcccccgggctgcaggaattcgtctcacccccccccctagaaaaaaaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgactccaaacagaagaggtactgcgagatcttcaagacgcaccttctgggctgccagtgcgtgatgctggcgagcccggaagcggcgcggttcgtgctggtgacgcaggcgcacctgttcaatgcgaccctacccgcggagcagggagcgcatgatcggggccgtcngctctctttctccatcagggngactaacacctccatctccagcaggntggatcaggggggcgctcgggaccggaaagggactgcggacgctccatcctttaggtggaaagccgccgatgacggtccactcttccctttcctggggaaacccggcaccgtcaaaaagaacgtttccacctccatgaaaaaccctgttccttttgaccttgggcatcctgggaaataccttccgggggcccgggtctggaaaaaatggggcaaaggccgaaaacctaaaaaa

SEQ ID NO: 90136 - protein, 217 aa, Zea mays
  misc_feature: Ceres CLONE 1578030
  misc_feature: SWISSPROT Homolog: EC 1.14.13.93 (+)-abscisic acid 8'-hydroxylase
  misc_feature (124)..(124): Xaa is any aa, unknown, or other
  misc_feature (131)..(131): Xaa is any aa, unknown, or other
  misc_feature (140)..(140): Xaa is any aa, unknown, or other
MAFFLALVCILVLLAIASYVQYTRWQKGKGRFGGHGRSAPLKLPPGSMGWPYLGETLQLYSQDPSVFFDSKQKRYCEIFKTHLLGCQCVMLASPEAARFVLVTQAHLFNATLPAEQGAHDRGRXLSFSIRXTNTSISSRXDQGGARDRKGTADAPSFRWKAADDGPLFPFLGKPGTVKKNVSTSMKNPVPFDLGHPGKYLPGARVWKKWGKGRKPKK

SEQ ID NO: 90137 - DNA, 788 bp, Zea mays
  misc_feature: Ceres CLONE 1578033
  misc_feature: Encodes the peptide sequence at SEQ ID NO. 90138
  misc_feature (653)..(653): n is a, c, t, g, unknown, or other
ggagctcaccgcggtggcggccgctctagaactagtggatcccccgggctgcaggaattcgtctcacccctagaaaaatgtagcccaacgagaagagcggcggcgcgggcggacaggagctgtgccaagccacaatgggtatctcacgcgactcgatgcacaagcgccgtgccaccggtggaaagcagaaggcctggaggaagaagcgaaagtatgagcttggtcgccagccggccaacaccaagttgtcaagcaataagacagtgaggagggtccgtgttcgtggaggtaacgtgaagtggagggctcttcgccttgatactggtaactactcatggggaagtgaagctgttacccgcaagacccgtatcctcgacgtggtctacaatgcatcaaacaatgagcttgtgaggacaccaaccccttgtgaagagtgccattgtgcaaattgatgcttgccccattcaagcagtggtacctcactccctatggaagttaaacttggtaggaaaaaaaaaaaccccctgctgcaaaaaaaggaaaatgctgaaggaacaaaagttgaaggcccccccctaaggaaaaggaaaaaagagccaccccttgtccccagaaacctttgaaaaccccaagggaggggcccacccccttgngccccccacctttgagggaacatttttggcccggggaacggttgcctggccatgccttttcctcccccccccccccaacagggggccccccacactcgatggggccccaccccgttgagaggggaaagagacttg

SEQ ID NO: 90138 - protein, 105 aa, Zea mays
  misc_feature: Ceres CLONE 1578033
  misc_feature (1)..(97): Pfam Name: Ribosomal_S8e Pfam Description: Ribosomal protein S8e
MGISRDSMHKRRATGGKQKAWRKKRKYELGRQPANTKLSSNKTVRRVRVRGGNVKWRALRLDTGNYSWGSEAVTRKTRILDVVYNASNNELVRTPTPCEECHCAN

SEQ ID NO: 90139 - DNA, 800 bp, Zea mays
  misc_feature: Ceres CLONE 1578034
  misc_feature: Encodes the peptide sequence at SEQ ID NO. 90140
ctccccgcggtggcggccgctctagaactagtggatcccccgggctgcaggaattcgtctcacccctagaaaaaatttcttcccagaccaacctgtgcttatattaaaatatagcatcccccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaaccccggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtggggaacaagttctgctcctgtcgtcacgcgaacgcggtccactcgcaggggcagtgaccgtgctgcttgctgcgacggcgacggcgaggatcctggggtccccggcttggctagcgaaaaatctcgacgaggccctcccgtccctggttcctgttcccccactgggaaaggctt

SEQ ID NO: 90140 - protein, 210 aa, Zea mays
  misc_feature: Ceres CLONE 1578034
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKPRGNSSGIPVLVDEDDPLALESFLNITLVNKAGRSVSLKMDVSRAYFVAYVAGQRSCLLKRSGRTFSSAICYYGGPWGTSSAPVVTRTRSTRRGSDRAACCDGDGEDPGVPGLASEKSRRGPPVPGSCSPTGKG

SEQ ID NO: 90141 - DNA, 797 bp, Zea mays
  misc_feature: Ceres CLONE 1578036
  misc_feature: Encodes the peptide sequence at SEQ ID NO. 90142
  misc_feature (75)..(75): n is a, c, t, g, unknown, or other
  misc_feature (527)..(527): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaancaaagctggcgtcagtcagtctgacagctcagctcctcccgacctccctatatctctgctcccccaaaccctaatccctggcataacacaacaatctctctcccctcactccctctctgcagcgcgcagctttcaaagcgttgggagagatggcagaggagacgcaaccagaggccgccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaaagcacctggtgaatgacctgcccgacccggagaaagaagcgctcgacgaagtcaagcagctgatcgctgccgccctcgccgcaggtgaagtcaannctgctcccccgccgccgccgccgaaggccaaggagacaaagggggaggaagccaagcccaaggagccccccaaaaagaaccagcggccaaggcggaagccacgggcgaagacctcaaggcccaggtggctgcggatgcccccgtttgaggaaggcaaaaccggagggccccccggccaaagaagccaaggctgaaaacctgggcggaagaaaccaaaacctttccaagccccacccccaagaaaaaaaccggcccggggcccctgaggg

SEQ ID NO: 90142 - protein, 165 aa, Zea mays
  misc_feature: Ceres CLONE 1578036
  misc_feature (101)..(101): Xaa is any aa, unknown, or other
  misc_feature (102)..(102): Xaa is any aa, unknown, or other
MAEETQPEAAAAAAAPAAAEVVVTEAAPAEAEVPAAAEAEAEAKDEKKGDEAELTADDAGVGTGSFKEEKHLVNDLPDPEKEALDEVKQLIAAALAAGEVXXAPPPPPPKAKETKGEEAKPKEPPKKNQRPRRKPRAKTSRPRWLRMPPFEEGKTGGPPGQRSQG

SEQ ID NO: 90143 - DNA, 768 bp, Zea mays
  misc_feature: Ceres CLONE 1578039
  misc_feature: Encodes the peptide sequence at SEQ ID NO. 90144
  misc_feature (569)..(569): n is a, c, t, g, unknown, or other
  misc_feature (576)..(576): n is a, c, t, g, unknown, or other
ctggagctcaccgcggtggcggccgctctagaactagtggatcccccgggctgcaggaattcgtctcacccctagaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgatgaggagcgccacacgcagcagatgcagtccatcagtgcgtcgttggcgtctctgacgcgtgaaaccgggccgaaagtggtcaagggcgacccggccgcgaatggcgatgccgccgcgcatggcgcgccatcgacgccgagggcgcatcagcagcaccgccaccccgccgccccccgncattagncgtcagcgacagctccctcaagttcactcatggtgctcaacaacctctcgccgtgctgagctgttcaagcaggcccatcaaggtccaagaagggggccgttcctcacgtccacccggggccgctgggcaaacctgttccggggcccaagaccggggcgggtccccccagggaccagcgcggtcgtcaaggga

SEQ ID NO: 90144 - protein, 135 aa, Zea mays
  misc_feature: Ceres CLONE 1578039
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISDEERHTQQMQSISASLASLTRETGPKVVKGDPAANGDAAAHGAPSTPRAHQQHRHPAAPRH

SEQ ID NO: 90145 - DNA, 1108 bp, Zea mays
  misc_feature: Ceres CLONE 1578042
  misc_feature: Encodes the peptide sequence at SEQ ID NO. 90146
  misc_feature (1)..(1): n is a, c, t, g, unknown, or other
  misc_feature (2)..(2): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
nnttgtttttttnnnnnnngtagggggaggggaggggagggggtgggaattataggataagtggcnnnccgagggggggggtaaactggagctccccgcggtggcggccgctctagaactagtggatcccccgggctgcaggaattcgtctcacccctagaaaaaagggtttcccccctctgatttcccctcctcctcacgctccccctggctccccaagcctcgacgcccagctagggttttgcctccttcccgccgccgctgtttcagcgagcgagaccgaggggtagacaaagagcagtgcttagccacccatgtcgctgcgtccgagcgagcgggtcgaggtacggctgaaccactccaaggtggcggttgactcgtacgacgggcggctgcggcgcaagcactatatggtggagatcctcatgagccgccgcgaggagagcctcctcaagaggcgcggcgaagggggtccaagccgaggtccctgcccctcccgtcagggggtcgaaaagaagctttgaaagcctccccagcctatgggttagtgggggtttatttcgggaaggaaaaataaccccgtcaagcctgggaggggccaaccacaacagggttcccgacgaaaattcgcgtcctgccttttgggagggaagggaatttccccccccccaatccgggaaaaggaaaggtctttatttccaagagaaacacgggggtgggacacaggttctctccccaaagagaaattttttgatggttgtgcccaggatccctctccccctcccacccccaatataacaggggggaaatttgtgcccacccccccacagcccctggaaaaatgtgttttcgcaaaagaccctgggccaagggggtggctccctttcacaaaaaaaatttagtgggggcttcccccgggccaactcttttccggggaaaaattaccccaaaggggtgggtggtttgtgggaatccacggtgaaacctggggtccccttatatttgggggaaaaaccttctcttggggccctgggtttaggcaatagaagttttcattgtaaccaaagcttttttggggcctttttgaagaaattgtccccctcgcctt

SEQ ID NO: 90146 - protein, 69 aa, Zea mays
  misc_feature: Ceres CLONE 1578042
MSLRPSERVEVRLNHSKVAVDSYDGRLRRKHYMVEILMSRREESLLKRRGEGGPSRGPCPSRQGVEKKL

SEQ ID NO: 90147 - DNA, 905 bp, Zea mays
  misc_feature: Ceres CLONE 1578043
ctccccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctccgtcccgctcccggccgccgtcccttctcataatcgcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaggagtacacgtatctccacctcgtgctttcgcacaatgggggttcgacgtggcggcatcaaccgtctttcttagatcaaccatctccggggggagacggtttgaaagtctttcaaaaccctttttgacctcttttggctggtctccaattttttttttttaacctggccaagggaaaaacaaagtggaaccttctgggggggcattaccccccccccccccatacggtaagcattaacacagggaaacagaatggggcggaaacattaaaaggggaaaaggttctcttttggccaaagtattgaaaaatgggggaaaaatgctttggggcaaagggaacactttttgccaaagggtttaaccaaggtctggaaaaaacggggagaaattttggaaagagggcccccgatacaaaagggatttgaaaaagggagaagggtttttt

SEQ ID NO: 90148 - DNA, 1101 bp, Zea mays
  misc_feature: Ceres CLONE 1578044
  misc_feature: Encodes the peptide sequence at SEQ ID NO. 90149
  misc_feature (415)..(415): n is a, c, t, g, unknown, or other
  misc_feature (846)..(846): n is a, c, t, g, unknown, or other
  misc_feature (854)..(854): n is a, c, t, g, unknown, or other
  misc_feature (865)..(865): n is a, c, t, g, unknown, or other
  misc_feature (866)..(866): n is a, c, t, g, unknown, or other
  misc_feature (878)..(878): n is a, c, t, g, unknown, or other
  misc_feature (952)..(952): n is a, c, t, g, unknown, or other
ctggagctccccgcggtggcggccgctctagactagtggatcccccgggctgcaggaattcgtctcacccctagaaaaaacttgcaccggcttgctgctagcttgcgacaggactaggaggagctagccgaggaggaggtgtgtgactccatggacgcgggccagcaggatgcgtgggactgggactgggaggtcctgctgccagaccacaggagctcatcctccgtgcgcgaccaccacggcagcaacaataatacccttgacgatccagaacaagcagaggagctcgaggtgctgctgcctacccggggacgggacaagctcctggagcggccccacgacgagtgccgggatctcggcaggggccgccggcgaagggcggcagaagtccgtatatagagcccccccggggccnacacaaaggggcatacagaaaatgaccccccatgcaagaggtggcgccccccgatatatgaggggggccttggaaagaaggtgcggtccggggtatatcgtcagacgggaggtacgaagtggagccttatgtcgcgacaaggccgcccataggtgatatctggggggggggggtcgtgggacggctgtgccaccctaatgtgctgaggcgtgggaaaccagtatggcgacgtctgtaggaaccgtttatgatacaaggagggatctttcgcgactcgcgcgccaggccatagggggcaccgggagagttgtatgaacaatggagggagatccggaccacaagatgtgttgtggatggagcgggatctcgcgatgagcgagcactcatcgtccctgtttgtatccacctcgcggcagattcggcaatctganccgcaaanggagagggganngagcttctttgntttctatagagagggcggtgcgtgagtgaaccgtgggccatgcgtttatcgattggctgtcgtgggtaaggttnttgtgctgcagagaacgatcctctgggtgcaggaggaatattgagcctcataggcgccagtcaggaatggggagcagatgagacgcggtgtgttgtgacctaatacatcgaggtagagctcgctgttgaaggaacgaatgtggttgccg

SEQ ID NO: 90149 - protein, 82 aa, Zea mays
  misc_feature: Ceres CLONE 1578044
MDAGQQDAWDWDWEVLLPDHRSSSSVRDHHGSNNNTLDDPEQAEELEVLLPTRGRDKLLERPHDECRDLGRGRRRRAAEVRI

SEQ ID NO: 90150 - DNA, 1026 bp, Zea mays
  misc_feature: Ceres CLONE 1578046
  misc_feature: Encodes the peptide sequence at SEQ ID NO. 90151
  misc_feature (62)..(62): n is a, c, t, g, unknown, or other
  misc_feature (63)..(63): n is a, c, t, g, unknown, or other
  misc_feature (68)..(68): n is a, c, t, g, unknown, or other
  misc_feature (498)..(498): n is a, c, t, g, unknown, or other
  misc_feature (511)..(511): n is a, c, t, g, unknown, or other
  misc_feature (548)..(548): n is a, c, t, g, unknown, or other
ggggggggtggggggggttgcgcacaactcacgaaacaacgactatggataggagaataacnnccccncgtgtttggttgataggtgggactccccgcggtggcggccgctctagaactagtggatcccccgggctgcaggaattcgtctcacccctagaaaaagttccgctcgctcgcccgccaccgagagacgacactctacgtgtgtgcctgcgagagcgagagcgcaccagcagagcagacagcttcctctgcggcctgctggtcgcttcgcttcgctccagtccagggcaaaggacggcacatggcggggggcgggggcggccgggacctgccgtcgacgccgacgtgggcggtggccctggtgtgcgccgtcatcgtgctcgtctccgtcgccatggagcatggcctccacaagctcggccactggttccatacgcggcagaagaaggccatgcgggaggccctggagaagatcaaagcagagttgatgctngatgggcttcatnctcgctgctcctcggccgtgggggcagacgccccatnctcccaagatatggcatccccgggccaaagggctgggcaagcatcattgcctgccccgtggcaaagccggcccgaaataggggtccgggccggcccggcccgcccgaacggaaccgaccaaaagaaggcggtaccgggcccggccccggggagaaacttcccctccgggggggttacccccgggccccgggtaaccccctgtgggaattaccggattggaaggcccccggggggcaacccaaacccgggccgggtttttcccttccggcccgggggggccgggcgcttccccgggaaacgaacaaaacctacccggggcgaggtggaacccaaaagggcaaaggggtgggtcccccttcattccttcccttcgggggcgcggggggtcccaaccaaggcctggcaaacattctttccatcctttccggggcctccgcgggtggtttcccaattttcggcctaaacagggggtcgcccc

SEQ ID NO: 90151 - protein, 234 aa, Zea mays
  misc_feature: Ceres CLONE 1578046
  misc_feature (69)..(69): Xaa is any aa, unknown, or other
  misc_feature (81)..(81): Xaa is any aa, unknown, or other
MAGGGGGRDLPSTPTWAVALVCAVIVLVSVAMEHGLHKLGHWFHTRQKKAMREALEKIKAELMLDGLHXRCSSAVGADAPXSQDMASPGQRAGQASLPAPWQSRPEIGVRAGPARPNGTDQKKAVPGPAPGRNFPSGGVTPGPRVTPCGNYRIGRPPGGNPNPGRVFPFRPGGAGRFPGKRTKPTRGEVEPKRAKGWVPLHSFPSGARGVPTKAWQTFFPSFPGPPRVVSQFSA

SEQ ID NO: 90152 - DNA, 813 bp, Zea mays
  misc_feature: Ceres CLONE 1578047
  misc_feature: Encodes the peptide sequence at SEQ ID NO. 90153
  misc_feature (464)..(464): n is a, c, t, g, unknown, or other
ctcaccgcggtggcggccgctctagaactagtggatcccccgggctgcaggaattcgtctcacccctagaaaaaatggtggctctgaagtcatctgttaaccgatggatttggtcgtcgaaagcgtcgttcatgggcgcttacccgtcaggccatcaaggtttcctcttctgcccggctcgttgccctccactaccgtggcactgagtgctgccttttccggacgtccatgcccacccattgttcgtcggaatgccccagcggtggtgccatttgccaagaagaagaggaatgaatatatcgaagatccgccagatgaggaggtcgcagatgatttcaccgacgagttggaggaggacttcgacgacgccaaagaagacgaaggcggtaatggatccccccaactcggtgatgtttgtttttcctgtttgggatttccggctgacttcctgtgggacgactggngattgtggtccctgcagtttgctccatttatatgctcccctcatctgattgttcgcactgtgatgcatcccctctaaaattttagtgagaagcgttttgcgcatctgttccttttcatgggcctgtgtcctatcgttcactatgaatcatccctgctagcaaggggggtggtaccattctctacccccggaataccagttatcccacaaatgcaaattcctccattttgttcaaaaaaaaatgcagttcgccggcactttgtggagacctaaatccccccaaaattgggggaaaagtgccctggaactcttgggaaaaccattaacccttccttgggaaggtttttcct

SEQ ID NO: 90153 - protein, 145 aa, Zea mays
  misc_feature: Ceres CLONE 1578047
  misc_feature (121)..(121): Xaa is any aa, unknown, or other
MDLVVESVVHGRLPVRPSRFPLLPGSLPSTTVALSAAFSGRPCPPIVRRNAPAVVPFAKKKRNEYIEDPPDEEVADDFTDELEEDFDDAKEDEGGNGSPQLGDVCFSCLGFPADFLWDDWXLWSLQFAPFICSPHLIVRTVMHPL

SEQ ID NO: 90154 - DNA, 853 bp, Zea mays
  misc_feature: Ceres CLONE 1578048
  misc_feature (618)..(618): n is a, c, t, g, unknown, or other
ctccccgcggtggcggccgctctagaactagtggatcccccgggctgcaggaattcgtctcacccctagaaaaagctgcagagcctgcagaggcttttcttccccccaccacacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttgctgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctcacctggttcgatttcttcatttcgggttcgattcggtttttctatcccagagcgaaagatcaatatcacctgacacaacataaccgatttcgtggaagccgaggttgcttctctgctcagtgggtggataactgggattgtggnattttgctaactacatgctggggttatcagccctttcttaagggaaaccaaagaagagaccaccaaggcaattttgtttgtctctttccttaggaagctgggcgagtacttcggcatgggcaaatgcttagttccgaggaactgacaccttccaactggttttaggacatgggatgaataaggatccaaaagtttaaaaaaattgggacagagtgggaagcttttggccccctgg

SEQ ID NO: 90155 - DNA, 1147 bp, Zea mays
  misc_feature: Ceres CLONE 1578049
  misc_feature (12)..(12): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (31)..(31): n is a, c, t, g, unknown, or other
  misc_feature (33)..(33): n is a, c, t, g, unknown, or other
  misc_feature (68)..(68): n is a, c, t, g, unknown, or other
  misc_feature (69)..(69): n is a, c, t, g, unknown, or other
  misc_feature (79)..(79): n is a, c, t, g, unknown, or other
  misc_feature (993)..(993): n is a, c, t, g, unknown, or other
  misc_feature (1147)..(1147): n is a, c, t, g, unknown, or other
gggggggggggntttttttaannnaatagtnangtaggtggattgggggaggtggtggggtgtttttnngtggtggggntcaaaactggagctccccgcggtggcggccgctctagaactagtggatcccccgggctgcaggaattcgtctcacccctagaaaaaagacccagagcaccctcggcggggccgccgccagctgtggcggtagccgtggcatccccaagggtttcggctccgtgaacatggacgagctgctccggagcatctggaccgcagaggagacccaggccaaggcctccgcctctatcgcaggagcgagcgcggggatgccccccacgccgatgcagcggcagggatcgtcgctcacactgccccgcatgctcagcaccaagacggtcgacgaggcgtggagaaatctcgtgcgcgacgaaccgccgcagggggcggacggcggtggacaccagccgccccaccgccagtcaacgctcgggggagatgactctgggaggagtttcttgggtcaaaagctggcgcgggtcaaaggaagaaccccccgcctttctggttccctccaagcagccgcccacccccatgggtggcccccccgccggggccgggtaaaccctgttttgcccccccttaaaaaaaacttccccccccctttttttttttgggggggaaatttttaccccggggggttgggccgcgaaccgaaaccagaaccccccagagccttttcccggtggcaaggcgcgcggggtaaaaggaggggttttttgtggccacacccccggaggttccgggggggaaaattgtggtgttggggggaatctcctgtgtgggcccccctctgtgggaaaaaccccgcggcccccaacaatgggggtccgggggccaaaggggggcctatttggggtggaaaaaggcacaacaaccgcgcccccctttgtgtggcctttgtggtggacaaaaaaaaaacaaacccggggntataaagacacccacaacacttttggaaaattctcctatctctccgcgggggaaaaaagggggagatataccgagggtggagaactctcggtgtgttccgcttcccccccttataaaacgggaagacccccccacaaaaaaacttttttttttn

SEQ ID NO: 90156 - DNA, 789 bp, Zea mays
  misc_feature: Ceres CLONE 1578050
  misc_feature (57)..(57): n is a, c, t, g, unknown, or other
  misc_feature (437)..(437): n is a, c, t, g, unknown, or other
  misc_feature (559)..(559): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (663)..(663): n is a, c, t, g, unknown, or other
tccccgcggtggcggccgctctagaactagtggatcccccggggctgcagggaattncgtctcacccctagaaaaaatcctcgcccgcaacaccatttccgaacgggtcgcgcccgagcccgatatgcccgcgaagcccaggcccagccagacccaaagcgatgcgacggagatcgtgagatcgcgcgccgcagcctcctcccccgcccccgccgccggcgatgacctccgcagtcctcgccggccggaatgaggtccaccaggcgcatcagcaccaccgccaatgggctggcgcccgcgtcccgctcatgcccaagccgtcctccaaccctaaccctaggcgccaccgcgcgggcccaaaccctatccccagtggctcgccgccggagccgcgggccgctccggccgtcgcggccgagccctcgccgtccgcctcnggggcacctgaacttcaagccgtcggaaatgaccccccgcgagggccgggaactccgcgcgcggctcaccagcaagctctgccgcgtccgcgcttttctctcccgcattgactcgtgcaganggggggcaagccccccgnnnnnnnggnnnnggaggccccccggggggggggccggggcccccgcccccgggcctgggggaggaggaaatgggaaaaagggggancagaaaacccatctacgccgccccgggaaggtgaaaaaaaaaacgggtggggggaaaaaaccccccggccggaaagggggggggggcgcagaagacgggggggagagaagcgggggcacaagcggg

SEQ ID NO: 90157 - DNA, 816 bp, Zea mays
  misc_feature: Ceres CLONE 1578054
  misc_feature: Translation starting site: 418
  misc_feature: SWISSPROT Homolog: EC 2.3.1.41 Beta-ketoacyl-acyl-carrier-protein synthase I
  misc_feature (739)..(739): n is a, c, t, g, unknown, or other
ctccccgcggtggcggccgctctagaactagtggatcccccgggctgcaggaattcgtctcacccctagaaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagtttgtttcttcggcaccgagccatcgcacggccgcccccgcatctcgtcctgctctcaggtccttggcctccgccgttcttcgacaggggcgcgacccggtgcccactccgcgaaatccgagtccctcgtgcagctccgtagggtggaagagatccatcaggcggtgagcggtaggaggcgcccgtacaactgagggggcgggcaatggcggccgtggcaggcccactctgcacgtggctcgttgccgcgtgcttgtctgcggcttgcgacgcagaagagtacaagcataagcattgctgcctcggcgcgcggcgtcgcggcttggcgcgctctggaatggctatggctgttgccttacaagctgaaaagaagtgtcattgaaaagaaagaactcgatatcaaacaaaggagggtggttgtcacaggcatggggtgtagtgacaccattgggccatgatcccgacgtcttttacaacaatcttcttgatgggtgtagcggaaatagtgagatagagaggtttgactngttccacttccccacgagaattgcaggagagataaaatccttttccactgaagggttgggttggacctaaaccttga

SEQ ID NO: 90158 - DNA, 761 bp, Zea mays
  misc_feature: Ceres CLONE 1578055
  misc_feature: Encodes the peptide sequence at SEQ ID NO. 90159
ctggagctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtcgagcgcgtgcgcttttccaaggacggcggtctgctccagctcaccggcgtcgacggccgccgcgccaccgtcgtcgtccccaacgaccccgacctcatagacatcctcgccaccaaacggcgtcgacatctccctctcccaagggcgagtcgggcgggcccgggcgggtttcgtcgcctttcgtcggggaacctccctcttccccttttattcgggtttcccttgggcctctttcttccttctttccggcgt

SEQ ID NO: 90159 - protein, 203 aa, Zea mays
  misc_feature: Ceres CLONE 1578055
MAPPSVSASHLLITASLPKPKPSSLRPPRLPLAKPLPASAALLALAASPALAADAPAPAPAPTPAPAPELQAEAPTPTVNPFSSSLLTAPKPSAAASDLPEGAQWRYSEFLSAVKRGKVERVRFSKDGGLLQLTGVDGRRATVVVPNDPDLIDILATKRRRHLPLPRASRAGPGGFRRLSSGNLPLPLLFGFPLGLFLPSFRR

SEQ ID NO: 90160 - DNA, 930 bp, Zea mays
  misc_feature: Ceres CLONE 1578063
  misc_feature: Encodes the peptide sequence at SEQ ID NO. 90161
ctccccgcggtggcggccgctctagaactagtggatcccccgggctgcaggaattcgtctcacccctagaaaaaactccaactcctcgattctcagagtgctgtacaagtgtctcgccctaccgcggccgtcaaaaatccgatctttccgccgtttccggaggccacacggctgcaagactgaccaatcccccgcggatcgagccgcagacgccagcagttcctgctcgcggaccgcaggcggggcccggacggagcatggggtcccgatccgccggcgcggcgctgcggctgtggctgctggcgctcctgctgggctgctgccaggggaggttcgtggtggagaagaacagcctcaaagtgacggcgcccgacggcctcaagggtacctacgaaccccccattggcaacttcggggtgccccaatacggcggcaccatggtcgggcttcgtcgcctaccccaaggcccacagggaaggcctggcaagaactttctacgaacttcaacatctccctacaaaggcccaagccccgggtgcggtttcccccaccttttcctggctccgttcaaaaggggggaagaattgggttaccttccccaaaaagaaaggggcttgtgatatgtccccccaaaaaagccaggggaaccaggccggccaaatcccctttggtttgcccgaagtgaaccaaaagaaccaaaccctccttaatttaccaagggggacaaaaccccttgagggagggggtgggggaaccccgggaatttattttagaggaaacaatcccctttttccctttgggggggttaaaaaacccaaaaaacctttggggggaaaagggccccccagaaaagcaaatcctacacgcggggggaaacggggttaaatgggaaatttgggaaggggaggggagaccccggccccaccctgg

SEQ ID NO: 90161 - protein, 120 aa, Zea mays
  misc_feature: Ceres CLONE 1578063
MGSRSAGAALRLWLLALLLGCCQGRFVVEKNSLKVTAPDGLKGTYEPPIGNFGVPQYGGTMVGLRRLPQGPQGRPGKNFLRTSTSPYKGPSPGCGFPHLFLAPFKRGEELGYLPQKERGL

SEQ ID NO: 90162 - DNA, 944 bp, Zea mays
  misc_feature: Ceres CLONE 1578065
  misc_feature: Encodes the peptide sequence at SEQ ID NO. 90163
ccccgcggtggcggccgctctagaactagtggatcccccgggctgcaggaattcgtctcacccctagaaaaaacaccaacccagccatggccaaggcagctcctcctctcctcgccgccggcagccgcactgccatcacagcgcagcagccatcgtcgaggaaaggcgccgctggcaccggtttgttctgcagtcgcgccatcgtcagcaagcgcaccagggtaacagcgaagctcggagacggagagctgaagcctgcaggcaagcggaagttcatcaccaaggaagaggagccagaacagtactggcagaccgcgggggagagggagggggagaaccccatgatgacacccctgccctacatcatcatcttcggcatgtccacccccttcgtcatcctcgccatcgccttcgccaatgggctggatcaaggtccctgtggcgatgaacggaaacgcgatcagccagccctggaatcatagatgcttgactcgttaagcctggcatctcattccagcgggggtgtccttggcaacttttgtacccttccagtatataggaggaccaaaagtttccttgggggggggaacaataattggcaaggaatccccgtggggggttatgtcaaccccgaaaaccgggttttaccttttttccggaaaaaaactttcaaaatcttttacctcctttcaaaaaaaaaacacgaggtccccaaaccaacttggaagggtaaattcccccccctgcatttggggggggcaccccaaatccccccccccgttgtttgcgaacgggaaatccctttggggacacacccgcccttcctaaagcccaaagatttggtttcggccccctttgaaccatttttcagaaaaatgtggggggaattccacaaagaggaacggcacaatctcgtcctcttagagaaacacagtatgttattg

SEQ ID NO: 90163 - protein, 131 aa, Zea mays
  misc_feature: Ceres CLONE 1578065
MAKAAPPLLAAGSRTAITAQQPSSRKGAAGTGLFCSRAIVSKRTRVTAKLGDGELKPAGKRKFITKEEEPEQYWQTAGEREGENPMMTPLPYIIIFGMSTPFVILAIAFANGLDQGPCGDERKRDQPALES

SEQ ID NO: 90164 - DNA, 861 bp, Zea mays
  misc_feature: Ceres CLONE 1578067
  misc_feature: Translation starting site: 88
  misc_feature (10)..(10): n is a, c, t, g, unknown, or other
  misc_feature (69)..(69): n is a, c, t, g, unknown, or other
  misc_feature (142)..(142): n is a, c, t, g, unknown, or other
  misc_feature (147)..(147): n is a, c, t, g, unknown, or other
  misc_feature (150)..(150): n is a, c, t, g, unknown, or other
  misc_feature (156)..(156): n is a, c, t, g, unknown, or other
  misc_feature (197)..(197): n is a, c, t, g, unknown, or other
  misc_feature (199)..(199): n is a, c, t, g, unknown, or other
  misc_feature (205)..(205): n is a, c, t, g, unknown, or other
  misc_feature (231)..(231): n is a, c, t, g, unknown, or other
  misc_feature (234)..(234): n is a, c, t, g, unknown, or other
  misc_feature (316)..(316): n is a, c, t, g, unknown, or other
  misc_feature (394)..(394): n is a, c, t, g, unknown, or other
  misc_feature (403)..(403): n is a, c, t, g, unknown, or other
  misc_feature (409)..(409): n is a, c, t, g, unknown, or other
  misc_feature (415)..(415): n is a, c, t, g, unknown, or other
  misc_feature (450)..(450): n is a, c, t, g, unknown, or other
  misc_feature (457)..(457): n is a, c, t, g, unknown, or other
  misc_feature (478)..(478): n is a, c, t, g, unknown, or other
  misc_feature (489)..(489): n is a, c, t, g, unknown, or other
  misc_feature (509)..(509): n is a, c, t, g, unknown, or other
  misc_feature (522)..(522): n is a, c, t, g, unknown, or other
  misc_feature (560)..(560): n is a, c, t, g, unknown, or other
  misc_feature (582)..(582): n is a, c, t, g, unknown, or other
  misc_feature (584)..(584): n is a, c, t, g, unknown, or other
  misc_feature (618)..(618): n is a, c, t, g, unknown, or other
  misc_feature (746)..(746): n is a, c, t, g, unknown, or other
  misc_feature (783)..(783): n is a, c, t, g, unknown, or other
ctccccgcgntggcggcccctctaaaactagtggatcccccgggctgcaggaattcgtctcacccctanaaaaaaaccaacccagccatggccaaggcagctcctcctctcctcgccgccggcagccgcactgccatcacancgcancanccatcntcaaggaaaggcgccgctggcaccggtttgttctgcagtcncnccatcntcagcaagcgcaccagggtaacagcnaanctcggagacggagagctgaagcctgcaggcaagcggaagttcatcaccaaggaagaggagccagaacagtactggcagaccncgggggagagggagggggagaaccccatgatgacacccctgccctacatcatcatcttcggcatgtccacccccttcntcatcctcnccatcnccttcnccaatggctggatcaaggtccctgtgcaatgaccntaacgcnatcagccaccctggatcatanatgctgactcntcagcctgcatctcatccancgtgtgtcctgcnactttgtaccttcatatatagagacaagagttcttgcntgtgagcataattgcatgatcncntggtgtatgtaacccgaaactgtttaccttttcncaacaacttcaatcttccactcttcaaaaaaaaccacgccccaaccactccaacctcaatcccccctccaattgcgggcaccccagtcccccacctggtggcacgcggatcccgttgggcccgctccnccttctttaacccccaaattttgtttggcccccttcncccttcttccaaaaattggggtggatttcccagaaattcgggccaaacctgccctaggggcaccggggggggtcgggg

SEQ ID NO: 90165 - DNA, 919 bp, Zea mays
  misc_feature: Ceres CLONE 1578069
  misc_feature: Encodes the peptide sequence at SEQ ID NO. 90166
  misc_feature (412)..(412): n is a, c, t, g, unknown, or other
acacgcggaggcggccgctctagaactagtggatcccccgggctgcaggaattcgtctcacccctagaaaaagcgctgcttcgctggctttcggcaacgccctttaccacatctgaatctcacccacccacccacccccgcgtcccccacctcatggcgccggcgatggggctgaagcggcctgcggcgggagcaggggcggcagcagcgcagaccgtcacgctgtccgcgcctgccgtgcgggacgcggtgcgcaccgccgtaagggaggccgaggccacagcgaaggctaccgccccggccgccagggtcccggcgacggcggcagtgccggcggagatcgctagggatggggtgctgtgcctggaggaggtcgaccggaggcggtggagcccccccccccacaccaccnggggcgcggttaaagccaaaggaaagggcgtccggtcggcgggcgccttcaaggggcgtccccgcgtccagtccccgaaggccggcccggtcgaggaaaatcatgggccctttataaagatcattatgtttgtggccccgaaaggcttttccagaaaagtggtcccaccctttcctatggttcccactaactgtacacggggaaaggcctttgaaagccatttttctttggggggaaaccaaagggggggtgtttttaaaaaaaaaggaaacctgggcttcgaaactcggtggggaaagtcccccccaaaaacaagggacgtcgcattctggggggccgtgggggccctattccacccggggaattctccaaaggaaatggcgggcattgggccgcttttttggaaaaaaaaatgtttttttgttccccccccccaggggggaaagaaaaaattgtattttaggggagcccggaaaagcacaactctccccccttttttttgggggg

SEQ ID NO: 90166 - protein, 255 aa, Zea mays
  misc_feature: Ceres CLONE 1578069
  misc_feature (87)..(87): Xaa is any aa, unknown, or other
MAPAMGLKRPAAGAGAAAAQTVTLSAPAVRDAVRTAVREAEATAKATAPAARVPATAAVPAEIARDGVLCLEEVDRRRWSPPPHTTXGAVKAKGKGVRSAGAFKGRPRVQSPKAGPVEENHGPFIKIIMFVAPKGFSRKVVPPFPMVPTNCTRGKAFESHFSLGGNQRGGVFKKKGNLGFETRWGKSPPKTRDVAFWGAVGALFHPGNSPKEMAGIGPLFWKKKCFFVPPPQGGKKKLYFRGARKSTTLPPFFWG

SEQ ID NO: 90167 - DNA, 796 bp, Zea mays
  misc_feature: Ceres CLONE 1578070
  misc_feature: Encodes the peptide sequence at SEQ ID NO. 90168
ctccccgcggtggcggccgctctagaactagtggatcccccgggctgcaggaattcgtctcacccctagaaaaaactcacctccctgtctctcttctccttccctcccgcggtggttataagacccctccgccccgtcctctcctctcctctctgctcccgtcgatctgccatcctctgcctgccccgcttgcgcggcgcgtctgctctagtgatttgagacggagatccccagagattgaggagagggagggaggcgccggggccggggagcggcggcggcgagggatggacggccacggcggcggggcgggggccggcaagctgacgcggacgccgtcctcgctgctgcgctcgcccacggtgcgcaactgctcctcgttccaggccgtggttgtcgacgacccggagcccgacgacaagaaggcgcaggcgcaccccaagcccccgccccaccacttgcaccccggtggcggccccgcccacccgcggctcgtcctcgcgctcccgctcgccttcctgctcgtgctgctcctcctccgcggcggcggcgacggccaccacctcgccctccttgcggcgtccgcggccgtcgcgctcgccgccgccgcgggggccgcgcgcctgctccggggacgtctgcgccgctcgccaggctccggctcggtccagtggttcatcggggacgacgacgacaagccgcagaagcgggcggactaagccgccgcgccgcacggccgcgtcgtgcgggaaggcgtcgagttctacagcaatggggactgctacgagggcgagtt

SEQ ID NO: 90168 - protein, 143 aa, Zea mays
  misc_feature: Ceres CLONE 1578070
MDGHGGGAGAGKLTRTPSSLLRSPTVRNCSSFQAVVVDDPEPDDKKAQAHPKPPPHHLHPGGGPAHPRLVLALPLAFLLVLLLLRGGGDGHHLALLAASAAVALAAAAGAARLLRGRLRRSPGSGSVQWFIGDDDDKPQKRAD

SEQ ID NO: 90169 - DNA, 744 bp, Zea mays
  misc_feature: Ceres CLONE 1578071
  misc_feature (240)..(240): n is a, c, t, g, unknown, or other
acccgcggtggcggccgctctagactagtggatcccccgggctgcaggaattcgtctcacccctagaaaagtcgcgtagccgctttcacacattcggtctccttcgccgccgcctatactcctgcagaaatagccccagagcgaaggcggttgctgcttcttcgtgttccttcgcccgccgcacacgggatccatttgaccgatcgaccgacccacacacaccgagagccagccatgggngcaaaaccacagcgcgcaggacgggagcggccacggccggcgctccttccagcagcagccgtcggcgcagtggggcgccggaggaggggggtactacgcccaggacccgaacgccggctactgcggcgcgccggtgccacaacaggggaggaggggtacgccgcgcccttacctgcccccggcgtaccagtaccagcccaccgccgctgctccggcgccgcaagtcgcgaaaacgcggcagctggaccggcggtactcgcggaatgccgacgactttcactcgggggaccaggttactgaagctctagctcaagccgggactggaaccccaaatcttattggtgggggtgtgattccccaaaaaaccaaccgagggggacaggcaaatttcccttttccgggggaacgtggtccccccttcccttttggccaaacccccccaaaacccggttttgaaaaaaacccccccccccgaaatttttggggggggaaaaaacccttttg

SEQ ID NO: 90170 - DNA, 1219 bp, Zea mays
  misc_feature: Ceres CLONE 1578072
  misc_feature: Encodes the peptide sequence at SEQ ID NO. 90171
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
ggttggtgtgnnngnccccgtggagggaacaaaggggggcggtagaccaggggggcgtnnntaaaaagtttaatactggagctccccgcggtggcggccgctctagaactagtggatcccccgggctgcaggaattcgtctcacccctagaaaaaaccgccgccgccgccatcctcgacccctgaagtgaagaggcaacccgaggacgcctctcccatccacgcgcgaatcctaccgccctcccactcccaaaaacctagccgcgcgcgccacctgcatcccatggcggcaaccgcggccgtggcggggaccgggtcgtccctctcctcgcgccgcagtcgcagcgttgtctcctcgtccttccgcgcagctgcctcgcgcttccgctcgccgagatgcgtgctcgggagcgagcacctgcgggtggcgcatgaagggaagcggatgagcggcgccgagtccaggacctcgtgggcgcccccccgtgcccgcaccgggagtccagggctggccgcacctgcccaaggggagctgccggtgactccagggaaggaaagatctttcgcccgggcgaacggcttaaaccggtcccgcttccccctcagggaaaaattggcccggcgtttaaccctggggggaaataagaaacctcccgggcaaaggaaatcccgtggatataaaaggccggccttttgggcctttgatggggggaggaaaaagaattttgagggggtgggccaaaacacctggcgacaaaaaaacgacaagtccctttgatgcacgaagagggaaatattgggtcacaaactggtggggggtcttctccttcttgagagaaacccccgcggggcgcccccagaaagtgtggtggccttctcttactcctcggtgtgtacaaaagccgcgaaaataacaccccctcaaatgtgcgaggagagctgtcttctgtccgcagtaccaaaagggaaattgtgcgattggcactatgggcccggggtggcggggtgccttgtttccaagcagcgcggggacctctaattatacgcggcggtgggggtaaacttccgccgcgagccgtggggggtctcgtaggcgcccggggtgccatgactcggggaaaaggggtctcttaggggggtcgtggaaaacaccctatatcactggtccaaaaacgttgggggtgtcgaagaattatccttgtgtcgggaggagggggagg

SEQ ID NO: 90171 - protein, 164 aa, Zea mays
  misc_feature: Ceres CLONE 1578072
MAATAAVAGTGSSLSSRRSRSVVSSSFRAAASRFRSPRCVLGSEHLRVAHEGKRMSGAESRTSWAPPRARTGSPGLAAPAQGELPVTPGKERSFARANGLNRSRFPLREKLARRLTLGGNKKPPGQRKSRGYKRPAFWAFDGGRKKNFEGVGQNTWRQKNDKSL

SEQ ID NO: 90172 - DNA, 739 bp, Zea mays
  misc_feature: Ceres CLONE 1578073
  misc_feature: Encodes the peptide sequence at SEQ ID NO. 90173
ctcaccgcggtggcggccgctctagaactagtggatcccccgggctgcaggaattcgtctcacccctagaaaaagtctctctcgatccccaaatctctcgcgctctatggaagtcgctctataggatccccaaatcgacggaatcactgctcgcggacggcggcctcgatccgcgctcgcgctctacatggaaggcctcgatccgcgctcgcgctctacatggaaggaggtgacagcggcgtttttttctgattgcgcacggactcgcgctcgcccttactcctccgcctccactagctgacccggctctagatctggacctcaagttcgagtcctcgctcaaggccatggtgctactgcagcgctccgtcgcggcagtgggagctacccttcaaggacgacatctcctccatggaggacaaggtggatgagaggctcagcaaggccatggtggtggtggcgtggtcgacgtatcggcatgacagcatcggatgagtggcgccgacggggtgctaggcggaagagcgtcaccatcagctcgaagttgtcgtagagccagaactgcatctacctccacggcaccatcggtaaggacctcttcacacacaagtaggtcgtccagctctctatgaagatccggggccagagtcgacgatggagtccgagagggcgccatctctcctccctcgctcgttgggccaatggaaacgcccacccccgccatccgcgccggtcatga

SEQ ID NO: 90173 - protein, 41 aa, Zea mays; identical to SEQ ID NO: 81391
  misc_feature: Ceres CLONE 1578073

SEQ ID NO: 90174 - DNA, 841 bp, Zea mays
  misc_feature: Ceres CLONE 1578074
  misc_feature: Encodes the peptide sequence at SEQ ID NO. 90175
  misc_feature (481)..(481): n is a, c, t, g, unknown, or other
ggagctccccgcggtggcggccgctctagaactagtggatcccccgggctgcaggaattcgtctcacccctagaaaaaactcgcacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctggcgatccagtctctggtccccctcttgtnattcatggatagggatctgcatattgctaaacaacacaagacatggattttatgctggttttggtggcgcctcatataggtgggggagggcagctcctcaacagtaaggggaaacgtgcctgataagttggaaaggaaaccagtatcgtactggacccttatggaaaagttatcttcaaaaacaggttgggaacaagcccaaacattgggagggggtttatccccccaagcccggcctgggaaaaatggggggggttccccggggccatttaggggttttgccaaccaaaagggccgaaaaaaaaaaaaaaaaaccggggttttggggggtggtttttctcccacaagagggaggggggc

SEQ ID NO: 90175 - protein, 95 aa, Zea mays
  misc_feature: Ceres CLONE 1578074
  misc_feature (70)..(70): Xaa is any aa, unknown, or other
MGGGNGETTQLGEPLLAKKAKAYRPRCPGCRVDRLNAEREGVFPLKDLFLIWLVTITCTLAIQSLVPLLXFMDRDLHIAKQHKTWILCWFWWRLI

SEQ ID NO: 90176 - DNA, 790 bp, Zea mays
  misc_feature: Ceres CLONE 1578075
  misc_feature: Encodes the peptide sequence at SEQ ID NO. 90177
tccccgcggtggcggccgctctagaactagtggatcccccgggctgcaggaattcgtctcacccctagaaaaaaacccccctcatcctcgcacatccgattgtgccctgtgctctgccgttctcttatccaagatttcgctggcggcggctcagggagcgaacaaagattgttttttttttttcgggctatggagacgaggcctgattcattcaggcccgggcggtggagtggcttcctgaccgggtctgattcgtattggttcaaatgatctgggcggcttaattggttgcatccgcttccgccggggaatcggagctagggctgtggtttgttggccggctggtggatttgtcggcttgggtctggtgagatctggagggtttctggttcagcgcacgggccgcaggtctgcgtagatcccctcttcgattccgtggcggatttgtttagggttttggtttgagtctggtggaacatgattaagcagatccttggcaggctgccgaggaagccggggaaggctggggatagccgggaagctgctgctgcggggaatggaactgagccgtcgaattcctacagtgttgtgaggggcatggacccagggaacaagaggggctgaaatggagactatccagttccatctggtctaacttctaacccaatgatgaatggggctgtggtgtatcactcccgtgagccgttaccggcattcaaggattgtgccggcatcagaaaaacagaatttgtttgtcaagaagggtgaaccttggctgggctggggatga

SEQ ID NO: 90177 - protein, 48 aa, Zea mays
  misc_feature: Ceres CLONE 1578075
MIKQILGRLPRKPGKAGDSREAAAAGNGTEPSNSYSVVRGMDPGNKRG

SEQ ID NO: 90178 - DNA, 784 bp, Zea mays
  misc_feature: Ceres CLONE 1578076
  misc_feature: Translation starting site: 155
  misc_feature: SWISSPROT Homolog: EC 1.4.1.2 Glutamate dehydrogenase
ccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaagatgctggggtgattgctgggcctaatgtgctgcgtatcatcaacgagcccacagctgcagctttcgcctatgggtcttgacagaaggctaccaggtgtcggggaagaagatggtcctcatctttgatccttgaagggggg

SEQ ID NO: 90179 - DNA, 1301 bp, Zea mays
  misc_feature: Ceres CLONE 1578078
  misc_feature: Encodes the peptide sequence at SEQ ID NO. 90180
  misc_feature (20)..(20): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (73)..(73): n is a, c, t, g, unknown, or other
  misc_feature (74)..(74): n is a, c, t, g, unknown, or other
  misc_feature (992)..(992): n is a, c, t, g, unknown, or other
  misc_feature (1021)..(1021): n is a, c, t, g, unknown, or other
  misc_feature (1143)..(1143): n is a, c, t, g, unknown, or other
gggggggagggtcaactcancctggcctgccgtataacatcaccaatcagtcgcgtntttnnnnntttatttnnaaaaaaaaatggagctccccgcggtggcggccgctctagaactagtggatcccccgggctgcaggaattcgtctcacccctagaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaaccctcggtacccatcgccaggttccggggacgaagggattcatggggaaagcccttgctgccgggcgctggatgttgtccatggattgggccagattcggggcggtcggttttctaacttcttgccctaaccttccgtcggcccgaataagaggtttggtccggtgggacccaccacgaagccacccaaccgaaattgaaccgaaggccacgttcacccttggttgtgggtaaggttccctccaaagagcgcgggggcgggggggtgttccgggttttcgacacctggggattaaaccatctccggagagaaaaacaccccggtttcacagagggggggggaaagaagataaagcgccctcgttggcggactcaatgggggggggcctacctcctctagagagaaaaattccccccccgcccccggggggggtccgccgcctgcggatagagggggagaagcagaatataccacgtgcggtnggggggaggaagtagacccccccttgtgngcgcgggggaaagactggtgttgctccccccctcctcaaagagtagattatcactggtggggtcgctcaaagaaagagggccacaccctctcctttggaagcgttttctagacttcgagagntgtagacgccccccacaagcttctctccccctgtgggtggtgagacagtggtgaaaataggaaacccactctcctcgaggacaccaagggggacaaattttttttctgtcaactcgacccccgagagaaaccccggagcgcaaaagcaataaagagat

SEQ ID NO: 90180 - protein, 136 aa, Zea mays
  misc_feature: Ceres CLONE 1578078
MASETETFAFQAEINQLLSLIINTFYSNKEIFLRELISNSSDALDKIRFESLTDKSKLDAQPELFIHLVPDKATNTLSIIDSGIGMTKSDLVNNPRYPSPGSGDEGIHGESPCCRALDVVHGLGQIRGGRFSNFLP

SEQ ID NO: 90181 - DNA, 730 bp, Zea mays
  misc_feature: Ceres CLONE 1578079
  misc_feature: Encodes the peptide sequence at SEQ ID NO. 90182
ctccccgcggtggcggccgctctagaactagtggatcccccgggctgcaggaattcgtctcacccctagaaaaaagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagatgcgccgtgaggggctccaagcccaggtccctgcccctcccctccggggtcgagaagaagcttgaaagctcccagctatggttagtggggttattcggatgataataccttcagcttgagggcacaccagtccgcaattgctcttatagagagaatccccccatccgagagtatcaaaacagggggagtcccaagatttgggccagctcctcaccgaaaggatttccccccccctccaatttgaaacctccatgggccccccaaaatatggcgttcggggacttcaaaaaaaaccaaagggtggtttttggaacagggggaccgttccccatattttggggaaacctcctggggggccgggggag

SEQ ID NO: 90182 - protein, 68 aa, Zea mays
  misc_feature: Ceres CLONE 1578079
  misc_feature (4)..(68): Pfam Name: IBB Pfam Description: Importin beta binding domain
MSLRPSERVEVRRNRYKVAVDAEEGRRRREDNMVEIRKSRREESLLKMRREGLQAQVPAPPLRGREEA

SEQ ID NO: 90183 - DNA, 846 bp, Zea mays
  misc_feature: Ceres CLONE 1578080
  misc_feature: Encodes the peptide sequence at SEQ ID NO. 90184
  misc_feature (800)..(800): n is a, c, t, g, unknown, or other
  misc_feature (801)..(801): n is a, c, t, g, unknown, or other
ccccgcggtggcggccgctctagaactagtggatcccccgggctgcaggaattcgtctcacccctagaaaaaatcggaccgccagcagtcgccagccccacgcaaggcagatcagcgagcagctatgggaatagagactccggcgatggcggtagcgctgctggcggcgctggtcgcttccgcggccatgttcatgttggcggggaccgcgcagcgcgtccccggaagaggggatccggccgctgtccaagatccccgtccacatggtcaccgtcgaaatgcatccgtcagcgtacgtgcgggcgacaccgtcgctcctcggcgagcatggagaagacaccgagtgcgtgaatgtgaacttcggctggaaagagccgtcagacgacgactggatcagcgtcttctctccgtctgaattcaactcgtcggactcatgtccgtactcatggtcagcataataaccctatctctgcacagcacccatcaagtatcagttcgccaactactctgcgaactagatctactggggctaggggagcatccggatggagctcatcaactagcgctccgacttgtacttcggcctcttcaacggggggactcacaaacccgtggctgatcgcgagggtcagaaccccatatctttcaagaacccccaaggcgcctgtgtttcccgccccctgacgccagggctccctcccccaaccaagattacgggggacttgggacccccaggctacaccctctaattgaggctttccccattccgtgaaaatggggcgcccctgtcgctgaaaggnncccccagagggggagattgggaactccgtcaaaccccgaaaggtg

SEQ ID NO: 90184 - protein, 64 aa, Zea mays
  misc_feature: Ceres CLONE 1578080
MVTVEMHPSAYVRATPSLLGEHGEDTECVNVNFGWKEPSDDDWISVFSPSEFNSSDSCPYSWSA

SEQ ID NO: 90185 - DNA, 827 bp, Zea mays
  misc_feature: Ceres CLONE 1578081
ctccccgcggtggcggccgctctagaactagtggatcccccgggctgcaggaattcgtctcacccctagaaaaaaaaaccctttggtctcctgtcctctcttcgtccaccgcgtcgtcgtctccctccctccgtccccgcacccaccgttatatacaacccccgtcgggactacactcaccaccgcgcctcgaatccatcgctcaactactcgaacccgactcaccggcgcctactcccgcctggctcccgggcccattcgtcgacccgtcgccgggcgaaagcgcgccactaaggtctccaacctccgcccgttgaagcgacggcgccgcatcggaggaactgtagctgttagtccgcctcttctcggcagcgcggggcggagatccgaccggacttgggatcgattccttcccttttctcgggaggcagtaaatagtgggctgtttgtttcccgaaaatttgaagggggttcagctgaacccacgagttccctcacgttaagcccgccgcacccggttcggcgaccgatctggctgaattgaaactgcttggtttgcagattcagggcgctaacagttcctgagggaagcttctggggacatggacatggcattgcccgttgggaatgccacagcggcggtgctcgcccgtgtctcggctgccttcaatggcccccttgccccgcgcagtcgtctttgggggtccatatttgatggtcacttgggtcgtgggagggccttctttattggcagccataggggtcccagcctcttccggggaagagcttaccaaacccacccaaagaaggccccctcccctgaaaaa

SEQ ID NO: 90186 - DNA, 971 bp, Zea mays
  misc_feature: Ceres CLONE 1578085
  misc_feature: Encodes the peptide sequence at SEQ ID NO. 90187
ctcaccgcggtggcggccgctctagaactagtggatcccccgggctgcaggaattcgtctcacccctagaaaaaggcaccgcacttcacaccccaccaaccttctccccccctgaaaaactatctaccccaccccaaaccacccctacccgccgacgagcgcgatcgattgattcgtttcgcgccgggcggcggcggagggagcccaccagatccggctaccgccgcggctacgatgaagtcgctgctgccgcggagcgagctgcggcgctcgtcggcggccgccgtgcggtcgtcggccggcggcgccgcggggggagacggtgctgtggccgactgcggcgggaatgggccgcgagcgcccgcctcctccaccttctgggtcctgctgcacgcgcctctgctgcggtcatctcgttttttccgcgggttttccggctttttcgcggtctccctctttctttcattgggtcttggtcctgcgaccggggactcgttccctactcccagcattcaatcccgtccctccaataaggtaggggtgggtcccgtgtcgcctggccatccgaacccagaaatacgggaactcaatttaatgcggtgtccatcccactcccagcccctttctgttgggtggaacccgctcacctattaatttccctaattacaattgctccgcatcaccgcctttttggggggggtgggctgtcgtttgactatgattcctcccgccccgttctggggagtgctcggggggttaataatcctcgtatcaggagggggcctatgagaggtgtgagagcttcgggttttaaagttcctttatacaatgaccccgcactcgtttctgttgttttttgggtgtaaacctacctcaagataagcttgcctcccgttttgatcgctcgggggtgggacgagggttggttgttggaattttccgtggcgcggtggggccccgtcaccttgaag

SEQ ID NO: 90187 - protein, 139 aa, Zea mays
  misc_feature: Ceres CLONE 1578085
MKSLLPRSELRRSSAAAVRSSAGGAAGGDGAVADCGGNGPRAPASSTFWVLLHAPLLRSSRFFRGFSGFFAVSLFLSLGLGPATGDSFPTPSIQSRPSNKVGVGPVSPGHPNPEIRELNLMRCPSHSQPLSVGWNPLTY

SEQ ID NO: 90188 - DNA, 1064 bp, Zea mays
  misc_feature: Ceres CLONE 1578087
  misc_feature: Encodes the peptide sequence at SEQ ID NO. 90189
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (183)..(183): n is a, c, t, g, unknown, or other
  misc_feature (922)..(922): n is a, c, t, g, unknown, or other
nggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnncccaannntnttccaagctggagctccccgcggtggcggccgctctagaactagtggatcccccgggctgcaggaattcgtctcacccctagaaaacttcagagctgttcagggaacacaacacactggggaacggagagggacaccggcgccatcgcaagtacgcactcggattggggagcgacagaggaggcgcatccctgttgcctcgccagctccgtgactctctctctctcctctcccggtgcaagcaagcaagcaagctaggcttggacaacgacgacgacgatggcgtgcgggtctcgaagcccgaccaacgagatggttgacgagtacgagaagctggttctcagaatgaaccctcaaagggtcaccgtggacaacaactccgacatgactgccaacctggctcaggggggacagcgccaaaaaattacgggaccctggctggaaggggggtcagggtgctaaccccatctgaaagctttcccattaaagcggggccttaaattttcctccacaaggggaaaagggtttcatgggaacgtgttcccctgtcccgggggaatcgggggggggggaaaaaaatttttttaaaattggcccaaattcctcccccaaaaaaaatttaaaacccgtcccccggggggagagggggaaatccctctcaattttctccccgggggcccccccaaaaaaaagggggggggtgggcccctttaaagacccaaaaaccccaaaaaaaaaanccaaaaacaccacccctttaattggggtggggggggggggaaaaaaccgccggggggcctttttttttaaaaaaaaggtttttcccggggggggggggggggaccccctgtgggggcacaccccgggggggggcgggggggg

SEQ ID NO: 90189 - protein, 60 aa, Zea mays
  misc_feature: Ceres CLONE 1578087
MACGSRSPTNEMVDEYEKLVLRMNPQRVTVDNNSDMTANLAQGGQRQKITGPWLEGGSGC

SEQ ID NO: 90190 - DNA, 785 bp, Zea mays
  misc_feature: Ceres CLONE 1578093
ctggagctccccgcggtggcggccgctctagaactagtggatcccccgggctgcaggaattcgtctcacccctagaaaatctcatggagagttcgatcctggctcaggatgaacgctggcggcatgcttaacacatgcaagtcgaacgggaagtggtgtttccagtggcgaacgggtgagtaacgcgtaagaacctgcccttgggaggggaacaacaactggaaacggttgctaataccccgtaggctgaggagcaaaaggagaaatccgcccaaggaggggctcgcgtctgattagctagttggtgaggcaatagcttaccaaggcgatgatcagtagctggtccgagaggatgatcagccacactgggactgagacacggcccagactcctacgggaggcagcagtggggaattttccgcaatgggcgaaagcctgacggagcaatgccgcgccgtgatggaggcggctacggcggtggcggtggcggctacagaggtggtcgtggaggctacggcggcggcggtgggggatacggtggtggaaaccgcggcggcggctacggcaacaacgacgggaactggaggaactgagcggtggggtccgcttaggcctagttatcttgttcgcttctgctaccgtgttcaccctagtctagagggggtttatcttcgtctgtggtcgtctcgtgtccgtttgttttcgtttcgtgttccattgttggttgttgccccatctggttgttttttgacccccctctatatattttatacacaaaaatattc

SEQ ID NO: 90191 - DNA, 832 bp, Zea mays
  misc_feature: Ceres CLONE 1578095
  misc_feature: Translation starting site: 315
  misc_feature: SWISSPROT Homolog: EC 2.3.1.119 Icosanoyl-CoA synthase
ctggagctcaccgcggtggcggccgctctagaactagtggatcccccgggctgcaggaattcgtctcacccctagaaaaagcaatagcccgtccccgccgccggattcgatcccgtctccggccgacgcgaccatttcccgcaccgccagatcctctcggctcggcccggccgccgcgcacctcccgcaattacagcgaccgcaataccagcaacgcctcctccacaaacggggcgggccgaggatccattcagccagtccacgcctttgactcgcactccgtttccagatctacgcgggcgggccgaggaacgatggacggagtctccgccccgccgccccaccggcggctgccggacttcctccagagcgtgaacctcaagtacgtgaagctggggtaccactacctcatcacccacctgctgacgctgacgctgctgccgctgatcgccgtgatcctgctggaggccgggcgcaccgacccggacgacctgcgccagctctggctccacctccagtacaacctcgtgtccgtgctggtcctctccgccgtgctcgtgttcggcgccaccgtctacgcgctcacccgcccgcgccccgtctacctggtcgacttcgcctgctaccgcccgcccgcgcacctccggggtccgcttcgaccagttcatgcgccactgccgcctctgcggcttctccgacgaagcgctggagttccagcgcaagatcctggaggcgctcggcctcaagcgaggagacgtacgtccccgaggccatggacggggcttccgcccccagccaccaatgtccaaacgcccgcgcccaaggccgaggt

SEQ ID NO: 90192 - DNA, 1169 bp, Zea mays
  misc_feature: Ceres CLONE 1578096
  misc_feature: Encodes the peptide sequence at SEQ ID NO. 90193
  misc_feature (822)..(822): n is a, c, t, g, unknown, or other
ggggggatggattttttttataataaaacggagtaatgcggcgccgtttctatacaacaaagttaaaataaaaagctgggactcaccgcggtggcggccgctctagaactagtggatcccccgggctgcaggaattcgtctcacccctagaaaaaacccggaccaccccccacaccacgtagtgccgtgccgcactgctgtcctgcaatctcccataaactcactcgcctcgcccacccgcccgcctgtccctccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcggggcgggacccctggggcgggccgctggagatctccaacgccgactcggcgacagatgacgaccggaaccgggacctggaccgggcggcgctgaagccggcatctggacgaaaacgcccccagagctgggctccttggccggggccccggcgaacaaggcggggcaagaaaaaaaaaaaaaggttaccttccgaccctgggggctggcatttcggtcgtccgaaaaccgccaagaatcttttccttggtggggaaccggttcggggccacccaatctccttccgggggccttccgggggggtctcttttcctgtcgcgggcttttgcactcccccgatggagggggaattccccgtctcaaaagcgggtttagggaagtcccccgcgccaaaaantaaaggtggagccccaggggccgagccccggatttggggcatgtgtctccgaggacccaagcttacaccaccctccccggggctcccctttgacaacaacaagggggcgcgcccccaagggtgtgtgtcttttaaaaacgcgcgctagaagacggaaatccccggggtttgccctctttgttcccaaaagcgccccaaaaaggggcagctttaaggcctgggggagggggggggacaattatcccttgccaaagaaaagggagagggggccctccatctcagaaaagagccccgttccccccccccggaaatctttgggtaccggagagcggtttataaaaaagaag

SEQ ID NO: 90193 - protein, 68 aa, Zea mays
  misc_feature: Ceres CLONE 1578096
  misc_feature (20)..(20): Xaa is any aa, unknown, or other
MEGEFPVSKAGLGKSPAPKXKGGAPGAEPRIWGMCLRGPKLTPPSPGLPFDNNKGARPQGCVSFKNAR

SEQ ID NO: 90194 - DNA, 829 bp, Zea mays
  misc_feature: Ceres CLONE 1578098
  misc_feature: Encodes the peptide sequence at SEQ ID NO. 90195
  misc_feature (544)..(544): n is a, c, t, g, unknown, or other
  misc_feature (735)..(735): n is a, c, t, g, unknown, or other
ctggagctccccgcggtggcggccgctctagaactagtggatcccccgggctgcaggaattcgtctcacccctagaaaaaaaacccactcgccactcttatccacagggccgcgcaagcgctctggcttcttccagtccagtccaccatccgcgccatggcgatggcgttcgcggctgcctccgcctggagcctcagtcttacagccttctccctcccgctgccccagtctctgcgcccgaaacctagccaactcctccatggcgcgaccagctcgttcccgcggccacgccgatgcgggtggggcgccgtggtgcgctgcgcgaagcgcacggggaagcagcggtacccgtcggagaagaagcggttgaacaggcgaaaacaggagttgctacgccaggccgccccggaggaggggagcaaggggcgggagtccgggtactggcggctctcgaagctcgctgttcccgcccgcgacgacccaggcaaggacttcaccggcatctccctgccgctactccaggccatcgccaaagccatcaagntcccggttccttctatgctccctgacgaggcattcactgtcatccgcaagtccatttgacgcacgaaaggttttgaaagaccctcagtgcactatattgttgatatggatgttaagaagaatcttaataatgagccagggcatgggattttatttgctcggtgggagcccaaacctgggagtgttggactncatgacccacaaaaagttaacatttgatcttggccacccctgttaaaccaaaaagtcgggggaatttggggcaccatgggagttaaaacaaatt

SEQ ID NO: 90195 - protein, 148 aa, Zea mays
  misc_feature: Ceres CLONE 1578098
  misc_feature (130)..(130): Xaa is any aa, unknown, or other
MAMAFAAASAWSLSLTAFSLPLPQSLRPKPSQLLHGATSSFPRPRRCGWGAVVRCAKRTGKQRYPSEKKRLNRRKQELLRQAAPEEGSKGRESGYWRLSKLAVPARDDPGKDFTGISLPLLQAIAKAIKXPVPSMLPDEAFTVIRKSI

SEQ ID NO: 90196 - DNA, 1028 bp, Zea mays
  misc_feature: Ceres CLONE 1578102
  misc_feature: Translation starting site: 756
  misc_feature: Pfam Name: Lipoxygenase Pfam Description: Lipoxygenase
  misc_feature: SWISSPROT Homolog: EC 1.13.11.12 Lipoxygenase
  misc_feature (79)..(79): n is a, c, t, g, unknown, or other
  misc_feature (1028)..(1028): n is a, c, t, g, unknown, or other
aaatggtataagggtggcgtataaaaccaaatttatcccaacgactctcccctcttttgtctcgctatttaaataaaanaaaaaattgaactccccgcggtggcggccgctctagaactgtggatcccccgggctgcaggaattcgtctcacccctagaaaaaaacaacgacgcgtgcgtcaaggaagaaacgccgagcgccctgctcaagtaccgggaggacgagctcggcgcgctccggggagacggcgagacgacggagcggccgttccagccgtgggaccgcgtgtacgactacgcgctgtacaacgacctggggaacccagacctgcgccaggacctggcgcgccccgtgctgggaggatcccaggagtacccgtaccctcggcgtaccaagaccggccgaccagccgccaaaacagatcctcggtcggagagcagagcgccgctggacgaagagatctacgtcccctgcgacgagcgcgtcggcttcgccagcatccccgcgccgacgcttccgccgctgggcgggcacttcaggtcccctcgccgatgtctaccgccttcttcggcctcgacgacctcggctcgggctccccggaggccaagggcggtcaatcaaacaggcgggcgcggcccgtttccccccgcccgttggccctccagggttccaattttcaggtttaaaccccggaacaaccatttgggccgaggaaggggaaccaaaaagaagtttccgccgggccggggcaaaaatggaattccggccgggagggagcaaaaaccccggggtgggtggccaatacaaagcccgcgggtccctccacaggtttccccccgccttggcccgcaaactgaagtcctttgaaacccgcacgggggttggtttctggggcggaaccccaggggacgcggccatgggaatgaaccccaagggaacccctgggtgttgagtaaagaaaacatttggggggcggggaaattaaaccggttcgcacaaacagggtccagataaaaatgaaaggggn

SEQ ID NO: 90197 - DNA, 829 bp, Zea mays
  misc_feature: Ceres CLONE 1578103
  misc_feature: Encodes the peptide sequence at SEQ ID NO. 90198
  misc_feature (609)..(609): n is a, c, t, g, unknown, or other
  misc_feature (634)..(634): n is a, c, t, g, unknown, or other
  misc_feature (636)..(636): n is a, c, t, g, unknown, or other
ggagctccccgcggtggcggccgctctagaactagtggatcccccgggctgcaggaattcgtctcacccctagaaaaagccgcacccctttcctccttccgccctccgccgcgcctggctttctcccttcccgagaggccacgctccatccccgcccgcgctgcctcccctggcgatcggcggcgaccgcggcccaacgaaagcgtcgtggtcggccgctgtcacgcttcttgcagacgctgggcggactgggaacaagcgccaatggggatcgcggtggtggctctacacaccatgccgggggcgttcaccacccactccccggcatccattctgtcccttcggccagactttacgaggataaacggccgcaccgattcggtgccgaacgccaggacactgcaaggcgtcctaaggatcccgaggctgaggtcggtcaggcggctgtgccagcggatccatgaccgggttacagagggggaacggtccttgggtcaaggaatgcctgaataacgctaggccaggtcctggcgaacatcagcgtgcgttgtcaagctggtagtggcaatgggtggtctaaatggggagtgcggccgagactccacctcnaaggcggaaatccctcttcggttgnangattaggccccgggaacttctcgcggaaaccaatgggtttactaattgtgggcaatccctgttggggacgattgctgcccacgatcccaaaggacggtggtgccggtgaacctccgatcagggtgtttattcggggactgcataccatccggggctttggctttcccgccttaaggggggaaaatggaaaatg

SEQ ID NO: 90198 - protein, 82 aa, Zea mays
  misc_feature: Ceres CLONE 1578103
MGIAVVALHTMPGAFTTHSPASILSLRPDFTRINGRTDSVPNARTLQGVLRIPRLRSVRRLCQRIHDRVTEGERSLGQGMPE

SEQ ID NO: 90199 - DNA, 878 bp, Zea mays
  misc_feature: Ceres CLONE 1578105
  misc_feature: Encodes the peptide sequence at SEQ ID NO. 90200
  misc_feature (471)..(471): n is a, c, t, g, unknown, or other
ctccccgcggtggcggccgctctagaactagtggatcccccgggctgcaggaattcgtctcacccctagaaaaagtccccaatccgaaccgacgaggagctcgccgccgtgagatgtccgagtacgacgagcgctaccagggcaacgccgacatgcccgcagccgaaggcggctatccgcaggccgagtacgccgccgccgccgcgcctgccgccgggggttcgccgcccgcagacagcaagccctccgggttctccgaccacgccgacggccgctcctcccagcaccagcatgagacacaatcacatgacagtggttcctcgaaatctcgagaaagggaccgagaacgcgataagggcaaggatagggagcgtgacaggtatcgtggcccgagaaaaggggagggaccgagacaggggataaggaatcggtgaaagaagtgacagaagacagagaattcgcgatcccccnccacaggggacccattcgagagcggcagcgaagaaaaaggggaacaacggtggatccgttccggaatgaatcgggaacccgtcacccggtggatggtgcggggacccgcccacccgggggaatgaatcggggaattcctgagaagggaaaaaagaggatccgtgggacaagaagattggggccatccggtaaggggaattgggttcccgggcgtccccctttttttaagaagatcccggaaccgcgtgaaccccccagaaactaaggaatccccggttcacccgccctccccgatatcaaaagaagcaaaggcgcccgggggggggggggtttttgaaacaaaaacaaccccccccaaaaacaatggggccctttcccaaattgtgtgtgccccggcccggggtggc

SEQ ID NO: 90200 - protein, 106 aa, Zea mays
  misc_feature: Ceres CLONE 1578105
MSEYDERYQGNADMPAAEGGYPQAEYAAAAAPAAGGSPPADSKPSGFSDHADGRSSQHQHETQSHDSGSSKSRERDRERDKGKDRERDRYRGPRKGEGPRQGIRNR

SEQ ID NO: 90201 - DNA, 777 bp, Zea mays
  misc_feature: Ceres CLONE 1578106
  misc_feature: Translation starting site: 114
  misc_feature: SWISSPROT Homolog: EC 1.6.99.5 NADH dehydrogenase (quinone)
  misc_feature (346)..(346): n is a, c, t, g, unknown, or other
ctggagctccccgcggtggcggccgctctagaactagtggatcccccgggctgcaggaattcgtctcacccctagaaaaaatctccgttcgatcccatcgccccgccgccgccatggcgtttctcgcgcgggcgctgcggcagtccaactggcgcctgtcgtcgcgctgccccgccgtggccgcctcctgccgttggatctccccgaccgccgccgcgggatcgccggaggccggcgcggcggtggcgtctgccgacccggagctgcctccgccgcgggagcccgttggcggcgcccgcgtggagcttcctcctaacccggaggacgcgctcgaggtattcgtggnatggccatgcggtgcggatccccaaggggttcaccgtgctccaggcctgcgaggtcgccggcgtcgacatcccgcgcttctgctaccatagccgactctccatcgctggaaactgccgcatgtgtctcgtcgaggtcgagaagtcgccccagcccgtcgcttcctgtgccatgcccgcgctcccagggatgaagatttagacaacacccagtggcaaagaagcaaggggaggtgtcatggagttcctgctgatgaacatccactcgactgcccatctgtgatcaggggcgcgagtgcgacctccaggacagtctttggcatttggtgctgaccgcggcccgttcacgaagatgaagcggtcagtgtggacaagaattgggtcccctgggtaaaacagggatgactccttgctcaaatggacaaggggggta

SEQ ID NO: 90202 - DNA, 777 bp, Zea mays
  misc_feature: Ceres CLONE 1578108
  misc_feature: Translation starting site: 247
  misc_feature: SWISSPROT Homolog: EC 1.14.13.68 4-hydroxyphenylacetaldehyde oxime monooxygenase
  misc_feature (533)..(533): n is a, c, t, g, unknown, or other
ctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcagtggcggccagcgaccccgacaagctcttgagcctgctgccgtcgccgcccatgaagctccccatcatcgggcacctgcacctgatgggggacatcccctacgtgtcccntcgcgcgctcgccaccaggtacggccccgacctgatgctgctccgcctcggcgccgtgccgaaccgtggtggtctcgtcgccgcgcgtcggcgaaggcgtgctcccgcactaggaacacgttttctccatccgcccgcggtcccgggtgtccgacatcatcatgtacggcgccaccgactcgtgcttcgcgccctacggggaccatttcgcaaggcgcgaaaactgggtcacgtgcacctgctc

SEQ ID NO: 90203 - DNA, 846 bp, Zea mays
  misc_feature: Ceres CLONE 1578110
  misc_feature: Encodes the peptide sequence at SEQ ID NO. 90204
gagctcaccgcggtggcggccgctctagaactagtggatcccccgggctgcaggaattcgtctcacccctagaaaaagcaccagcgccacccaaatcccgcaaaaccctagagacagaagacgcgaggggagagagagaggcgcccggcatggcgagcgcgacgtccccagcgatggccgcgaatctggcgggcaagtcgggcgtgcgggtcgtcgtgatcggcgaccccggcaccggcaagtccagcctcatcgtcgccctcgccaccgagcagtttcccgagaacgtgcctcgcgtcatgccccccacccgcctccccgccgattatttccccgaccgcgtccccatcaccatcatcgacacgtcgtccagcccggagcagaagccgaagttgatcgcccagtgtcaggccgccgatgcggtcgtgctcacctacgcctgcgaccggcccgccacgctggagcggctcagttcgttctggcttcccgagcttcggcgactcccgctgaagggcccagttatcgtggtggggtgcaagctggacctgaaggaccaacaaccagtttacccttgaaccggttatggcgcccctcatggcagtcctttcccccgagattgaagacccctggcattgcagtgcccccgcctcttccgcagaatacagggtgcctgaagggttttccaactattgcccagaaaaggcagtaactttcccccctaacggccccccccttttttgatttaaaaaatttaccaattctctgaaaagccccccacatggtgttgaaagaaaccttttaaaaccccggaataattccccttgaaaatggggggatcaaagggcc

SEQ ID NO: 90204 - protein, 141 aa, Zea mays
  misc_feature: Ceres CLONE 1578110
  misc_feature (20)..(132): Pfam Name: Miro Pfam Description: Miro-like protein
MASATSPAMAANLAGKSGVRVVVIGDPGTGKSSLIVALATEQFPENVPRVMPPTRLPADYFPDRVPITIIDTSSSPEQKPKLIAQCQAADAVVLTYACDRPATLERLSSFWLPELRRLPLKGPVIVVGCKLDLKDQQPVYP

SEQ ID NO: 90205 - DNA, 832 bp, Zea mays
  misc_feature: Ceres CLONE 1578111
  misc_feature: Encodes the peptide sequence at SEQ ID NO. 90206
  misc_feature (404)..(404): n is a, c, t, g, unknown, or other
aaagctggagctcaccgcggtggcggccgctctagaactagtggatcccccgggctgcaggaattcgtctcacccctagaaaaagcccagtcgctaattttgcttggctccgcgcccgcgcccggctcgtcgtcaatccacccacccatctactgcgccgaaggaacgcccagccgctccggcggcgtacgcggggagaggagaggagatgagacgaagtgcgacggggtgggcatgaggtgcaagaagcacccgtaccaggtcggcggcggtggcgtctgtgccacgtgcctccgcgaccgcctgatcgcgctcgaggccgcgcagaacggcgacgcgtcgtcgtcgccgccgcccgccgcggcgcccgtgttcccgaggtcggtgtcgccgtacgtgtcccncaggaagtcggaacacgtcggggggggggcggcgcgctcaagcaccacccgagcctgctcttcttccggacgccgcaggtagggccccgcctacggcggcggcgcgtttggaggaagggcgacatagggctccaggtaccagaaggcgggcgcgcccggcaaagttctttccgtggctccgccacggctctttcgggcccaccaccacggggccaccgaatcgggaaagaaaccccacccgggaagggcgcccccggaagcgggaaagaaaaaacttccttggggtccgccccgccaatcatggcccggcggccgcccccgaaagaaagcaaggggcgggggccccggggccttccatatcccccctcggcccaagggggtcaagccccccgcccccaaagggcgcctcctcttgccccccgcgtggg

SEQ ID NO: 90206 - protein, 83 aa, Zea mays
  misc_feature: Ceres CLONE 1578111
  misc_feature (57)..(57): Xaa is any aa, unknown, or other
MRCKKHPYQVGGGGVCATCLRDRLIALEAAQNGDASSSPPPAAAPVFPRSVSPYVSXRKSEHVGGGAARSSTTRACSSSGRRR

SEQ ID NO: 90207 - DNA, 892 bp, Zea mays
  misc_feature: Ceres CLONE 1578112
  misc_feature: Encodes the peptide sequence at SEQ ID NO. 90208
  misc_feature (715)..(715): n is a, c, t, g, unknown, or other
aaagctggagctcaccgcggtggcggccgctctagaactagtggatcccccgggctgcaggaattcgtctcacccctagaaaaaacacagcaaccagtaagccatcgctcacacagtcagaccgacgcactcactaacacacaacttctccatacacgccttagccatggcttccgctgcgcagaagaagatgacaattgtttgcttgatgctgctggccgtcgtcggccaaatcgtcgctgatgatgatgttaccgtagaacatcccagccgcatctgcaccgaaacggtgattgatcctcgtgttcccaacaacgtgtgcatctgctccaagaactgcgcctgtgccggcaagtgtatccttgagtcggctgatgctgtccagacctgctttgtcgactgcgtcctcaagaacgactgcatctgcagcaacaagatcatccccggcgctgacgacccaaaggctaatgccaagtgaagtagtactgctatcagcctatcatcatccccaataatggcgtacgtacctaaataaacgacctcccatgcatgcaccaacggggagagttaagtgtgtaataattaacggccggtatgtctgtacgacggcgcgtcttgtttgtaacaataaaccccttgtttggtacgtgtaataaataaaaaagccaccgctttaccccactcctgctgctggttgttaatgataacaaattcngcacccccacttcttaaggaaccggcagccttcacttccttgcttcaccccaaccgggcacccgcatttcctcggccggccccgggaaccccccctcggggccctcggggcctcccgccgcgggggcgggggttccctccccttcaattcccccgggtaaagagaatgaactggccc

SEQ ID NO: 90208 - protein, 103 aa, Zea mays
  misc_feature: Ceres CLONE 1578112
MASAAQKKMTIVCLMLLAVVGQIVADDDVTVEHPSRICTETVIDPRVPNNVCICSKNCACAGKCILESADAVQTCFVDCVLKNDCICSNKIIPGADDPKANAK

SEQ ID NO: 90209 - DNA, 833 bp, Zea mays
  misc_feature: Ceres CLONE 1578116
  misc_feature: Encodes the peptide sequence at SEQ ID NO. 90210
aaagctggagctccccgcggtggcggccgctttcgaactagtggatcccccgggctgtttgacttcgtctcacccctagaaaaaaaacccctctcgatcgacacacgcagcctcgacccatcgagacctgacccgatcctcccgaggccgccagccttatcctctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtggtagcagctggtgctaatcctgttcagattactcgtggtattgagaaaacagctaaagcactagttggagaactaccggagttgtcttaaggagggttgaagataatgagctttgcagatgttgcttgcaattaggggctggcaacaaactatgaaaattggttaacctggattaccaaagggccatgaaccaagggcgt

SEQ ID NO: 90210 - protein, 169 aa, Zea mays
  misc_feature: Ceres CLONE 1578116
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPVQITRGIEKTAKALVGELPELS

SEQ ID NO: 90211 - DNA, 788 bp, Zea mays
  misc_feature: Ceres CLONE 1578118
  misc_feature: Encodes the peptide sequence at SEQ ID NO. 90212
  misc_feature (517)..(517): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (698)..(698): n is a, c, t, g, unknown, or other
tcacccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtggtggtggttgaacaataataagcgaagccgagctggctgccatacataggtattgtgtggtgtgtgagagagagagagaaacagagttnctcagtttgctatctctctctctgcatgtttggcgtcagtctttgtgctcatgtacgtgtgtctaccatgcatgtggttgatcccgattgcgtctgctgtaaccatatatttaattgggccacgatggatatgatttgatcccattttttatatatatttacctaaannnngagaggaggnaagtgggaagggggttttttgaaaagaaaaaaaaaaaaaatttggagccgggagccctttttccccttgcccaatttttaaaaagccccc

SEQ ID NO: 90212 - protein, 76 aa, Zea mays; identical to SEQ ID NO: 42649
  misc_feature: Ceres CLONE 1578118
  misc_feature (1)..(76): Pfam Name: Metallothio_2 Pfam Description: Metallothionein

SEQ ID NO: 90213 - DNA, 834 bp, Zea mays
  misc_feature: Ceres CLONE 1578119
  misc_feature: Encodes the peptide sequence at SEQ ID NO. 90214
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
ggagctccccgcggtggcggccgctctagaactagtggatcccccgggctgcaggaattcgtctcacccctagaaaaacttggctatctgaagaagagtttggcgggggtcacattgatctgaagccagcaacagcaagatctgtgcttggaaaccagtcagcagatctctcgatggcaaaagatcaaaatgcccgtgcaaagtctgtagagaataggcatgaaaggtcagagggtgctatgaagcctgacgttcagcaaaagaagagcactgtggcttcaaatggatctgatattctaataccatcttccctcgtacaagggaaatcttcagtggttgcacgtgcagtggatgagcctccaaaacctgtgtctgatgaggggggtaaagtttctacaaaatctacttcaaaatttgagaacagggcaacacaaaaagcgtgctggcaatgctgggaagggtatgaagcctgatgttgcaaaggaaaattcccaaaacctgggaaaacctccaacctggaaaggaaattcaacaagtctccccttgtttgataaaaaaagggctcctgggcacttgaagccttccccagaaaacccgttcccccgttttggcaaggggaaactttggatcccgggcccccaataaaggtttcctccaccctcccccaaaaaaaagggcggtttcccctataggggggcggcccccccccccccgggggggggcccccccggaaaaaannnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnn

SEQ ID NO: 90214 - protein, 99 aa, Zea mays
  misc_feature: Ceres CLONE 1578119
MAKDQNARAKSVENRHERSEGAMKPDVQQKKSTVASNGSDILIPSSLVQGKSSVVARAVDEPPKPVSDEGGKVSTKSTSKFENRATQKACWQCWEGYEA

SEQ ID NO: 90215 - DNA, 829 bp, Zea mays
  misc_feature: Ceres CLONE 1578122
  misc_feature: Encodes the peptide sequence at SEQ ID NO. 90216
  misc_feature (660)..(660): n is a, c, t, g, unknown, or other
  misc_feature (671)..(671): n is a, c, t, g, unknown, or other
  misc_feature (674)..(674): n is a, c, t, g, unknown, or other
  misc_feature (675)..(675): n is a, c, t, g, unknown, or other
ggagctccccgcggtggcggccgctctagaactagtggatcccccgggctgcaggaattcgtctcacccctagaaaaaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgacctgatcgccggcatcaccatcgccagccgtcgccatcccgcagggcatcagctacgccaagctcggcgacgtgccgcccgtgctcggactctactcgagcttcgtgccgccgctggtgtacgcgctgatggggagctccaagaccgcggtggggaaaaagggggggcgggggccntctctgcatcntcnnccccaggcctgggggggcaggtggcttcccacgggaaaaccccggggatcggctggtagggccccatgcgccacccacccttcgttgcggggggaacttggcagggcccgggtctggatgtccaaaggggggggcgctcctccctgggagccgc

SEQ ID NO: 90216 - protein, 161 aa, Zea mays
  misc_feature: Ceres CLONE 1578122
  misc_feature (138)..(138): Xaa is any aa, unknown, or other
  misc_feature (143)..(143): Xaa is any aa, unknown, or other
MGGSADANGAGSVRVPVPPARPFLDTFRGNLKETFFPDDPFRGVVRERGAGRRTVAALRYFFPFLEWAPAYALSTFKSDLIAGITIASRRHPAGHQLRQARRRAARARTLLELRAAAGVRADGELQDRGGEKGGAGAXSASSXPGLGGQVASHGKTPGIGW

SEQ ID NO: 90217 - DNA, 1104 bp, Zea mays
  misc_feature: Ceres CLONE 1578125
  misc_feature (13)..(13): n is a, c, t, g, unknown, or other
  misc_feature (14)..(14): n is a, c, t, g, unknown, or other
  misc_feature (58)..(58): n is a, c, t, g, unknown, or other
  misc_feature (65)..(65): n is a, c, t, g, unknown, or other
  misc_feature (75)..(75): n is a, c, t, g, unknown, or other
  misc_feature (77)..(77): n is a, c, t, g, unknown, or other
  misc_feature (94)..(94): n is a, c, t, g, unknown, or other
tttgtttttgggnntgtggggtgggaggggggtgattggggtggggggtgggggtcgnccccacntttttttttntnaaagctggagctccccncggtggcggccgctctagaactagtggatcccccgggctgcaggaattcgtctcacccctagaaaaaagacccagagcaccctcggcggggccgccgccagctgtggcggtagccgtggcatccccaagggtttcggctccgtgaacatggacgagctgctcctgagcatctggaccgcagaggagaccctggccaaggcctccgcctctatcgcacgagcgagcgcggggatgccccccacgccgatgcagcggcagggatcgtcgctcacactgccccgcatgctcagcaccaagacggtcgacgaggcgtggagaaatctcgcgcgctacgaaccgcctcccgcggcggaccgcgggagacaccatacgccccaccggcagttcaacactccgggggagatgactctcggaagagttctttggtccagatcctggccgcggacccaaggaagaaacccccgctttactgccttcttgccaggcggccgcccttccccatgggtggacccccccggcgggccccaaataacccgggtttggccctccttaaaaagaccttccccgacccctttgttctttgtgggagggggagatttttatccccgggggggttgtgccctctaacacccaaaagggaaagcacgccaaggccctgtgtccctggggcaaaattccgtggtttataaagaggatcttttttgccaacccccagtgactccctgggaaaatttgtggggggggggaaatctcttggaggaacaccattggaaatataaacccccgcccccaaggaggggcccgggcatcagaggctatttgtgggggagagggctaaaatcccccctctaagggggcgtgtgggtaaaacaaaacaacagagggcggtgttaaaacacaaagcgtttggggtatttctcttggtccgcggggaaaagggagaaaaacacaccggctaaccccgtggcgctggccgacgtagataccggggaaaaccccccaaataattt

SEQ ID NO: 90218 - DNA, 768 bp, Zea mays
  misc_feature: Ceres CLONE 1578127
  misc_feature: Translation starting site: 188
  misc_feature: SWISSPROT Homolog: EC 1.4.1.2 Glutamate dehydrogenase
ctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtcttgacaaaaaagcacc

SEQ ID NO: 90219 - DNA, 769 bp, Zea mays
  misc_feature: Ceres CLONE 1578128
  misc_feature: Encodes the peptide sequence at SEQ ID NO. 90220
ctggagctcaccgcggtggcggccgctctagaactagtggatcccccgggctgcaggaattcgtctcacccctagaaaaaactctctccctctccactcttggtgtccgagtcccttggccgtacgctctgcctcactccgtctcttgcttctcctgccgccggcgtcggagagcgagcttctcggcgggcggcggcggcgcgcggcgctgggtgcggatcggccgcgggtgcatggtggaagccgccgccgggcgccggtcaggcaccagccgtcggcggcctagcggcagcggaggggagcaccagcgcctggttgcgctcgccgtcgccgcgcgcttcgccatggtcagcacccggtctgcgggtccagcagtggcgggaggagatggagcgggagctgctggaacaggcgccggccccggtgccggtagcggacgatgcatggaggacttcttcgactgcctcctcggcttgctcggcgcgttaggcatgacatgggctacggcgcggccccagcggcagccgctcccgccgctgcctcgcggggttggggcgggggctgagccaacccgacgcccggcgttcgcagcggcgctcagggcaccccccggccgatcgctgggcatggcgcctgcgccgtcgcgtcactgtacacgctgccgggcaagaaaggcgtccaccaggatgctttgatcttctggggaaaaacctcctgtctagaaatgataccatcctttgggggggtattttgaatgggccttggaccc

SEQ ID NO: 90220 - protein, 153 aa, Zea mays
  misc_feature: Ceres CLONE 1578128
MVEAAAGRRSGTSRRRPSGSGGEHQRLVALAVAARFAMVSTRSAGPAVAGGDGAGAAGTGAGPGAGSGRCMEDFFDCLLGLLGALGMTWATARPQRQPLPPLPRGVGAGAEPTRRPAFAAALRAPPGRSLGMAPAPSRHCTRCRARKASTRML

SEQ ID NO: 90221 - DNA, 1264 bp, Zea mays
  misc_feature: Ceres CLONE 1578130
  misc_feature: Encodes the peptide sequence at SEQ ID NO. 90222
  misc_feature (47)..(47): n is a, c, t, g, unknown, or other
  misc_feature (68)..(68): n is a, c, t, g, unknown, or other
  misc_feature (1264)..(1264): n is a, c, t, g, unknown, or other
gaaaaatcttccccgcgcagagaggtgaagcgccctcacacactgcnaataataccaaagttgttggngtgggtgggactccccgcggtggcggccgctctagaactagtggatcccccgggctgcaggaattcgtctcacccctagaaaaactctcgagaccctagtcctctgttacttctcgcgccgccgccaatcccctcccgttctccgccaccgccaatcccctcccgtcctccgccacctctgctgagagcgagaagagatggccggcaagggtgatgggccaggaatctgcatcgatctcggcacaacctactcttgcgtcagtgtgtggcagcacgaccgtgtcgagatcatcgccaacgaccaaggtaaccgcacaacaccctcatacgtcgccttcaccaactccgagcgcctcatcggagatgcggccaaaaacccggtcgccataaaccccatcaacaccggtcttccatcccaaacgtataattgggcaagaggttaaaaatagaaaccccatgtccaaaaccgataattaaaaactgggaaccactttaaagggtaaataactaggggcccgagggaaaaaagccctattgatcagtttggtttcatacccccagaggggcggacagcagaaaaacctagtctaggccagccacataaaaaaaatatcctctccgtccaatttggtgtcctccccaataacacagaaaagaatgccgcgggggaggatgtacgacgctagccaaataccctctcaaaatcgcttaatggtatatattactcgttgcgagatatttgaccggggcaagaagtgcgccgtgtaaattactattacccaacttgagggggtgccctctctattatactcatcttacccgtttaacatataagtgcaacaccacccagcgtcgataaaggagtattaaggaacccgccgaccaaatataggataatagggccaggtgcggtgacatctgatactagatagaaggggccccacctcctaaagggttgtgcctcagcaaagtctagtgtcaatgtccaaaaggggtaaaggcacagaaaccctggtgtaagtcgctatgctatcattattggaaccccctcgtgggttggtgtgtgtgctataaagggtagagggtgaaatccgaaatacgtgccccgaacggagtaatcacaaacgcgggccaccctggctttacaccaagatccaaccatctggagatgcgagcgattaaaccgctttgctacn

SEQ ID NO: 90222 - protein, 81 aa, Zea mays
  misc_feature: Ceres CLONE 1578130
MAGKGDGPGICIDLGTTYSCVSVWQHDRVEIIANDQGNRTTPSYVAFTNSERLIGDAAKNPVAINPINTGLPSQTYNWARG

SEQ ID NO: 90223 - DNA, 796 bp, Zea mays
  misc_feature: Ceres CLONE 1578131
  misc_feature: Encodes the peptide sequence at SEQ ID NO. 90224
ctcaccgcggtggcggccgctctagaactagtggatcccccgggctgcaggaattcgtctcacccctagaaaaaccttatcctctcggctgcccaccaccgcagacaagtctagtcctctccctccccttaacatagcgccgccactcgcgcccaccacgccgccgcaccgccgctggtgaacggatccgtccatcccgtacaccgcccaactcggcgtcgctgttccagtacccgccgccgcgggccgcgtcgggcgtcgccgtgcgcaagaagtgcctgcagatgggtgccggcgccgggcgcatcggcggctgggtggagtccatgcgcgcgtcctcgcccacccatgccaaggcggccaccgcgctcgccgcgggcgtcgaagaggagcggtacaccgcgtggatggtgaagcacccatcggcgctggccatgtttgaccagctggtggcggcgtccaaggggaagcagatcgtcgtgttcctcgactacgacggcacgctgtcccccatcgtcaacgaccccgacgccgcctacatgtccgacacgggtggctggatccgacggcaaaagcaagcatcccctgccccgctgcccattcaaccatccgagcatcctgctcagctcagggcgaaacaaaaccctcctccctcactgcccccctcgcagacgaacccgcgtggagctaggggttttgggtctcgccacgccacgcctccctgaaaacttctagaactttcaaggaagaagaagaaagaaagggggaagcctccccggccgcccgccgcaaaact

SEQ ID NO: 90224 - protein, 146 aa, Zea mays
  misc_feature: Ceres CLONE 1578131
MGAGAGRIGGWVESMRASSPTHAKAATALAAGVEEERYTAWMVKHPSALAMFDQLVAASKGKQIVVFLDYDGTLSPIVNDPDAAYMSDTGGWIRRQKQASPAPLPIQPSEHPAQLRAKQNPPPSLPPSQTNPRGARGFGSRHATPP

SEQ ID NO: 90225 - DNA, 806 bp, Zea mays
  misc_feature: Ceres CLONE 1578134
  misc_feature: Encodes the peptide sequence at SEQ ID NO. 90226
  misc_feature (207)..(207): n is a, c, t, g, unknown, or other
  misc_feature (700)..(700): n is a, c, t, g, unknown, or other
  misc_feature (746)..(746): n is a, c, t, g, unknown, or other
  misc_feature (800)..(800): n is a, c, t, g, unknown, or other
ctccccgcggtggcggccgctctagaactagtggatcccccgggctgcaggaattcgtctcacccctagaaaaaactccccctagtttcttttcccccggttttttccgtcctctcctcactcgtgtccgatggctcgcccccgccgcctcctctgacgacggtctgactgacccccgcctccccggagagcggctccgctgtctcngccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcgacggaggctaggcggcggccgaggcgggcgctctcgacgcgcggggtggcgacggcggcgctcgtgctgggcgcgctcgcggtcgccgcctactattgcttctactcggacgtggccgtgcagttcctggggatggagcaggaggaggagcagaggaacgagaccaggtctttcctgctgccgctctaccccaaggcgcgtcagggccgcgcactgcgcgagttcggggacgtcaagctcgccgccaggagggtcgacgacggcggaagaaaggctaggaacaggatgggagtcgcngaggcggccacggcgaggaccaattcacgggcgtgctcccgatcangggcaatgtcttcccccgatggcagtattacacatctatctttattggcacccntccaga

SEQ ID NO: 90226 - protein, 197 aa, Zea mays
  misc_feature: Ceres CLONE 1578134
  misc_feature (178)..(178): Xaa is any aa, unknown, or other
  misc_feature (196)..(196): Xaa is any aa, unknown, or other
MAPPRPPPNPAGEQQPQLHGVVIITLPPADQPSKGKTVTAFAYTNDPPPPRSPPDPVMGYPAATEARRRPRRALSTRGVATAALVLGALAVAAYYCFYSDVAVQFLGMEQEEEQRNETRSFLLPLYPKARQGRALREFGDVKLAARRVDDGGRKARNRMGVAEAATARTNSRACSRSXAMSSPDGSITHLSLLAPXQ

SEQ ID NO: 90227 - DNA, 804 bp, Zea mays
  misc_feature: Ceres CLONE 1578135
  misc_feature: Encodes the peptide sequence at SEQ ID NO. 90228
ctggagctccccgcggtggcggccgctctagaactagtggatcccccgggctgcaggaattcgtctcacccctagaaaaaagcagcagcagcactgccatccacactagagaacgatctcttgctccgatcaccagctagatgaggtcgacaatggctgctgcgctgatctctatgaagacggggctcgcggtggtggccgtgctggattccgctgcgctgctggcttcgtcctctttgtctgcaatctcctgcaggcaagtgctgtcatccccgagcccctgcataccccacgctacgtgtaggcccagctcgtctcccgacgtcgtgctgcagtactatctagagactccacccacgccgctgatgaacacggtaccccagcgcgcgtgccgatgactctgtatcctcaccgactgcgtcagatcgtcgacatgcgcaccgtcgacaccatcttccgcaagtgcaacatctgcggccgatttcccgtcagcatgtccaccgactgacatcagatccgctctgttacaacgactaagctaactaccgtaccgatcttctggaacgtcccgcgcgcctcgctaccgatcatgacccgggagaagtaaatcaacccgactgctttgctggagcagactgcatcatttccggctttatctaattgcgctactgagaaaaccaacctcttagggaagggtttgggggccccacaacaacaacttcggtacattccaactagcttggtgcacgggtcttaagggggtggaaagcaaacaccgggttccccttcctctcggaaaaaaaa

SEQ ID NO: 90228 - protein, 81 aa, Zea mays
  misc_feature: Ceres CLONE 1578135
MAAALISMKTGLAVVAVLDSAALLASSSLSAISCRQVLSSPSPCIPHATCRPSSSPDVVLQYYLETPPTPLMNTVPQRACR

SEQ ID NO: 90229 - DNA, 841 bp, Zea mays
  misc_feature: Ceres CLONE 1578136
  misc_feature: Encodes the peptide sequence at SEQ ID NO. 90230
  misc_feature (841)..(841): n is a, c, t, g, unknown, or other
ggagctcaccgcggtggcggccgctctagaactagtggatcccccgggctgcaggaattcgtctcacccctagaaaaagacgcccccatttcgaagctcctcctcgcgattccgatccacgcacgccatctgcgactccgcgtccgcctcgcacagggttaggacatatattcagtgatggaacaaaggaggccggctgccagcatccggagggcccaatcctatgcatcaataactgaggcttctttggaagctctgccaccatgaaaatgagatctctgcgccccacggatatgatggtgaatcaggagcaggtccaaatggctgcctcctccatccatagcattgacaatggcgccgacaatgggaaaggacctgcaattgctgcgactgtaggtgtgggaattcctcaggtcgaggacaagactatcgccatgcacccgatcaaggtccctcaaaccagcaaggctgctgctggtttcaccaacggccaagaaggcccagaacgcgtgcgcaaactggtaggaaaggtgttgggtttgacgggttattaactgccggatgtcggaaacactacatgaagcaaggcagcgtttcacccagaaaaccacgactggccctttggaacaatggaactgcgaaatgggggacccttatccggcaaagcccaattccagggggagaaaaggccttcacaaagcttggaaaataatacacaaggcgcggggcgcaattggggagacaccgaataaagtggtttcgcggaatcttggcaagaaatttcagggcgggggcgcaccggttgcgtgggttttgagccagaggaaaacctctcccgcgn

SEQ ID NO: 90230 - protein, 96 aa, Zea mays
  misc_feature: Ceres CLONE 1578136
MKMRSLRPTDMMVNQEQVQMAASSIHSIDNGADNGKGPAIAATVGVGIPQVEDKTIAMHPIKVPQTSKAAAGFTNGQEGPERVRKLVGKVLGLTGY

SEQ ID NO: 90231 - DNA, 762 bp, Zea mays
  misc_feature: Ceres CLONE 1578138
  misc_feature: Translation starting site: 212
  misc_feature: SWISSPROT Homolog: EC 2.1.1.43 Histone-lysine N-methyltransferase
acccgcggtggcggccgctctagaactagtggatcccccgggctgcaggaattcgtctcacccctagaaaaaatttgtggactagccctccgaaaaatgagccataactgtggctaatgatgcttatgatttgaatatccagcaagatctgacactcctttccagtgaggtgccaaaaagagccaggtcatctcatccaactaagaagcatatggttgctaacaggacacctacggtgaatgataatgtggcgaatactactatgctcacgaaacatgtcaagaaaaaaaagggcaggaacatttccagtgagaccagtcagaaggtaaaacctgtgatctcatgcccagaatcagatggttgtgctagagcttccattaatggatgggagtggcgcatttgggcacagaatgctactccgtcggaaagggctcttgtgagagggtaccgtgttcggactattctttctgcctcaaatgataatgtgtggaaaaattctcaagcaaaggtgtcatctgcaagaacaaatcgggttaaactgcgaaatctgttagcagccgctgaaggttctgaactgctgaaattacccacatgaacgcaatgaaaaagcgtttgcgttttcaatggacaagatccatgattggggtcatgtcgcacttgagtcgatcgtagcacaacactttgtaatagaatatgtgggtcaactgatgcaccgggaggtctctgacctacgtgagtctcaatatgagaagagtgggattc

SEQ ID NO: 90232 - DNA, 781 bp, Zea mays
  misc_feature: Ceres CLONE 1578141
  misc_feature: Encodes the peptide sequence at SEQ ID NO. 90233
ctggagctcaccgcggtggcggccgctctagaactagtggatcccccgggctgcaggaattcgtctcacccctagaaaaaacatttcggaagctagctagctctgccctctgctcggggctcctccttcccagtaacaactaacaagtctacacacaggggacaccacaagtacatcgccaccgacggaggaggaacaacaagaaccccgatgacaattgcagccgcggtgaccgcgcccacgtccgcgccagtgcacgtcgcgccgcgccacgccagccccgcggtccagccgcgcgccgcgccgcgcaaggagccgtcgccgctcaaccccaacgcgccggcgcaggcgctccgctccgccagccccggcggcggcgggtcttccgcggccacagaccgcgccagggctcacatcgccaaccttgacaaagtgctcgggaagccgccgcatgtgccgaggcccgcgagccacgccgccgccagcatgcagggccagggccaggggcaggacggcgagcaagaaccgctcaacgtccgggaaggcctgctcaacgcgctcaaccttctccttctttcgagccccatgcccccggaatgcgggcgcaggacggcccaccaaaacaatcacatgtttgccaacgcaaacctatttggcaaatggaaggaagcttcctcctcccgccaaattccccccgggggggccccccccccgcgggtgggcaacccaataacccgcccgccggccagggcaaccatgcccctccccaccgggggggaaa

SEQ ID NO: 90233 - protein, 190 aa, Zea mays
  misc_feature: Ceres CLONE 1578141
MTIAAAVTAPTSAPVHVAPRHASPAVQPRAAPRKEPSPLNPNAPAQALRSASPGGGGSSAATDRARAHIANLDKVLGKPPHVPRPASHAAASMQGQGQGQDGEQEPLNVREGLLNALNLLLLSSPMPPECGRRTAHQNNHMFANANLFGKWKEASSSRQIPPGGAPPPRVGNPITRPPARATMPLPTGGE

SEQ ID NO: 90234 - DNA, 855 bp, Zea mays
  misc_feature: Ceres CLONE 1578142
  misc_feature: Encodes the peptide sequence at SEQ ID NO. 90235
tccccgcggtggcggccgctctagaactagtggatcccccgggctgcaggaattcgtctcaccccctagaaaaaaacaagcaccagaccaattaactagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggcttgttcctggcgaggaaagttgtccctcaccagggcggggttttacatcatcatgcagtgcctgggcgcccttctgcggcgcggggcttcttcaaggggttccagcaggggggctgtacagggggaaggggggggggggcccaacgttcgtggggccccggctaccccaagggggaacggccttgggcgcccaaaatcttcggccacctttactccctccgtttaaacccgttctttctcccgccccaccgacgcgccaaaaagaaaacgcccggggggaccccccctgggtgccggaatcctccggcccccctcttttccaaatggggggg

SEQ ID NO: 90235 - protein, 233 aa, Zea mays
  misc_feature: Ceres CLONE 1578142
  misc_feature (46)..(209): Pfam Name: MIP Pfam Description: Major intrinsic protein
MEGKEEDVRLGANKFSERQPIGTAAQGTDDKDYKEPPPAPLFEPGELKSWSFYRAGIAEFVATFLFLYISILTVMGVSKSTSKCATVGIQGIAWSFGGMIFALVYCTAGISGGHINPAVTFGLVPGEESCPSPGRGFTSSCSAWAPFCGAGLLQGVPAGGLYRGKGGGGPTFVGPRLPQGGTALGAQNLRPPLLPPFKPVLSPAPPTRQKENARGDPPWVPESSGPPLFQMGG

SEQ ID NO: 90236 - DNA, 790 bp, Zea mays
  misc_feature: Ceres CLONE 1578147
  misc_feature: Encodes the peptide sequence at SEQ ID NO. 90237
ctggagctccccgcggtggcggccgctctagaactagtggatcccccgggctgcaggaattcgtctcacccctagaaaaacacttcacagcctctccgcctccgctcctcgcgccgccgccgcgtctcctcctgtacaggtaaggagaggaagagggcgaaatggtgaagcacaacaacgtcatccccaacgggcacttcaagaagcactggcagaactatgtcaagacatggttcaaccagcccgcccgcaagcagaggcgccgcatcgctcgtcaaaagaaggctgtgaagatattcccccgcccgactgctggtcctctacgccccattgttcaatgccagactttaaagtacaacatgaagtcaagggctgggagaggctttacccttgaggagctgaaggctgctggcatcccaaagaagcttgctccaaccattggtatttctgttgatcaccgccgcaagaacaaatcccttgagggactgcaggccaatgtccagaggcttaagacatacaaggccaagctggttatcttccctaggcgtgcacacaaggttaaggctgggtgactctactcccagaggagctttgccacggctaccagggtccaggggtgactacatgccattttactcggtggtgagaaaacgttcaagttgaggtttgtgaagggtcccagatggagatgaaagtccttttgcctgcctttggcaaacctccgccctttgaagcggatgaaaaaagaaaacatcccttggtgccccccccaagaaaaaaggcaacctta

SEQ ID NO: 90237 - protein, 136 aa, Zea mays
  misc_feature: Ceres CLONE 1578147
  misc_feature (6)..(135): Pfam Name: Ribosomal_L13e Pfam Description: Ribosomal protein L13e
MVKHNNVIPNGHFKKHWQNYVKTWFNQPARKQRRRIARQKKAVKIFPRPTAGPLRPIVQCQTLKYNMKSRAGRGFTLEELKAAGIPKKLAPTIGISVDHRRKNKSLEGLQANVQRLKTYKAKLVIFPRRAHKVKAG

SEQ ID NO: 90238 - DNA, 991 bp, Zea mays
  misc_feature: Ceres CLONE 1578148
  misc_feature: Encodes the peptide sequence at SEQ ID NO. 90239
gagctccccgcggtggcggccgctctagaactagtggatcccccgggctgcaggaattcgtctcacccctagaaaaagatttcccctcccgcccgcctccctccgtccactcggatccggaaaaccctaaccctagacgtcgcccggccgccgccatggaccccgacggcgacccggccttccaccgcaacgaggccatctccgcggtccaggatgtcgaccagtactatggcgacgacgacgacttctacgacctctacaacgacgtcaacgtcggggacggcttcctccacgcctcccaccaggcgccgccgcctctgccgctgccgccgccacctccgactcagcaggccccaccgccgcagaagcaccagctccctccgccgtcccagcagctgccgccgccccagcagcatccacctgcccacgtcctcccgccaccggccgccgcagggccccaccgccctcagcaaggcaggtaaagcatccccggggggggggccgtcccctggcttccggggcagaaccttcccggcccaagaaccaaaacctcccttcgcgcccgacttcaaaaccaaccgggggcgggtttcccgggggccgcgacggtcccgtcccgcccttcaagtaaacgacccaaatattttccacggcaaagaaacggggggattcaaaaccgcgccccctggggagaggggaaaaaaatcccccccggtggggggcccccaataccttgggtatccggggaaacacgggggggggcccttgctattgggggggggggggaaaacggcccccttggggggggcacaaaaacgcggggttttccgtggggggaggaaacccccccccggggtgggaaaaaaccgggacggccggaaattattgggaaaatctttagggcttcccccgaaagtttttggggcccgggcgcacaaggagaggttatcaggttttcttgcgcccccataaaggcgcccaggaggaccga

SEQ ID NO: 90239 - protein, 108 aa, Zea mays
  misc_feature: Ceres CLONE 1578148
MDPDGDPAFHRNEAISAVQDVDQYYGDDDDFYDLYNDVNVGDGFLHASHQAPPPLPLPPPPPTQQAPPPQKHQLPPPSQQLPPPQQHPPAHVLPPPAAAGPHRPQQGR

SEQ ID NO: 90240 - DNA, 827 bp, Zea mays
  misc_feature: Ceres CLONE 1578149
  misc_feature: Encodes the peptide sequence at SEQ ID NO. 90241
  misc_feature (791)..(791): n is a, c, t, g, unknown, or other
ctccccgcggtggcggccgctctagaactagtggatcccccgggctgcaggaattcgtctcacccctagaaaaactctcctcccctcttctcactcagctcaccagtgctcgctcacctttcccctccctttcctttcctttgctttcctatccttgtgccctcgaactcgaatcggaaacccagccagccatgtcgtactacggcgaccggcgcgcggagtcgtcgatcgtggaggcgttcacgctgtcgccgctgccgtacccggtgatcctggtgctgctgatggtgacgctgctgctgggcgcctcgtggttctttccgtacgacgactttcatcgaaggagggcgtccgcagcaagttgaaacctgggcgcctgcttggggggtggcccaatcggggcgtgggtccctccctcaattccgggggggatcctcccttcccgttcgaaactcccctttcaaaggggggcaaccccgggggggtttttctttccccccaagggggaaaaaacccccctcttggaaaagggggcccccccttaacaaaaaaagggggggggccccccccccccccagagggggggaaacctcccccccccccggggggggggggggtccccccccctgtggtgtccggtgccccccccccccccccccccccccgggggggcccccccccaaaagtttttttcacattttcccccccctttttccccaaaaaaaaatttttgtgggggggggcgcgccccctttaaaaacaacccccccccaaaaaaatgtggtgggggnccccccccccgcccccccccgggggtttgaaaaaaa

SEQ ID NO: 90241 - protein, 57 aa, Zea mays
  misc_feature: Ceres CLONE 1578149
MSYYGDRRAESSIVEAFTLSPLPYPVILVLLMVTLLLGASWFFPYDDFHRRRASAAS

SEQ ID NO: 90242 - DNA, 900 bp, Zea mays
  misc_feature: Ceres CLONE 1578151
tggagctccccgcggtggcggccgctctagaactagtggatcccccgggctgcaggaattcgtctcacccctagaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattgggtgcttcaaacaggggatgatgcctttctacaaggtacaagatgcccagaaatgattaccaagaatgaagggcgtgggtaatgggtatcaagaacaaaagtttggggaaactgggttaaaataacaaaaagccctttgccgaggcaaggttttctaaaaaaaccaagtactttgggaatgggaaccttgggggccccgtcccaaattttggagaaaaaaacaggggttttccctgggttaaaaggggtcttggaaatattgaaaaaggtgggggggggcccccgggggggtttttcccaaaaaaaaatgtcccaaagttttgggggggggggggaaaatcctggaaaaaaaaatttttctttttttaaaaacaaccagaaaaaataccccgcaaaatggggccccccctg

SEQ ID NO: 90243 - DNA, 1218 bp, Zea mays
  misc_feature: Ceres CLONE 1578154
  misc_feature (20)..(20): n is a, c, t, g, unknown, or other
  misc_feature (35)..(35): n is a, c, t, g, unknown, or other
  misc_feature (39)..(39): n is a, c, t, g, unknown, or other
  misc_feature (64)..(64): n is a, c, t, g, unknown, or other
  misc_feature (1090)..(1090): n is a, c, t, g, unknown, or other
agagaaggatgaaaaggaanttatttgtccttttngtancaacaacacatcctaccccccccantagaaatttatttttaaatccccacagtggcggccgctctagaactagtggatcccccgggctgcaggaattcgtctcacccctagaaaaaagaactctgctctttccgatacgagatcaaagttctttgaagcaaaggagaatgggtgtccattgacagcacctgttgcaaatgtgtctacccctttgagcatcaattcgtctgggaaagcaccactttctgaggttcctgaaagttccaggacaaatgttgttgggacaagctctgtagtccgttctttgttcagtgcttcttcatcatcagtcagttcatcaccagaaaagcagccgacagagaatgaaaaaatggtcaatgaaatgcttcatgaagatgccagtgcttttgctggcaggtctgatagtgctagtactgctgaccacccattccagaacaaagtgagagaaaccatggcagaaagcttttctggggatatgggtcacccaactccatgaacaggagaaaagaccctgattatagtccaattggatcaaccctagttaaagggaaagtgaaggggaattcgtttgcatggaccctggcccttccaaaaaggaatggggaaggggagaaaaaattccttggaagaaaaacattgtgacccctttgaaaaattccttggtccttccggggttaccttttgggggttccaaaggggtttcccccgggaggatataagcatccaaatctaccctctttggggggggccccagagaaatttttttgtggggagacggaaaatgttttgtccccgtggggaaatatatgggggttttttgccgaaaaaaagcctcccctcctatggtccctcgccactgcgccaaaaagagggaagaggatatgtacaccaacatggtaaacaaaacataaaaaacccccgtggggacaaaagaaaatgagtgtatgtagaaggggagcagagtttggggctctttaaggataacacttctctctaagatatgcttttaacaggggggccgaaataggtngcgcgttcagaaggctcgccaatatatcggggccaagttgggccatggggttatactactagggagggggccttgccggagatttgtatctatcacgcggcggaggaaagagagatgaggcgtggatg

SEQ ID NO: 90244 - DNA, 818 bp, Zea mays
  misc_feature: Ceres CLONE 1578155
  misc_feature: Translation starting site: 158
  misc_feature (290)..(290): n is a, c, t, g, unknown, or other
  misc_feature (627)..(627): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaactgcagccaaccatctaccagcgactcagcgagcgagagcagcacacacgcagctagctaggagcagcagcagagcagcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggnattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaaatcagggtgtctgtctataatctagccctcatggatgctncaaccttcgtcatgtaacaataatcagtgctactcttcctttgcagctgagtcaaaacaaggaattagtgaattcttgacagagattaatgtcatatcaaatgttaggcacccaaaccttatcaagctgattgggttgctgtgttgaagggagtaacanaactattggtgtacgaatatgcagaagaataa

SEQ ID NO: 90245 - DNA, 955 bp, Zea mays
  misc_feature: Ceres CLONE 1578158
tccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcaagaggtccgggccttcgtgggatcttgaaaattgaatgttctaatggagtccaagggtggcaagaagaagtctagcagtagtcgttcctccctgatgtacgaagctccccctggctacagcatcaaggatatccgccccgcaggcaggatcaagaagttctccgctgcttactcgaactgcgcgaggaaacccatcctgaatatctctgtcgtcctccccctccctagtagcggtaaaaaaccgccctggcattttccatttttgattcgccccaaaatccccccccggctaggctgggtttttcccggggaccccaaaaaatatttttaaaaagaaccccttttcccccgttttttcctccccgcgggggggtggctctgtccaccttggggccctctaaaaaaaaatgggggcagctcccgggaaaatttttagttggataggttggccccctccccccctctggtttttttgtaaattgtggggtccaaaggggaatttttgaaaaacaccccctcttagaaaaaaacctctttttttaagaacccaccgtgtcttgggccggaaacccccctctaaaaagggggaaaccctggtgccgcccttctcgcggggccccacaaaaaaaatctttttttttttaacactttgtggggaggacaattttattggcggaaaactctctataaaag

SEQ ID NO: 90246 - DNA, 731 bp, Zea mays
  misc_feature: Ceres CLONE 1578159
  misc_feature: Encodes the peptide sequence at SEQ ID NO. 90247
ctggagctcaccgcggtggcggccgctctagaactagtggatcccccgggctgcaggaattcgtctcacccctagaaaaactttcctctcttctcatgcccacgcgctcgcctatctcataatccttccccattccgcctctctagctggcctgtcaaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatggacgtttatgcaaaagggcatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgctcgaggagtatatcacctccatggtactaccttcgctaagggagaaacatgatgagtttatgctcacggagctagtgcaaaggcggtcaaaccataaagtcatggttcgctggctctcgcgtttctatcattaccctgacccgtacttcacatcgaggaggtcactcaccccacttaaagaagttggtcttaccttgcttccgagagttgatatatcaagagactacaggggcagtttaaagatgcac

SEQ ID NO: 90247 - protein, 155 aa, Zea mays
  misc_feature: Ceres CLONE 1578159
MAGQERRTIDLEEGWTFMQKGITKLKNILEGKPEPQFSSEDYMMLYTTIYNMCTQKPPHDYSQQLYDKYRESLEEYITSMVLPSLREKHDEFMLTELVQRRSNHKVMVRWLSRFYHYPDPYFTSRRSLTPLKEVGLTLLPRVDISRDYRGSLKMH

SEQ ID NO: 90248 - DNA, 795 bp, Zea mays
  misc_feature: Ceres CLONE 1578163
  misc_feature: Encodes the peptide sequence at SEQ ID NO. 90249
  misc_feature (768)..(768): n is a, c, t, g, unknown, or other
ctccccgcggtggcggccgctctagaactcgtggatcccccgggctgcaggaattcgtctcacccctagaaaaaagccgccgccgtttcttcatcttcctcgcaacgccgacgctgcaacttccgctccctccccgactcgcgctcggcacgcaggcacgcgactgcggtggcgctcaggctcgggctctcagcaacggcggggcagtcccagactcagcgtctccctctcgccaatcgccttgcgccctcgctccgttcctctgctcaccggccgattctgcgttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatgggcattggcaagggtggggtattgccatggaagcttcttggtgatcttaaattcttcaaagaacttacactaactacaactgatcctgccaaaaagaatgcagttataatgggaaggaaaacatgggagagcattcctgttaagtcaaggccactgcctggtcgtttgaatgtcatacttactcgatctggtagatctgattttgcacagtagaagatgttgttatatgtggaagtatgaaatctgccttagagctgctagcatcaagctcatactggctatcnaaatgagaaagttttcgtcataggagc

SEQ ID NO: 90249 - protein, 100 aa, Zea mays
  misc_feature: Ceres CLONE 1578163
  misc_feature (19)..(101): Pfam Name: DHFR_1 Pfam Description: Dihydrofolate reductase
  misc_feature: SWISSPROT Homolog: EC 1.5.1.3 Dihydrofolate reductase
MALTAAPASGDSQSGPQRNYQVVVAATCDMGIGKGGVLPWKLLGDLKFFKELTLTTTDPAKKNAVIMGRKTWESIPVKSRPLPGRLNVILTRSGRSDFAQ

SEQ ID NO: 90250 - DNA, 830 bp, Zea mays
  misc_feature: Ceres CLONE 1578164
  misc_feature: Encodes the peptide sequence at SEQ ID NO. 90251
ctggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcggtcgcgggcagcgcgtcctcaacactggctcccccatcaccgtgcctgttggcaaggctacccttggacgtatcattaatgtttgtcggtgagccgattgatgagaagggggaatattacgacaaaacactttcctcccttatccatcggggaacccctggcttttcgtggagcaggccccctggagcaccaaatttcctggttccgggaaaacaggggccgggggatctttccttgccccca

SEQ ID NO: 90251 - protein, 171 aa, Zea mays
  misc_feature: Ceres CLONE 1578164
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLGRGQRVLNTGSPITVPVGKATLGRIINVCR

SEQ ID NO: 90252 - DNA, 847 bp, Zea mays
  misc_feature: Ceres CLONE 1578167
  misc_feature: Encodes the peptide sequence at SEQ ID NO. 90253
  misc_feature (747)..(747): n is a, c, t, g, unknown, or other
ctggagctccccgcggtggcggccgctctagaactagtggatcccccgggctgcaggaattcgtctcacccctagaaaaagccatccccctatttaagcgcgtgccagcccccgccgtttccctccaagaagagcacgacccactcctccggctcttcttctccaccggcaccagtccaccacctcctgccaccgcgcggccccaaccaaccacaccgcagcgcagcaatggcgggcaacggcgccatcggtggagagcgacccgctgaactggggcgcggcggcggcggagctggccgggagccacctggacgaggtgaagcgcatggtggcgcacgcccagcagcccgtggtgaagatcgagggctccaccctccgcgtcagccaggaggccgccgtcgcctccgccaaggacgcgtccggcatcaccgtcgagctcgacgaggaggcccgcccccgagtcaaggccatcagcgagtggatcctcgactgcgtcgcccacggcggcgacatctacagcatcaccaccggcttcagcagcacctcccaccgccgcaccaaggacgggcccgcgctccatgtcgagctgctcaggcatctcaacgccggaatcttcggcaccggcagagacgggcacacgctgcactcggaggtcacccgaacggcaatgctggtgcgcatcatcacactactccaagtctactccggcatacgcttcgagatcctcgaggccatcacgaagctgcntcaacacgtgtgtcagccacatgctgctgctcctgggcaacatcagcgcatcggggcgacatggtcccgctgctcgacataaccagacctcatcacgagc

SEQ ID NO: 90253 - protein, 167 aa, Zea mays
  misc_feature: Ceres CLONE 1578167
  misc_feature: SWISSPROT Homolog: EC 4.3.1.5 Phenylalanine ammonia-lyase
  misc_feature (141)..(141): Xaa is any aa, unknown, or other
MVAHAQQPVVKIEGSTLRVSQEAAVASAKDASGITVELDEEARPRVKAISEWILDCVAHGGDIYSITTGFSSTSHRRTKDGPALHVELLRHLNAGIFGTGRDGHTLHSEVTRTAMLVRIITLLQVYSGIRFEILEAITKLXQHVCQPHAAAPGQHQRIGATWSRCST

SEQ ID NO: 90254 - DNA, 882 bp, Zea mays
  misc_feature: Ceres CLONE 1578169
  misc_feature: Translation starting site: 610
ctccccgcggtggcggccgctctagaactagtggatcccccgggctgcaggaattcgtctcacccctagaaaaagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctcccttctttcttccttcctttctcgggaaggggttcgagtgagtcctggcgttcttgctcctcctctgctaagcactttgtcacagggaaaaacccccctcgaattccggggggtccttgcctttcccccccggggaaggggagtttccttggctgggggaaaaaaggcttcccctggctcggggtcccccaccttacttcacctcttttcacccgacggggcccccgggggaatgtgggggggagaattttcggtccggaaacccggcccgggaagggaaataaataggagatgggcgggccgcggcccccggctcaaaggggcgaaagaagtttcccaccggttttcccgccccaaggggaaaaatttccccgggggaaccccctttttgggaaataaaacagcccccccccccagggggcgcggagaggccttctttggcaggggggttccagaaaattttcttgcctgacaggtggggggggacccctgtggtttttattac

SEQ ID NO: 90255 - DNA, 866 bp, Zea mays
  misc_feature: Ceres CLONE 1578172
  misc_feature: Encodes the peptide sequence at SEQ ID NO. 90256
ctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaaagatggcgggagcagcagctgtggagacagcggcggccgctgcggccgcggccgcaacggccaaacggaaaagcgtgctgccaccctcgccaagggggcccgggtaccccacccccccggaaggccatggaaaaaaggcccccaggaaaaaacttcttcctccttcaaccgggggttctaaaaggggggctggggaaattaacaaggcccggaatttaccctttgccaaccgggggggaatttgggaatccccaagcctccccctaaaaaaactcccccagggggattccacacaggggtccccggggccacccaactatggggggaaaaaaaggggaattacatcttgggggggaaaaccccgtggaggacccctggcggaggggggaacccaactgggccaaagacgccccctttcccggaaacccgggccccctttgttgtttaagcccggtgttatttcttctcaaaaacttgagaaagacccataggggggcccctccttagtagaggggggggg

SEQ ID NO: 90256 - protein, 46 aa, Zea mays
  misc_feature: Ceres CLONE 1578172
MEKRPPGKNFFLLQPGVLKGGLGKLTRPGIYPLPTGGEFGNPQASP

SEQ ID NO: 90257 - DNA, 1230 bp, Zea mays
  misc_feature: Ceres CLONE 1578173
  misc_feature: Encodes the peptide sequence at SEQ ID NO. 90258
  misc_feature (1)..(1): n is a, c, t, g, unknown, or other
  misc_feature (2)..(2): n is a, c, t, g, unknown, or other
  misc_feature (21)..(21): n is a, c, t, g, unknown, or other
  misc_feature (54)..(54): n is a, c, t, g, unknown, or other
  misc_feature (71)..(71): n is a, c, t, g, unknown, or other
  misc_feature (1102)..(1102): n is a, c, t, g, unknown, or other
nnccggggcggtttttgcttncactcataaaaaaaagagggtgggttttttttnggcgggttttcttttcnactagggttaaacaacgtggcggccgctctagaactagtggatcccccgggctgcaggaattcgtctcacccctagaaaaattgcagatagatccaatcgcccctccgtctgcctggcgtttctcgcgcgggcgctgcggcagtcctactggagcctgtcgtcacgctgccccgccgtggacgcctcctgccgttggatgtgccggacggaagccgcgggatcgccggatgccggcgcggcggtggagtctgcccaaccggagctgcctccgccgcgggagcccgtttggggggccccgggggggacttcctcctaacccggaaggacgcgctccgaagtattcatgggatggcctttgccagggggatgcgccagggggttaacggtggtccgggtgtgggtaggccccccgccgggggacatcccgtggcttctgccttacgataggcgaaatcctcccttcgcttgggaaatctgtccggattgtgtaatacagtcataggagtcaagaaaaattggcctaaaggaacccgtaccgatttttctaaggaacaaagtaccccggggcctccccgggggggagtgataagcaatttaaggaacactaaacacccccccgtgttggtcgcaaaataaaaatgggcgacagggtgctagggcggggggcccatgtggggaaggtgcttcctttcgctcttataagtgaaatccctttacccacactattcatagagaggtggcgctcccaattaatttggtgtggtagattcatggtgggggctgggccccatgggatgcgcacacaactcttttcacaaggagtaattgggggtggctaatagtggcgcatattttttgtggggtgcacataagaaaccatttgggtgacacggtggttcttataacggcatagaacacgagaataaggcggtttggtgcgttttctttggtgtagacaaaacagaaagttgttgggggggtcgccccttaggggtgtatcagcaaaacagcgtgaatttgaacctccgcntcttggagtccaccccagggggttagccctaaggtgtgttgagtgcgggggtggttgtcgccgggcaacaggaagtggtttgtcatatgagtattgaccaacgagaaccactggagtggaacgccgta

SEQ ID NO: 90258 - protein, 39 aa, Zea mays
  misc_feature: Ceres CLONE 1578173
MCRTEAAGSPDAGAAVESAQPELPPPREPVWGAPGGTSS

SEQ ID NO: 90259 - DNA, 783 bp, Zea mays
  misc_feature: Ceres CLONE 1578177
  misc_feature: Encodes the peptide sequence at SEQ ID NO. 90260
  misc_feature (513)..(513): n is a, c, t, g, unknown, or other
  misc_feature (580)..(580): n is a, c, t, g, unknown, or other
ccccgcggtggcggccgctctagaactagtggatcccccgggctgcaggaattcgtctcacccctagaaaaagccgcccgcagatccatcccctcccggcctccctagcctttcccctcgagcacgtcagcgccctcgccctgctctgtcggccggccaagctcctcaccggcgccatgaacccgtatgatctccgcttcgctgacccctcatcctaccacgacaggcgcagcgacttgaccgtggctcctacgttcgctccgccggctcccgtggctgcggcgaacctgaacccttacgccgccgcctacccgctgcctgtgcccgttcccgtgcccgcggcccccgcgggcggcgactaccagcgctacgggcagggaggcagaggccgtggtggcggtggcagaggcggtggaggagggtacggaggtggcggcagaagaagaggtcgcgggagggacgggcttgactcgctcgccctccctaagccggactttcggagcctgataccgntcgagaaaaacttctacgtggagtgtcccctccgtccaggccatgtcggaagcggatgtggcccaantaccgcggccctcgggataacaccatcgaggggccggaatgggccccaaccgggttaaaaactttccagggaagcccaacttccccaaaattttctgggtggcaaagctttttggccaaaaattggggaaatttggggggggccccaacaccctttttttaaactccaagggggggggggcccctatggggcttttaaaaaag

SEQ ID NO: 90260 - protein, 153 aa, Zea mays
  misc_feature: Ceres CLONE 1578177
  misc_feature (113)..(113): Xaa is any aa, unknown, or other
  misc_feature (135)..(135): Xaa is any aa, unknown, or other
MNPYDLRFADPSSYHDRRSDLTVAPTFAPPAPVAAANLNPYAAAYPLPVPVPVPAAPAGGDYQRYGQGGRGRGGGGRGGGGGYGGGGRRRGRGRDGLDSLALPKPDFRSLIPXEKNFYVECPLRPGHVGSGCGPXTAALGITPSRGRNGPQPG

SEQ ID NO: 90261 - DNA, 807 bp, Zea mays
  misc_feature: Ceres CLONE 1578178
  misc_feature: Encodes the peptide sequence at SEQ ID NO. 90262
ctggagctcaccgcggtggcggccgctctagaactagtggatcccccgggctgcaggaattcgtctcacccctagaaaaaagcggcgcagaacttcacgctctcccacgcagcccttccagcaccaccaccaccagcagcaagcatcgtcgtcccccgtccgcctctccgcttccttccaggcttctagccctctctcctcggcatctctagcgcgggcggcatctatagtagccctagccccggccgcggcattggaggaaggcagcggcattggctgcgggaaccggagaaggaggcattgactaggtacaagcctctgtaacctgccggatccggatccgaatccgcgctgccgactgccggagtttgggggcaacaaagcttgctctagtctctagagatggaggacctactgggttcggagatcgggaagaacgactacgattggctcctaactcctcccgggaccccacgtgttcctgcactgggagggtgctgagaaaacaccacccccaaaatatgttaccggaagcgcccctacaactaggattcatcctcaaactacctaagagccatctaggctttccaatattctccaaacacaaaaatggggaatttcgaaccaattccccccttagacccagccaaggaaagtcacctcctgtttaaacccaaaccaattccatgcccaggtcaaggctccccaaaggaaaatggggaaaccaacacggggaaagatccaggtgtccctgaataaaccaaagccattttttctcttgtcaggcgaaatcttttcagtaagaaa

SEQ ID NO: 90262 - protein, 32 aa, Zea mays
  misc_feature: Ceres CLONE 1578178
MEDLLGSEIGKNDYDWLLTPPGTPRVPALGGC

SEQ ID NO: 90263 - DNA, 985 bp, Zea mays
  misc_feature: Ceres CLONE 1578180
  misc_feature: Encodes the peptide sequence at SEQ ID NO. 90264
  misc_feature (1)..(1): n is a, c, t, g, unknown, or other
  misc_feature (2)..(2): n is a, c, t, g, unknown, or other
  misc_feature (12)..(12): n is a, c, t, g, unknown, or other
nnggcttttttnccgaccttctgccccgctctgcgggaaggagtaatataaaaacacaaccgggttgtttttagtacaaactgggactcaccgcggtggcggccgctctagaactagtggatcccccgggctgcaggaattcgtctcacccctagaaaaaccccccgcagatccatccgatcccggccacccatacactgtcccctcgagcacctcagcgccctcaccctgctggtgctccgcagggcaacctcttcaccagccccaggaacccatataatgaccgcttcactgacccctcctcctacctccacaggggcagccacatgaccgtggctgctactgttcgctccgatggctcccgtggctgcgacgaacctcaacccatacgtcgcaccctacccgctgcctgtgaccgttcccgtgcccgcggcccccgcgggccgcgactaccagggctgccgccatggaaccataggccgtggtggccgtggcagagacggtggaggagggtacggaggtggcggccgatgatgatgtcgcgggacggtacgggcatgaatcccggcggactccgtaatcctgactgtctcaacactgataccagtccgaaaaaacaccctgacagggcagtagtccctccggtccagggcaatggccccgaaggccgaatcgtgagcgacattaccgggcccccactcctgcgggatgaccccgcctccggagggggccccggtgatattggcccataaaacccccctgcagaaaacccttccctaggtaaaacggaacctgtccacctgatttacccagccatgcccaagaatgtttggcccaaaatctccggatttgaagggaaactcaaaacacccttagtagaagtctttcaagggcttggaacctttttgggacattttttagcggggtgggggtacccttaaaatgccggaaaccgagggcccagggggtgttacaggcgtaaaaa

SEQ ID NO: 90264 - protein, 59 aa, Zea mays
  misc_feature: Ceres CLONE 1578180
MAPVAATNLNPYVAPYPLPVTVPVPAAPAGRDYQGCRHGTIGRGGRGRDGGGGYGGGGR

SEQ ID NO: 90265 - DNA, 848 bp, Zea mays
  misc_feature: Ceres CLONE 1578182
  misc_feature (383)..(383): n is a, c, t, g, unknown, or other
ctccccgcggtggcggccgctctagaactagtggatcccccgggctgcaggaattcgtctcacccctagaaaaaagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatccgggnaccggggggcgggttcgccgcccccgacgtcgcgagaagtccattgaaccttatcatttagaggaaggagaagtcgtaacaaggttttccgtaagtgaacctgccggaaggatcattgaccaacacaaggagctactacctacagcttcttcattctcaaggtgggggagaaccaagacagaaaagaccctggaaaaaaccgcccatggccaagcctccaaagtcaatccctaaccttcgggggtttcaacggaatggggaaaccaaccctaaaaattcccaaaaggcgtttgtaacctggttcccaaaccgccccctggggctcaaggggggccaacccaaagcccgggggtctaaaaaaaaaaaaaaggggcccccaaattgggacttcggtgtcgccccccccttttttaaaaaaacctggaaacaatgttttttaaaaaggggcccaaggggccaaaaaat

SEQ ID NO: 90266 - DNA, 874 bp, Zea mays
  misc_feature: Ceres CLONE 1578184
  misc_feature: Encodes the peptide sequence at SEQ ID NO. 90267
acccgcggtggcggccgctctagaactagtggatcccccgggctgcaggaattcgtctcacccctagaaaaacactgcatcacaactgaatcgcaaatgggttttcatgcaataaacaaacttatagcgcaagtcgttcttgaaggttgaaaattaaccaggccaacggcttgagtcggaccctgtcaacacagggtggtcgatgttagagacatggcacaatctcgatcgtgacgtatgagaacccatctacacagggttgtgcttggcgtccatggaatgtttgtttgacttcaccgatagaattgctgatatgtaccatgatttcccagttcataggtcatacattttctaagaacatgcatcaggtttgtgtaagcagggctagctgttcacccccccaatgacatttttacttttttcacatcagaatcaactatcaaagaggacaaacaggttggttgaatgagagcaaaaggagccctccaagaagttgatcgatctgggcgtttgtttcccttcgtttgatgtgaccatcaagggagaccgtcgcattggcttcaaaagcatagggctcaatctagccctgtgaaacattttccagatgtaccaggggttacttttggctttacaaaaatgagggcgagaactgccttaacccccttttgacaattctgttcaactatagggcaaattgggtttggtttactttaaaacctagtgccccaatatggattccccgccgtgatttgaaatttttgggtttttggttaaaacatgtttttggggagcaagccaaatggccttatgaaaaatgggaaaaatgaaagcggctaagggcaagtgaatccttttccaaatagggcgttaaaaa

SEQ ID NO: 90267 - protein, 49 aa, Zea mays
  misc_feature: Ceres CLONE 1578184
TRGGGRSRTSGSPGLQEFVSPLEKHCITTESQMGFHAINKLIAQVVLEG

SEQ ID NO: 90268 - DNA, 835 bp, Zea mays
  misc_feature: Ceres CLONE 1578185
  misc_feature: Encodes the peptide sequence at SEQ ID NO. 90269
  misc_feature (439)..(439): n is a, c, t, g, unknown, or other
ctggagctcaccgcggtggcggccgctctagaactagtggatcccccgggctgcaggaattcgtctcacccctagaaaaaagcccgccgcgcggaggccgctggttggccaggggacaccacgccttccattattagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacnagctcatcatggactccatcaacaagaactacgtcgacatggacgagtaccccgtccacactgagctccagaaccgctgcgtaaacatgatagctcacctgttcaacgcgccgatcaaggaggacaaaacgcctattggggtcggaaaaatgggaatccttcgaaaacaatcatggcttggagggttgggcgtctcaaaaggaaattgggcaaacaaaaggaaagggagcgggggaaacccggggtgaaaaaaccccaaatttttgccccgggggggcaaaagttttaggggttggtggggaagaaaatttctcacaagggtttttttgggggggggggcccctaagggggggttttaacccccttcaaaagaggggggccctccccctcccgggc

SEQ ID NO: 90269 - protein, 157 aa, Zea mays
  misc_feature: Ceres CLONE 1578185
  misc_feature: SWISSPROT Homolog: EC 4.1.1.15 Glutamate decarboxylase
  misc_feature (76)..(76): Xaa is any aa, unknown, or other
MVLSHASSGRDDDDAVASTFASRYVRERLPRYRMPERSIPREAAQQIISDELMLDGNPRLNLASFVTTWMEPECDXLIMDSINKNYVDMDEYPVHTELQNRCVNMIAHLFNAPIKEDKTPIGVGKMGILRKQSWLGGLGVSKGNWANKRKGSGGNPG

SEQ ID NO: 90270 - DNA, 831 bp, Zea mays
  misc_feature: Ceres CLONE 1578187
  misc_feature: Encodes the peptide sequence at SEQ ID NO. 90271
ggagctccccgcggtggcggccgctctagaactagtggatcccccgggctgcaggaattcgtctcacccctagaaaaaatccgccgttgctaatccttccacactcctcccccgcaaccacgggatctctcactgtcccaccccactccctcctccatttggcagtggcacatctatataggcaccccgcacccggaatccccactcccccacgacgccgtcctcgtccccgtcccgacgaattggaataggagaagcaaaagatgatggatctcgccgacagccagcaacagcggctcatcgccggcgcggctctgctggtcgccaccgtcgccttcctcaggctcctcctgagctcccgctccgggggcaagcgcctgccgcccaccatcccgggggcgccggtggtcggcggcctcgtcaagttcatgcgcgggcctatcccgatgatccgggagcagtacgcccgcctcggcagcgtcttcaccgtccccatcatcagccgcaagatcacgttcctcgtcgggcccgaagtgtccgcgcaccttcttcaggggcaacgaggccgagatgagccagcaggaggtgtacagggtcaacgtgcccaccttcggccccgggggtcgcctttgacgtcgaactaccccatcaggagggacaatttcagttcttcaccggagccctccggggcaaaaaacttgccagctttttccaaccaatggtggtttaagccgaaaaaaaccttcccaaaagggggaaaaaagggcccctgtttaattttaaaaaaaaaaatggggaacccccctttatatggagaaggaaaggcggggg

SEQ ID NO: 90271 - protein, 189 aa, Zea mays
  misc_feature: Ceres CLONE 1578187
  misc_feature: SWISSPROT Homolog: EC 1.14.13.70 Sterol 14-demethylase
MMDLADSQQQRLIAGAALLVATVAFLRLLLSSRSGGKRLPPTIPGAPVVGGLVKFMRGPIPMIREQYARLGSVFTVPIISRKITFLVGPEVSAHLLQGQRGRDEPAGGVQGQRAHLRPRGSPLTSNYPIRRDNFSSSPEPSGAKNLPAFSNQWWFKPKKTFPKGGKKGPCLILKKKMGNPPLYGEGKAG

SEQ ID NO: 90272 - DNA, 832 bp, Zea mays
  misc_feature: Ceres CLONE 1578189
  misc_feature: Encodes the peptide sequence at SEQ ID NO. 90273
  misc_feature (428)..(428): n is a, c, t, g, unknown, or other
  misc_feature (499)..(499): n is a, c, t, g, unknown, or other
  misc_feature (674)..(674): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (698)..(698): n is a, c, t, g, unknown, or other
  misc_feature (704)..(704): n is a, c, t, g, unknown, or other
  misc_feature (706)..(706): n is a, c, t, g, unknown, or other
  misc_feature (707)..(707): n is a, c, t, g, unknown, or other
  misc_feature (710)..(710): n is a, c, t, g, unknown, or other
  misc_feature (711)..(711): n is a, c, t, g, unknown, or other
  misc_feature (714)..(714): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (784)..(784): n is a, c, t, g, unknown, or other
ctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaagtgcgacccctgcaactgctgatcacatcgatcgacgaccatggatatgattattatctatctagcttgtnggtggtggttgaacaataataagcgaggccgagctggctgccatacataggtattgtgtggtgtgtgagangagagagagaaacagagttcttcagtttgctatctctctctctgcatgtttggcgtcagtctttgtgctcatgtacgtgtgtctacatgcatgttggttgatccgattgcgtctgctgtaaccatatattaattggtccacgatgatatgatttgatactatatatatatatatntcctnnnnnaaaannnnnnnnaanaaaaanannaannaanannnnaaaaaannnaaatcggagccagaagcttcatccccttgcccacttctacagcccctctgctgcanaaagaaggaaagacctagcccttaaacctgtcagccatggccacccgc

SEQ ID NO: 90273 - protein, 76 aa, Zea mays; identical to SEQ ID NO: 42649
  misc_feature: Ceres CLONE 1578189
  misc_feature (1)..(76): Pfam Name: Metallothio_2 Pfam Description: Metallothionein

SEQ ID NO: 90274 - DNA, 789 bp, Zea mays
  misc_feature: Ceres CLONE 1578194
  misc_feature: Encodes the peptide sequence at SEQ ID NO. 90275
  misc_feature (668)..(668): n is a, c, t, g, unknown, or other
ctcaccgcggtggcggccgctctagaactagtggatcccccgggctgcaggaattcgtctcacccctggataaaggctgtcctccgctcgtgcctaccaactaaaggaataccctcatcttctctccttttgctcggaacgcacacacagcccggtccccgatctccgatcccctcgtcgatccaagatgcagatcttcgtcaagaccctcactggaaagactatcaccctcgaggtggagtcttctgacacctttgacaacgtcaaggccaagatccaggacaaggagggctttcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccaactacaactttcagaaggagagcaccccccccttggtgtggcgtcctcaggggcggcatgccaaattttggggaagacccngaactggcaaagactatccccccttgagggccgaggccttctggaacccttcgaacaatgtcaagggccaaaaatcccgggaaaaagggaagggcaattccccttccggaaccaggcaggg

SEQ ID NO: 90275 - protein, 200 aa, Zea mays
  misc_feature: Ceres CLONE 1578194
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (161)..(161): Xaa is any aa, unknown, or other
MQIFVKTLTGKTITLEVESSDTFDNVKAKIQDKEGFPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLANYNFQKESTPPLVWRPQGRHAKFWGRPXTGKDYPPLRAEAFWNPSNNVKGQKSREKGKGNSPSGTRQ

SEQ ID NO: 90276 - DNA, 834 bp, Zea mays
  misc_feature: Ceres CLONE 1578198
  misc_feature: Translation starting site: 147
  misc_feature: SWISSPROT Homolog: EC 1.5.3.11 Polyamine oxidase
  misc_feature (834)..(834): n is a, c, t, g, unknown, or other
ccccgcggtggcggccgctctagaactagtggatcccccgggctgcaggaattcgtctcacccctagaaaaaggggagcaacgcaagcactccgcactgttgtgcagaacgagagccacaccatcagtggttagagcgaccaatagatgagttcctccccgtcctttggtctcctggctgtagcatcattactcctagcactgagcttagcacaacatggctccctcgccgcaaccgtcggccccagggtcatcgtcgtcggcgccggcatgtctgggatctcggcggcgaagatgctgtcagaggccgggataaccgacctgctgattctggaagcgacggaccacatcggcgggcggatgcacaagacaaacttcgccggcatcaacgtcgagttaggcgccaactgggtggagggcgtgaacggcggcaagatgaaccccagtctggcccatcgtcaactccaccctcaagctccgcaacttccgctccgacttcgactacctcgctcagaacgtctacaatgaggactgtggcgtctacgatgaagattacgttccgaagagaattgaactggcggacagcgtggaagagatgggggagaagctctctgccactttggcacgccagtggggagagacgacatgtctatccttggccatgcagcggctcaaagaaacatcaggccgtaacgggccgggccaacccccggggggacatgggggggtgggacctaccgacaaagtttcggacttacgaaagtttcccggggaagaacaaccattcgccgttgaacccctgtccctgtgcaaaaaaaaaaccgggggcccctcn

SEQ ID NO: 90277 - DNA, 902 bp, Zea mays
  misc_feature: Ceres CLONE 1578199
  misc_feature: Translation starting site: 274
  misc_feature: SWISSPROT Homolog: EC 2.7.11.1 Non-specific serine/threonine protein kinase
ggagctccccgcggtggcggccgctctagaactagtggatcccccgggctgcaggaattcgtctcacccctagaaaaaacccgccccgccctagctcacacgccaagccccagtacaaacaaagcctacggaatttcccccagctccaattcgcgctgttcgttccctttcagccagtcagtcgccgcctccgctgaactggaagtccaaactagctagctcactgggcaccgatttcccccaatttttcgctgccaggaggccgcggcgaccatgggcaactgctgcgccgcgccgtcgacggagggaagcggcaagacccgccccaagaagcagaaggagaacccctacaacgtcgcgtacaaccgcggcgcggcgccgccggcgccggtgcgcccgggcctggtggtgctgcggggacccgacgggggcgggacctcggcgcggagtacgagctgggcggcgagctggggcgcggcgagttcggcgtcacgtacctgtgcacggagcccgccacgggggcgcgctacgcgtgcaagtccatatccaagcgcaagctgcgcacgccccgtggaccttggaggacgtgcgcccggggaggtggacatcatggcgccacatgccgcccgcaccccaacattcgtcaggctcccgcgcccgccttacaagggaccgaaaaccccgtggcccctcctccatgggaacttctgtccaggggagggggaagctctttcaacaggaatcgtcccgcccgcggggcaacttaaacccaagggcggcccccccccccgccccttctatgccccaaccattcgtttgaaggggccttccacaaaaaatgcccaccaggggctttggggcgtccattgcccacccgggggattttttaaacccagaagaaa

SEQ ID NO: 90278 - DNA, 1186 bp, Zea mays
  misc_feature: Ceres CLONE 1578201
  misc_feature (15)..(15): n is a, c, t, g, unknown, or other
  misc_feature (20)..(20): n is a, c, t, g, unknown, or other
  misc_feature (28)..(28): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (1001)..(1001): n is a, c, t, g, unknown, or other
  misc_feature (1186)..(1186): n is a, c, t, g, unknown, or other
ttttttttgtggggngggcncctatttnatagggtcggggggtccttcttnnnnagggtgggggtaaaactggactcccgcggtggcggccgctctagactagtggatcccccgggctgcaggaattcgtctcacccctagaaaaatgatctctagctgagactccgagcaaaatgcagcagccaggaacaacaagctaagctaagccccctcacgcagaccgcacgaccgagcgcgcgggcattgaccgacccatcgccgccgcctcgatcgaccatggacgcttggcgaacacggaacaagtggtggctgggatgcatcgcgttcagcatcttctgggggctggccgtcttcccctcggggccgtttcatgcccggggggacgctaccgggggctccctcccgggggggcatggctcatgggggctctttcggggtgaggacccgcgggaagaaggcctaacaagggccatccgaccctccccgaatcccggggcccggctccttgcggggacccatgggggggggcaacaatgcttccccgggggagcgcgccccgaaaattgttcaaagtgagccttggggaagacggcgcgtgggggatggggcgggaaccccgggggggcggcgcgcggggaccccggcgggggtttccgcggggagactgggcccctacgcgagagtggggtccgaatggggatgctttactctacacctggttttatgtttaagaaaataggaggaaaagaaccattttgggcgggtggcgcggcggggtgggccgctcccaacccggggaagagtgtgacagccggcccgcccgtccgaaaaatccttgtgggagggtcctaaatataaaaataaaacactaccccctcttgtgggaccccacccggcaagggccccccccttgtactgtggcggggcagagtagcaatacccacttttgtttctactacgagagagggtgaaggagaaaaataagaggagggggacgggcnctttcgcagcgagaacagagggacgagtgagtggggggggggagagaggcgctgcggaggggagaagaaccctgcaggtgaatctatgtaacccaccgtgggggcgggaaaaagaggacgagagagacttgggctcgactgttagggggtggcgagtgtgttgtcctcacacccgcttcgagggn

SEQ ID NO: 90279 - DNA, 895 bp, Zea mays
  misc_feature: Ceres CLONE 1578202
  misc_feature: Encodes the peptide sequence at SEQ ID NO. 90280
  misc_feature (895)..(895): n is a, c, t, g, unknown, or other
caccgcggtggcggccgctctagaactagtggatcccccgggctgcaggaattcgtctcacccctagaaaaagtctcccctcttcctcctcccctgcgatcttctccaccgcatcacctccctcgaaccctagacccacccacgcgcccattgccttcggtcgccatgtccgccgctcagcttctccgtcactcgcgcaagctgcggagtttgcaaaatgctgtaggttgtgaaaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacttggagaatagcatccaacagccttaccccaagtgctgctagctggctcagtggttcattctcatgtggacaggtagtctcagcgcggccattctcaagtagtgcagacctgccctcccatcaagaaaatggggattgcgtctctttcacctacaatgactgaggggaaacattgccaaaggggcttaagaagggaaggaaaaaagggtctccccctgggggaggttctctcgcgaaagtggaaaactgaacaaacccacttgtggaaaatgggagtgcatgggaaaaagggcctatctttgctaaaaatttttttccgggggaaggggggccaaaaggaaaaattaaaagttgggggagggtcctttgcttataactcttgataaagaagaagggggtgacatttcagaaaagattttaaggagttaataaaacccggtaattcttttcaggtgtgagaaccggggggccccccgcggccggaaaacacaaaaggggcgggn

SEQ ID NO: 90280 - protein, 129 aa, Zea mays
  misc_feature: Ceres CLONE 1578202
  misc_feature: SWISSPROT Homolog: EC 2.3.1.12 Dihydrolipoyllysine-residue acetyltransferase
MSAAQLLRHSRKLRSLQNAVGCENFSFVRHFSSGSGSFIARENGIGKRTRGTRFSQHNQPAKQLETFSAGVNGSCTWRIASNSLTPSAASWLSGSFSCGQVVSARPFSSSADLPSHQENGDCVSFTYND

SEQ ID NO: 90281 - DNA, 838 bp, Zea mays
  misc_feature: Ceres CLONE 1578203
  misc_feature: Translation starting site: 101
  misc_feature: SWISSPROT Homolog: EC 1.10.3.1 Catechol oxidase
ctccccgcggtggcggccgctctagaactagtggatcccccgggctgcaggaattcgtctcacccctagaaaaaaaaaaaactataggtctgggctagctatggccggtagcaacggcactctgctgctcgcactccgcatcgtcctcttctgcgccctcgcctccgtggccaccaccttgttcccgctcgtcacaaggccatgcgcctactccctgccaagaaccatcctcgccgccagcggcctcgaccctcacctcatctcctgcgccgacgacggctccgccaaggcccagctgtcggatggcgatggaggccacaacaaggccggtagcggcggcaggcccatagtcaccgacctgctgtcgtgcggcgagccccgcctcccatcccacgcgctcccgcccttccgctgctgcccgccgacgccggcgtccgacgctgccgtcgccaacttcacgttccccgaaccaggcgagccgctccggacgcggcggccagcgcacggggccgccggcgcggacagcgtcgccaggtacgcgcgcgcggtggcgctgatgaaggcgcttccggagtcggaaccgcgcagcttctaccagcaagccaacatccactgcgcctactgcacagcggcgtaccagcaggcggggcggccggagctgcacgtgcagatacaacttctcgtgggtctgcttccccttacagcgggcctacctctacttcttccagcgcgtcgcggcgaggctcgtgggcgacccccgggttcgccgtgcccttctggaactgggacttgcccgaagggagattcgagggcccccggaatttcccagaaacgggat

SEQ ID NO: 90282 - DNA, 836 bp, Zea mays
  misc_feature: Ceres CLONE 1578209
  misc_feature: Encodes the peptide sequence at SEQ ID NO. 90283
ggagctccccgcggtggcggccgctctagaactagtggatcccccgggctgcaggaattcgtctcacccctagaaaaactagaaaaaaccaactcgcgatccatcgatttgattgcagaacaccacccaacagccaaaccatcactaggcgtctacgcttgacatggataaggcctacatcgccgcgctctccgccgccgccctcttcttgctccactacctcctgggccgccgcgccggcggcgagggcaagaccaagggctcgcagcggcggctcccgccgagccctccggcgatcccgttcctgggccacctccacctcgtcaaggccccgttccacgcggcgctggcccgcctcgcggcgcgccacggcccggtgttctccatgcgcctggggacccggcgcgccgtggtcgtgtcgtcgccggactgcgccagggagtgcttcacggagcacgacgtgaacttcgcgaaccggccgctgttcccgtcgatgcggctggcgtccttcgacggcgccatgctctccgtgtccagctacggcccgtactggcgcaacctgcgccgcgtcgccgccgtgcagctcctctccgcgcaccgcgtcgcgtgcatggcccccgccatcgaagcgcaggtgcgcgccatggtgcggaggatggaccgcgctgccgcggccggcggcggcggcgccgcgcgcgtccagctcaagcgggcgctgttcgagctctccctcagcgtgctcatggagaccatcgcgcacaccaagacgtcccgcgccgaggccgacgccgactcggacatgtcgcccgaagcccacgagtttcagcagatcgtca

SEQ ID NO: 90283 - protein, 224 aa, Zea mays
  misc_feature: Ceres CLONE 1578209
  misc_feature: SWISSPROT Homolog: EC 1.14.13.89 Isoflavone 2'-hydroxylase
MDKAYIAALSAAALFLLHYLLGRRAGGEGKTKGSQRRLPPSPPAIPFLGHLHLVKAPFHAALARLAARHGPVFSMRLGTRRAVVVSSPDCARECFTEHDVNFANRPLFPSMRLASFDGAMLSVSSYGPYWRNLRRVAAVQLLSAHRVACMAPAIEAQVRAMVRRMDRAAAAGGGGAARVQLKRALFELSLSVLMETIAHTKTSRAEADADSDMSPEAHEFQQIV

SEQ ID NO: 90284 - DNA, 787 bp, Zea mays
  misc_feature: Ceres CLONE 1578213
  misc_feature: Translation starting site: 147
ctccccgcggtggcggccgctctagaactagtggatcccccgggctgcaggaattcgtctcacccctagaaaaaaggtcccgcctcacaccacctcacctcatcactacctcacccacccagccccccaagaactacccatcaaccatggcgccgccgtcggtgtccgcctcccacctcctaatcaccgcctcgctcccaaagcccaagccttcctccctccgcccgccgcggctccctctcgccaagccccttcccgcatcggcggcgctcctggcgctcgcggcctcgcccgcgctcgccgccgacgcgccggcgcctgcccccgccccaacccccgcgccggcgccggagctccaggccgaggcgcccaccccgacagtcaaccccttctccagctccctcctcacggcccccaagccctccgccgcggcctccgacctccccgagggcgctcagtggcgctacagcgagttcctctccgccgtcaagcgcggcaaggtccagcgcgtgcgcttttcaaggacggcggtctgctccagctcaccgccgtcgacggccgccgcgccaccgtcgtcgtccccaacgaccccgacctcatagacatcctcgccaccaacggcgtccacatcttcgtcctcaagggcgattccgcggggcccgggcgggttcttcgccttcgtcgggaaacctcctctttcccttttatcgggtttcgcgggcctcttctttcctcttcccgcccgccgcaggggaggggcccggggccggggccctggtgggccccc

SEQ ID NO: 90285 - DNA, 1226 bp, Zea mays
  misc_feature: Ceres CLONE 1578215
  misc_feature: Encodes the peptide sequence at SEQ ID NO. 90286
  misc_feature (1)..(1): n is a, c, t, g, unknown, or other
  misc_feature (65)..(65): n is a, c, t, g, unknown, or other
  misc_feature (834)..(834): n is a, c, t, g, unknown, or other
nttggtggtggtgtggtggaaaataaaaggcggagtgggggggttagtgggtgtggggcgccatnaattaaatttgtactccccgcggtggcggccgctctagaatagtggatcccccgggctgcaggaattcgtctcacccctagaaaaacaacgcctcttgttctccgtccctctctgcctgaccagctaggatcagcggaagcagcaatggcgatggcgtcgtccagcgggctgaggagctgcatcgccgtgggcgtgcccagcctggtggggccttcgtcccggcccggccggctggcgccgttctgcgccaacgtctccacctctgggcgcgtcaccaggtccgcggagtggatgcccggaaggccagatcctggccacctcgaaggctgcgtctgcaggggaacttccgcttcaaaccgctgggaacttgcgagggtggcggaaaacttcgagcgggtcaagagaaaaaaaagcgtttccacggaggccggggcaatggttgcccgtcccccggggatactggttgcccggaaagcactgggggccttgggaaaactcggggggaagggggccaagaattggggaggagtccgtccccacagagagggggaagggtcaccgattaaacatgggttaacccccgcggggtgtgcgttgggggggccatggtgttaaaccaaaaaccacttcacgaaggggggagtttgggagattgtgttgggggggcgcgccggcgcccccatttttttgccaggaagaaaataccacaaggtgctgcgcctccaggatgtgccgtgcaacaagaaggtgcatctccccccgcgtggntagagggatgacctaaaggagtgtccctgcctccgggcgcatattattgctcccttttatagcagtgcaccctcgcattgggggggggctgagtgcgctcccgaaaagggagcgccccgccgccgccagcggatgtgtgtcgtgtgagcggaggcttgaaaagaagtgccctttcgggtggagtggcaaccgtggaggtaaaagaaatcgtccgctttcttctgtgtgcataatagtatatgaaaatactacccaccaggcaaggggcagccctcttacttggagtctacgagttaataaataagaaggtgttaacaggccccgcgggaaaacacggtgtgaacccacctggtgatggaagacaaacggtgcgtgctaaaaggccccgccct

SEQ ID NO: 90286 - protein, 156 aa, Zea mays
  misc_feature: Ceres CLONE 1578215
MAMASSSGLRSCIAVGVPSLVGPSSRPGRLAPFCANVSTSGRVTRSAEWMPGRPDPGHLEGCVCRGTSASNRWELARVAENFERVKRKKSVSTEAGAMVARPPGILVARKALGALGKLGGKGAKNWGGVRPHREGEGSPIKHGLTPAGCALGGPWC

SEQ ID NO: 90287 - DNA, 757 bp, Zea mays
  misc_feature: Ceres CLONE 1578222
  misc_feature: Encodes the peptide sequence at SEQ ID NO. 90288
ctccccgcggtggcggccgctctagaactagtggatcccccgggctgcaggaattcgtctcacccctagaaaaaaagtcaaaacctgttccgtgcgcacgacctcatctgtcatctcgcagcagacagaggaatttcccttctgggagaatcacaaactgttctccctctgcactgttggatctcttgcgtggtcgccgtccaagcagaagcggagcactaaccacacgagcgcgagagtggaggcgcagagagccgtcgccatcgtccatcgcaaattcgctagcggacacaaatccacccagccagccgttcatcgcaaccaccacaaccaccaaccaacgggcgtgcccaccacgcggcgccgttggggttggcgggcgccatgggggcgccgagcagccgcgcgctggcgctgggcgcggccttcctgctgctcctcgtcgcgctgccctccgccttcctctacctcacctcctccgcggccacccgcgccaccctcctcgacctcaagcccttctccgccaggtgcgcgcccgcagtcgcgccgctccgcgtcttcatgtacgacctgcctgcgcgcttccacgtcgccatggatggggccgccgcccggcgcggggttccccccgtggccgccgtccgccgggcgggatcaagcgcccgcacagcgtggaaatactggaagaatggcctcccctccaaggatggggggcccccgggacccgaaaccggggaaaggaagggccgtccaaggg

SEQ ID NO: 90288 - protein, 124 aa, Zea mays
  misc_feature: Ceres CLONE 1578222
MGAPSSRALALGAAFLLLLVALPSAFLYLTSSAATRATLLDLKPFSARCAPAVAPLRVFMYDLPARFHVAMDGAAARRGVPPVAAVRRAGSSARTAWKYWKNGLPSKDGGPPGPETGERKGRPR

SEQ ID NO: 90289 - DNA, 816 bp, Zea mays
  misc_feature: Ceres CLONE 1578223
  misc_feature: Encodes the peptide sequence at SEQ ID NO. 90290
  misc_feature (593)..(593): n is a, c, t, g, unknown, or other
tccccgcggtggcggccgctctagaactagtggatcccccgggctgcaggaattcgtctcacccctagaaaaaaggagatcagagccccggcgaggtcgcaccgcaccagccatcgtctccttccttccttcctatactaccatccaaccagctgcccagcgcaacgttacctgcccgacatccgacaagccagtccatccggcagcgagcaaaggtctgagatgggttccgtagacgcggcgatcgcggtgccggtgccggcggcggaggagaaggcggtggaggagaaggcgatggtgttccggtccaagcttcccgacatcgagatcgacagcagcatggcgctgcacacctactgcttcgggaagatgggcgaggtggcggagcgggcgtgcctgatcgacgggctgacgggcgcgtcgtacacgtacgcggaggtggagtccctgtcccggcgcgccgcgtcggggctgcgcgccatgggggtgggcaagggcgacgtggtgatgagcctgctccgcaactgccccgagttcgccttcaccttccctggggcgccgcccggctgggggcgccgccacccaccacgggncaaccccgttctacaaccccgcacgaaggtccaccgcccaggccggaaggcggggcgggccccaagggctcatcctggaaccaaggccctggccccctgggaaaaaaagggcgcgggaaattccccggggggaaaaggggggatccccccgggggccccggtcaaagggggccttttaaaggggtgggtgggagatttccccaaatttattccggggcccaaa

SEQ ID NO: 90290 - protein, 198 aa, Zea mays
  misc_feature: Ceres CLONE 1578223
  misc_feature: SWISSPROT Homolog: EC 6.2.1.12 4-coumarate--CoA ligase
  misc_feature (124)..(124): Xaa is any aa, unknown, or other
MGSVDAAIAVPVPAAEEKAVEEKAMVFRSKLPDIEIDSSMALHTYCFGKMGEVAERACLIDGLTGASYTYAEVESLSRRAASGLRAMGVGKGDVVMSLLRNCPEFAFTFPGAPPGWGRRHPPRXNPVLQPRTKVHRPGRKAGRAPRAHPGTKALAPWEKKGAGNSPGGKGGIPPGAPVKGGLLKGWVGDFPKFIPGPK

SEQ ID NO: 90291 - DNA, 836 bp, Zea mays
  misc_feature: Ceres CLONE 1578224
  misc_feature: Encodes the peptide sequence at SEQ ID NO. 90292
ctccccgcggtggcggccgccctacatcgtcccacctgtacgtactacactgcgccgcttgaacgatgctttgcggcgatggaccgggtcggcggcggcgaaaagcaactggaggattgcacagtagccaatgctctaggaacttggttcttctcagttgcgggtgctcttgttgctattcctgtgggcataaagaagaaatccttagccccactcgtcttcttcggcactactggaaccatgctggacattatcatgggcattacccagtgtgagcaagagcatgctgagcgggaaatgaagattttggaagcccagaaattttcggtcgatgcttcagctcagaacgaaagctctgattcctttggcagtgctgacaagtgaaacacttctcctgttttccctcacttgtgacctggcttcacctctgttaattagagttgttgctcagatgccaatttgacacctttaaatttctgaatacactattcctactccctcaataacgtgcaattgtgcatttgatcaaccattagtttatatatatattgtgaattgaaaacaaaatataaaaggttcagtcttgctccctcagcaagattggcacatggtgaaaatggctccaaaacctcccccaaaagtaccaagtccaggggtttccccacccatcctcttttttaatcgaaggggggaccccaagcgcctataaaaaaaatcccccacccggggaggcccttgttacaacttttttaaaggggtttggtgtgtgggcccgcccctgggccctttgtgtaaagagaaaggaaatcccaccccccggggaaatatgggtttct

SEQ ID NO: 90292 - protein, 101 aa, Zea mays
  misc_feature: Ceres CLONE 1578224
MDRVGGGEKQLEDCTVANALGTWFFSVAGALVAIPVGIKKKSLAPLVFFGTTGTMLDIIMGITQCEQEHAEREMKILEAQKFSVDASAQNESSDSFGSADK

SEQ ID NO: 90293 - DNA, 850 bp, Zea mays
  misc_feature: Ceres CLONE 1578229
  misc_feature: Encodes the peptide sequence at SEQ ID NO. 90294
  misc_feature (722)..(722): n is a, c, t, g, unknown, or other
  misc_feature (804)..(804): n is a, c, t, g, unknown, or other
ggagctccccgcggtggcggccgctctagaactagtggatcccccgggctgcaggaattcgtctcacccctagaaaaaaagccgagatcgagcagctgctacctctccgatccgaggcctgagcgagcgagctgagctgagctgagctgaggactcagcctatataatatctagactagagtacaccacaacgacgaggcacatatatatacacgcggcggcggcgggcagatccatcttggtatacacgtaatatatacacacacacacgatgggcagcgccggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccgcgcccgccgtgctcgtgtacatgatcaactacctcatgtccatgtccacgcagatcttctcgggacacctcggcacgctcgagcttgccgccgcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgagggccacggggggtgccngctggcggcgctgtacgccttctccccgccccgtcctgctccctgcttggggaagtccccccgagatcgcgtcggccgccgnccgtcttcgtgtacggcctgggtcccggcagatccttcgcctacgc

SEQ ID NO: 90294 - protein, 193 aa, Zea mays
  misc_feature: Ceres CLONE 1578229
  misc_feature (151)..(151): Xaa is any aa, unknown, or other
  misc_feature (178)..(178): Xaa is any aa, unknown, or other
MGSAGGGGESKLESPLLGASSTGHGEAVVSGQLESILGDASVPWGTRMASASAVEMRLLVRLAAPAVLVYMINYLMSMSTQIFSGHLGTLELAAASLGNTGIQVFAYGLMLGMGSAVETLCGQAYGAHKYDMLGIYLQRSTVLLRATGGAXWRRCTPSPRPVLLPAWGSPPEIASAAXRLRVRPGSRQILRLR

SEQ ID NO: 90295 - DNA, 858 bp, Zea mays
  misc_feature: Ceres CLONE 1578231
  misc_feature: Encodes the peptide sequence at SEQ ID NO. 90296
cccgcggtggcggccgctctagaactagtggatcccccgggctgcaggaattcgtctcacccctagaaaaacaacatggttgcctgtgggcaattccaggatcacataaaaagggtttggtgagacgtatggtcagagatgaaaatggtacacattttgatcggccctccccagtctatgatcagaaagaatttgtaccgctggaagtaaaatctggtgctttggtggttatacatggagatcttatacatcagagttttgagaacctttctctagcgtcaagacatgcattcagcttacatgtagtggatactgaaggatgtaaatggtccgaagacaactggatacaaaggaaaacggcccctgaaccgctctatgtgtcttagcaaaaccagtaactagtggcgtaaaacaatagagattcccagcaagtgatttgtggatcgccttctctgcacaataaaatggggggatcaagctgccgccatgctggtttccctttcacctgggaaacatatgaagggctttgttccggttattttccaataacacatggatttggatagggatttaaaaaaaaatttgagaagaaagttttggactttgttttggggatttcaaactccattccaatccccccttcaaatcccccattggatttggagaggctaaacccgaaacaaggcccttaaaacttggaaaaaacctatttgcctaccgggtaaatacccttaaaaaaattcttctctttccggctgggggtaaggagaaaaaaaaaacggccctccttctccaatttttttttttttaaaaacgactccgtatagtaagaaaaataagaactaaataattttatat

SEQ ID NO: 90296 - protein, 127 aa, Zea mays
  misc_feature: Ceres CLONE 1578231
  misc_feature: SWISSPROT Homolog: EC 1.14.11.18 Phytanoyl-CoA dioxygenase
RGGGRSRTSGSPGLQEFVSPLEKQHGCLWAIPGSHKKGLVRRMVRDENGTHFDRPSPVYDQKEFVPLEVKSGALVVIHGDLIHQSFENLSLASRHAFSLHVVDTEGCKWSEDNWIQRKTAPEPLYVS

SEQ ID NO: 90297 - DNA, 807 bp, Zea mays
  misc_feature: Ceres CLONE 1578232
  misc_feature: Encodes the peptide sequence at SEQ ID NO. 90298
  misc_feature (452)..(452): n is a, c, t, g, unknown, or other
  misc_feature (455)..(455): n is a, c, t, g, unknown, or other
tggagctccccgcggtggcggccgctctagaactagtggatcccccgggctgcaggaattcgtctcacccctagaaaaactctctcgcgcttccgctttcccttctcctggtcctggccatggcccacgaacgggagccgctcctgcagcaacgacagaccggcgtcggcaatgcctgcggtgccaagggctcgtcctcggcgccggcgccgtcggctgccgcgctgccgtcgctggctaggaccgtgctcaagttcctgatgtgggcggtgttcctcacctgggccgcggggatcttcctctacccgaccaagcccgtgcaggccgtgttcaggaagtgcgtcgggctcaccagggactccatgttcggcatcgtcgggggtattttcctgaccttcagcgcgccaattctgatcattgcgcttctcgcatatgtgtacatctccttcttnccngagtgagcatgtgggtggagaaaaggaagctgcgctcactgagtttcaggctctggactttccctgttcttgtagacggcccctttggagttgtccctgcagctgaggtcaatcggactggccttggttaaagtttttggtggccaccccaggcccttttattgccgggaaccctttgaaccttggccccgaaatttgactcccctccatggaccggaaggggatttgaaccgggaaggccttgggccccccttttaaggggcgggtgggggtggttttgaaagggttttccttttccgggccaaccccccaagggcccggttttcttatagggttttccaaatttcccttt

SEQ ID NO: 90298 - protein, 113 aa, Zea mays
  misc_feature: Ceres CLONE 1578232
  misc_feature (111)..(111): Xaa is any aa, unknown, or other
MAHEREPLLQQRQTGVGNACGAKGSSSAPAPSAAALPSLARTVLKFLMWAVFLTWAAGIFLYPTKPVQAVFRKCVGLTRDSMFGIVGGIFLTFSAPILIIALLAYVYISFXPE

SEQ ID NO: 90299 - DNA, 762 bp, Zea mays
  misc_feature: Ceres CLONE 1578235
ctccccgcggtggcggccgctctagaactagtggatcccccgggctgcaggaattcgtctcacccctagaaaaaatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgctttccccttagaagggaaaaaagcggtgggattgaaccccccttggaaggaaaaaggcaaaggggaaaggtttattgggggaaagtggaaaaaagggacttcaaagggggttcccccccggggggggggggagaggaaattaaaaggggggggggggaaacaaaaaaaaaaaagggggggcccccctgggggttggggggggagagaaaaattattttgttttttttttttctcacaaactactgcaacaaaaaaggggggggggggggggggggcccccctctttttttagaaaaaaaaaaaaatgaaaaatccccccccgcaaaaagaagtgggggggggggggggggggggccccccccccccccacccctttgaaaaacaaaaataaaataattgtgtgtgaggggggccccccccccccccccaccgaaaaaaaaagacggcgcgcctccctttgtatagggggg

SEQ ID NO: 90300 - DNA, 758 bp, Zea mays
  misc_feature: Ceres CLONE 1578236
  misc_feature: Encodes the peptide sequence at SEQ ID NO. 90301
ctcaccgcggtggcggccgctctagaactagtggatcccccgggctgcaggaattcgtctcacccctagaaaaaagcctgcaaaagccagcagcagcgagcgtcggtaggggagcccgggcagcggagcacacttgccctctccacctggaaccccgagcaggctccgccggccacggccggtgccgcgacgactcggcacgcgctagctagctagctgttcctcttcccgagggccccaccactaccaccatcctgccgcccggcctcgtgtggcggatgatgattcctagggagccgtggcggccggagcacccttccaactcctgatcccgagctgacccccgccatcgcagcggcggctctgccgcagcgtctgtgtccagacttatgatgatggagacccctcaaatcgagatgggcggtttcaaggtcaacagcccgcaagtgcccaacggcgtgttgcggcccaccgtgtcttcctcctggaactcgcgagagacggtcgagagggcgctcaagagcatcaggatcgtcattttcacttccaagctcaacttgctcatgccgttcgggcctgcgtccatcattctccacttcacgactaggaggcatggattgattttccttttcagcatgctaggaattacaccctttagctgagcgttttgggatattgcaactgagcagcttggcaatatacactgggtccaaacaggtgggtgggccttccggaatgcctacattttggaaattgca

SEQ ID NO: 90301 - protein, 90 aa, Zea mays
  misc_feature: Ceres CLONE 1578236
MMMETPQIEMGGFKVNSPQVPNGVLRPTVSSSWNSRETVERALKSIRIVIFTSKLNLLMPFGPASIILHFTTRRHGLIFLFSMLGITPFS

SEQ ID NO: 90302 - DNA, 888 bp, Zea mays
  misc_feature: Ceres CLONE 1578238
  misc_feature: Encodes the peptide sequence at SEQ ID NO. 90303
  misc_feature (587)..(587): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (609)..(609): n is a, c, t, g, unknown, or other
  misc_feature (610)..(610): n is a, c, t, g, unknown, or other
  misc_feature (628)..(628): n is a, c, t, g, unknown, or other
tggagctccccgcggtggcggccgctctagaatagtggatcccccgggctgcaggaattcgtctcacccctagaaaaaagcagcaccactccttcctccattcctccaagccacgccacacctcggcgcgtcccgccaaaaccccatcgatacccaaaccctagccagcccctctcccacgcgccatgtccgtcgcgtctgcggcggcggcggcctccctcatcgcctctacctcgctctccgtcccagaccgcatccgcctccatccccgccccgcacttcctccactaccgtgcttccgccgacgatcgcgggtctgcctcgtacgcgccgtcctcgaagaccgcccgtccccgcctgccgaggaggacgccaagcgctacgggctcaacgggaacgggagcgggctcggatacgacgatgccgccgtccaagcgtacctcggaagcaacggtaacggtagcaccagcggtaacggcggggcggtgaagcagaaccccgaggttgccgggagcagcgcggccatagtcccggccccggtcccgccggcggagggtgagaggagaggaagggagagtgagagatcntnnnnggggggaggggaggttnnttggtttaaaggaagagnagggcaaaaggtttctggttgctcccgggtgggcgctgggaatcgggtttaaaacctaattcaacagattcaaaagaacacgggaaaatatggggggattcggtttttaccatttaatattccaggggctgggcctcaaccaaatcaaaagttcaccttacaagaaggggggggagtgtctggaggaagaaaaaaaaataaatgggggggagggaaaagttcccttgcgccaagttggcctaaaaagagaaaaggtccct

SEQ ID NO: 90303 - protein, 164 aa, Zea mays
  misc_feature: Ceres CLONE 1578238
  misc_feature (135)..(135): Xaa is any aa, unknown, or other
  misc_feature (136)..(136): Xaa is any aa, unknown, or other
  misc_feature (142)..(142): Xaa is any aa, unknown, or other
  misc_feature (148)..(148): Xaa is any aa, unknown, or other
MSVASAAAAASLIASTSLSVPDRIRLHPRPALPPLPCFRRRSRVCLVRAVLEDRPSPPAEEDAKRYGLNGNGSGLGYDDAAVQAYLGSNGNGSTSGNGGAVKQNPEVAGSSAAIVPAPVPPAEGERRGRESERSXXGGGEVXWFKGRXGQKVSGCSRVGAGNRV

SEQ ID NO: 90304 - DNA, 813 bp, Zea mays
  misc_feature: Ceres CLONE 1578241
  misc_feature: Encodes the peptide sequence at SEQ ID NO. 90305
  misc_feature (696)..(696): n is a, c, t, g, unknown, or other
  misc_feature (733)..(733): n is a, c, t, g, unknown, or other
  misc_feature (785)..(785): n is a, c, t, g, unknown, or other
ccccgcggtggcggccgctctagaactagtggatcccccgggctgcaggaattcgtctcacccctagaaaaaacgcaacgattagccaaacagatcaatcatcttctacttcttcgtataggccgcgggatcccgaatcccaatccatagtcgccaccgtcgccggctacagggttcggtccccgtgatggagccctcgtcaacctcctcctcgccggctgtggagcgccggttgtcgccggaggtaaggagggtgcggaagcgggagctgaaggaggcactggagcaggtccagcgggcggttgagatgctgcgcgatgccgacgccgatctcggcgtctctctctcggaggagaccacagcagctccgccggagggcgaggaccgcgaggccgatgtcggtgccaatggatatggggcggagacgtcgtcggttgcgagtgactccgattacgagacggcccaggtgagcaggaggcgtcctgatccctcacgagttcttctgggcacgttgagggttccgggaactaggatttggatttccgaagtataagtcgttgcaacaggcgtaactgaatcggtaaattgcgtataagtcgttgcaataggcgtaactgaattagtaaattgcgtaattgaattgatatcagctacaatttatttttggccactacaaattgaaactaagtgcttgantaatacgtgaggaccctagagcctgtttgttcagacntacttatttttaactaaatgaaataagttagattatataatctcaaacaacnacacctaagttgggatgggtagtttgaa

SEQ ID NO: 90305 - protein, 121 aa, Zea mays
  misc_feature: Ceres CLONE 1578241
MEPSSTSSSPAVERRLSPEVRRVRKRELKEALEQVQRAVEMLRDADADLGVSLSEETTAAPPEGEDREADVGANGYGAETSSVASDSDYETAQVSRRRPDPSRVLLGTLRVPGTRIWISEV

SEQ ID NO: 90306 - DNA, 748 bp, Zea mays
  misc_feature: Ceres CLONE 1578242
  misc_feature: Encodes the peptide sequence at SEQ ID NO. 90307
ctggagctccccgcggtggcggccgctctagaactagtggatcccccgggctgcaggaattcgtctcacccctagaaaaaacggatctccctacacatcaggaaagccagaaggaaatactgtacctagctagccaccgcgcgcgcgcgcgaatagtctgcctggaatacactaccgttcaaaacaaacacaaagcgtcgtgctgcgtgatctctgactgcgtcgacaactaccgcagcaccaagtaggtgatggcagccaccgtatcttcctgcatgagcctcgttgccaccgtgaacaaccgggccggcaggttccccatcagtgtgggactgacgaagacgcttcagagccgtcgtcgttctagccgctatcttgtcgtcgcctcggcgacgagagccgaacaggaggccgcccctgtgacgatcgaggacgtggacctcagctctcataaggccgcggcctacgacaggtatctcgccgcgcggtggcgggaggtccacgccaccaacaactgggagggtctgctggacctcatcgactgcgtgctcctccagtagctcatccgctacggtgagttcagccaggccacctacgacagcttcgacgacgacagcttctccccctacagcggcagctgcaagtacccggcaaaaatcttcctacacgacatcagcctgcgatgcatcggctaccaggtcacccgatacctctacgcgacatgcaatgacctcaagtgccctaactc

SEQ ID NO: 90307 - protein, 102 aa, Zea mays
  misc_feature: Ceres CLONE 1578242
MAATVSSCMSLVATVNNRAGRFPISVGLTKTLQSRRRSSRYLVVASATRAEQEAAPVTIEDVDLSSHKAAAYDRYLAARWREVHATNNWEGLLDLIDCVLLQ

SEQ ID NO: 90308 - DNA, 773 bp, Zea mays
  misc_feature: Ceres CLONE 1578243
  misc_feature: Encodes the peptide sequence at SEQ ID NO. 90309
  misc_feature (281)..(281): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
ctggagctccccgcggtggcggccgctctagaactagtggatcccccgggctgcaggaattcgtctcacccctagaaaaaatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgnacggggggcggttcgccgcccccgacgtcgcgagaagtccattgaaccttatcatttagaggaaggagaagtcgtaacaaggtttccgtaggaacctgcggaaggatcattaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtggaaccgcacccgaggaacttggtggtcccccactcttttnnnnnnnnnnnnnnnnnnt

SEQ ID NO: 90309 - protein, 89 aa, Zea mays
  misc_feature: Ceres CLONE 1578243
MPPIPKRGEHLLVLLIVACAATAATAAGTVPFYPSAESAAAAHCDGTLYPELCLSTLADIPDLHKKPLPDVICAAVEPHPRNLVVPHSF

SEQ ID NO: 90310 - DNA, 2529 bp, Zea mays
  misc_feature: Ceres CLONE 1578244
  misc_feature: Encodes the peptide sequence at SEQ ID NO. 90311
  misc_feature (2372)..(2372): n is a, c, t, g, unknown, or other
  misc_feature (2375)..(2375): n is a, c, t, g, unknown, or other
  misc_feature (2379)..(2379): n is a, c, t, g, unknown, or other
  misc_feature (2381)..(2381): n is a, c, t, g, unknown, or other
aatagagagattattaattttaaacaaaaggtcaaagccttatctaccttatccttcattttattatcgtttttcaaccatggaatcttccaaattgtcacctcaagatattgagaaccaactcaaacaattaaatatcgagtatattttgcacaaccatgaagcttgcatgaatattgctgacctccaacaacacaccaagttaaatcacgcccctttgatcaaaaacatcttctctgaagacaaaaagggccaatgcttcctcatctctgctcgtcacgacaccattatcgaaagagctttctacaaaaaactcggaacttcttacagcaattgcagaatggccaagcctgaagtccttcaagctgtcctcggcgttgctcctggatccgtcactcctttcggtttggctaacgacaccgaaaagaaggttaaggccttcgctttggacgaaaacctcttgaaggaagaatggctctctttccaccctctcgttaatactcaaaccatcgaaatcaagagagaagatttcgtcaagtggttggccagtattgacagaaaacccgaagttcttaacttgagcgaaaaggaagaagttgccgccaagcctgaaaagaaggaagctgctcctaaagaaaagaaggctgctgaagaagacaaggatgacaccaaattgaaaattatgcataaaaagaatgaaagattctctgattggtacactgatgttatcgtcaagggtgatttgatcgaatactacgacgtctctggttgctatatcctcagaccttgggcttatggtatctgggaaagtatccaatccttcttcgatgctgaaatcaagaagctcggtgttgaaaatgcttatttccccatcttcgtctcccaaaaggccttgaacaaggaaaaggctcacgttgaaggtttctccgctgaagtcgcctgggtcaccaagtacagtgatactgacctcgctgaacccgtcgccatcagacctacttccgaaactatcatgtacaacgcttacagcaaatggatctccagtcatagagacttacccctcaagttgaaccaatggactaacgtcgtcagatgggaattcagtagccccactcctttcatcagaaccagagaattcttgtggcaagaaggacatactgcccacgccaccgaaaaggaagctgatgaacaaacttatgctatcctcgaattgtacagaagagtctacgaagaagtcttggccgtccctgtcattaagggtgttaagaccgaaagtgaaaagttcgctggtggtcactacactactaccgtcgaagcctacatccaagaaaacggtagagctgtccaatctgctacttcccacaatctcggtgaaaacttcgccaagatgttcaacatccaatatcttgatgaaaagaacgaaaagaaatgggtctggcaaacctcttggggtcttaccaccagatctatcggtatcatgatcatggttcacggtgatgatcaaggtttggtcttacctcctcgtattgccaaggtccaagctgtcattatccccgtcatcttcaaggattccgaaaagggtaagctcgatgctaaggccaaggaactcgaagaagaattggccaaggctggtgtcagagtcaagatcgatgatagaactaactacagtcctggttggaaatacaaccattgggaacttaagggtgttcctttgagaatcgaactcggccctaaggatcttgaaaagggtgaagttcgtttggtcaagagattcgatggctccaagagtcaattgaagcaagaaaacctcggcaaacaagtcgctgaaatccttgaacaaatccaagctgctatgttggctaaagccactgaaaagagaaatgtcagacttagagaagctcatgattgggaatctttcatgaaacatcttaacgaaggttgcatcgtcctcactccctggtgcttcgatgaagaagaagaaaagaaggttaagttgagatctaaggaagaagctggtcaactcagtgcttctgaatcccacttgactggtgctgccaagaccctctgtattcctttggaacaagaacccatcaaggaaggtgaaaagtgcttcttcactggcaagcctgccaagaagagagtcctttggggaagatcttattagaaaaaatagagaataatacttagctagaaaattcaatttatctatataaaaaattattatatgtacaaagtgagtgcataattcataattgttagtcgtcgtacctttacataatgtcataaatctctgattatcccttaataactaaaaaaaaaaaaaaaaacgagacgctcgaggtacccaattccccctatagggggtccgtaatatnacntgantnttgctgacctccaacaacacaccaagttaaatcacgcccctttgatcaaaaacatcttctctgaagacaaaaagggccaatgcttcctcatctctgctcgtcacgacaccattatcgaaagagctttctacaaaaaactcggaacttc

SEQ ID NO: 90311 - protein, 693 aa, Zea mays
  misc_feature: Ceres CLONE 1578244
  misc_feature (609)..(693): Pfam Name: ProRS-C_1 Pfam Description: Prolyl-tRNA synthetase, C-terminal
  misc_feature (486)..(583): Pfam Name: HGTP_anticodon Pfam Description: Anticodon binding domain
  misc_feature (241)..(417): Pfam Name: tRNA-synt_2b Pfam Description: tRNA synthetase class II core domain (G, H, P, S and T)
  misc_feature: SWISSPROT Homolog: EC 6.1.1.15 Proline--tRNA ligase
MESSKLSPQDIENQLKQLNIEYILHNHEACMNIADLQQHTKLNHAPLIKNIFSEDKKGQCFLISARHDTIIERAFYKKLGTSYSNCRMAKPEVLQAVLGVAPGSVTPFGLANDTEKKVKAFALDENLLKEEWLSFHPLVNTQTIEIKREDFVKWLASIDRKPEVLNLSEKEEVAAKPEKKEAAPKEKKAAEEDKDDTKLKIMHKKNERFSDWYTDVIVKGDLIEYYDVSGCYILRPWAYGIWESIQSFFDAEIKKLGVENAYFPIFVSQKALNKEKAHVEGFSAEVAWVTKYSDTDLAEPVAIRPTSETIMYNAYSKWISSHRDLPLKLNQWTNVVRWEFSSPTPFIRTREFLWQEGHTAHATEKEADEQTYAILELYRRVYEEVLAVPVIKGVKTESEKFAGGHYTTTVEAYIQENGRAVQSATSHNLGENFAKMFNIQYLDEKNEKKWVWQTSWGLTTRSIGIMIMVHGDDQGLVLPPRIAKVQAVIIPVIFKDSEKGKLDAKAKELEEELAKAGVRVKIDDRTNYSPGWKYNHWELKGVPLRIELGPKDLEKGEVRLVKRFDGSKSQLKQENLGKQVAEILEQIQAAMLAKATEKRNVRLREAHDWESFMKHLNEGCIVLTPWCFDEEEEKKVKLRSKEEAGQLSASESHLTGAAKTLCIPLEQEPIKEGEKCFFTGKPAKKRVLWGRSY

SEQ ID NO: 90312 - DNA, 835 bp, Zea mays
  misc_feature: Ceres CLONE 1578245
  misc_feature: Encodes the peptide sequence at SEQ ID NO. 90313
ctccccgcggtggcggccgctctagaactagtggatcccccgggctgcaggaattcgtctcacccctagaaaaaagggaaagcctcaaaaggcgacgcgcaagggccgaggagagaaaggaacctgaggaaggcacaccagtttcaagcaatccctaggccgtggcgacgcgctgggaaggattcaaatcaggggcgaagcctaggtgacggcgctcttagtcgcctctagtagctgcgcgacgcgggctggcttgtccgatcggtttgcctcggccatgtcgactaagaaagttctttgcaagttcttcatgcatggagcttgcttgaaaggagagtactgtgaattctcccacgactggagtgatcaagcaaataatgtttgcacattctaccaaaaaggtgcatgctcgtatggtagccgttgcagatatgaccatgtcaaagtttctcgtaaccccacagtgccaccaccacgcccaacgtcaagtacttcaagacgtgcatctacttctcttcaactttcaagttacaatcatccaccctcatatggtgcaccaaaacgattcaagcaaccaaagacatcagatatctgtgggatgggttggcacattctgcccagtaagcctgcatgggaaaaatgattttcagcatggattttgtttcaaaagatgggaatttgaccgggccttccaaatcaaaatttggataaaccagacttcctttgaaacctgtgggaatcccccctattttggttcctttggccggcggccggggaatttggccctttaggggggaaagggggccccccaaaaggctgtggagaaatcttttgc

SEQ ID NO: 90313 - protein, 121 aa, Zea mays
  misc_feature: Ceres CLONE 1578245
  misc_feature (31)..(56): Pfam Name: zf-CCCH Pfam Description: Zinc finger C-x8-C-x5-C-x3-H type (and similar)
MSTKKVLCKFFMHGACLKGEYCEFSHDWSDQANNVCTFYQKGACSYGSRCRYDHVKVSRNPTVPPPRPTSSTSRRASTSLQLSSYNHPPSYGAPKRFKQPKTSDICGMGWHILPSKPAWEK

SEQ ID NO: 90314 - DNA, 886 bp, Zea mays
  misc_feature: Ceres CLONE 1578246
  misc_feature: Encodes the peptide sequence at SEQ ID NO. 90315
  misc_feature (398)..(398): n is a, c, t, g, unknown, or other
  misc_feature (839)..(839): n is a, c, t, g, unknown, or other
  misc_feature (886)..(886): n is a, c, t, g, unknown, or other
gcggtggcggccgctctagaactagtggatcccccgggctgcaggaattcgtctcacccctagaaaattcgccatccatttttcatatcctcactcgccgccgccgccgctcgtccctcgccccatcgcgatggcccggatcaaggtgcacgagctgcgggggaagagcaaggcggatctgcaagcgcagcttaaggagtttaagtcggagctctccctgctacgcgtagccaaggtcaccggcggggctcccaacaagctctccaagatcaaggttgtgcgcacctccatcgcgcgcgtgctgaccgtcatctcgcagaagcagaagtcggcgctgcgtgaggcgtacaagaagaagaagctgctcccgctcgacctccgccccaagaagacccccnccatccgcaggcgcctcaccaagcaccagctctccttgaagaccgagagggaaaagaaacgtgagaagtatttccccatgaggaagtacgctatcaaggcctagatcagtgaaagaacatttatcctggtcaagttttgctcaaaagttaccttgaatttgagacaaatctattctcctccaaagtactatggtagctggaatcaaactgccttgatgaaaaaagaagtccttttttgctttgtttaaaccgggcttttaattttttccccaggcccccactcccaagcggaactcctcccctcggaatccacatggcccccatggaggccggcgaattggcttactttcccaccggcctccgtggaacctcaaccctgcaaggccaaaggtaagaaccccttttctgtcctcgtttcgcccaacacccgtggcgtacgtncctgggcccccatatattaacgcgggccttcgttcggcccaaaatan

SEQ ID NO: 90315 - protein, 123 aa, Zea mays
  misc_feature: Ceres CLONE 1578246
  misc_feature (6)..(64): Pfam Name: Ribosomal_L29 Pfam Description: Ribosomal L29 protein
  misc_feature (90)..(90): Xaa is any aa, unknown, or other
MARIKVHELRGKSKADLQAQLKEFKSELSLLRVAKVTGGAPNKLSKIKVVRTSIARVLTVISQKQKSALREAYKKKKLLPLDLRPKKTPXIRRRLTKHQLSLKTEREKKREKYFPMRKYAIKA

SEQ ID NO: 90316 - DNA, 781 bp, Zea mays
  misc_feature: Ceres CLONE 1578248
  misc_feature: Encodes the peptide sequence at SEQ ID NO. 90317
ctcaccgcggtggcggccgctctagaactagtggatcccccgggctgcaggaattcgtctcacccctagaaaatttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaagggtacctgtacccgaaaccgacacaggtgggtaggtagagaatacctaggggcgcgagacaactctctctaaggaactcggcaaaatagccccgtaacttcgggagaaggggtaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacggggcaca

SEQ ID NO: 90317 - protein, 98 aa, Zea mays
  misc_feature: Ceres CLONE 1578248
  misc_feature: SWISSPROT Homolog: EC 4.2.1.92 Hydroperoxide dehydratase
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGH

SEQ ID NO: 90318 - DNA, 802 bp, Zea mays
  misc_feature: Ceres CLONE 1578249
  misc_feature: Translation starting site: 142
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
ctcacccgcggtggcggccgctctagaactagtggatccccctgggctgcagggaattcgtctcaccctctngnnaanannnnnnnaaaaaaaaaaaaaaaaaaaaaaaaaaaaaaaattcccagccgccgacaaaccagtatgcacgcacgcacgcacgcagactccaggcctgaacatcatcaccgaatacatcatggggtacctgtacccgggccgtcccgtcgccaacatgtgcttcaaggtgtacggctacatcagcatgacgcaggcgctggccttcctgcaagacttcaagctgggccactacatgaagatcccgccgaggaccatgttcatggcgcaggtgggtgggggacgctgatcgcggcgctcgtgtacatcgggacggcgtggtggctcatggacagcgtccccaacatctgcagcacggagctgctccccgccgacagcccctggacgtgccccatggaccacgtgttctacgacgcgtccgtcatctggggcctcatcggcccgcgcaggatcttcggcgacctcggcacctactcggcggtcaactggttcttcctgggcggcgccgtcgcgccccctcctcgtgtggctcgcggcaccgggtgttcccgagccagagctggatcctgctcgtcaacatgcccgtgctcatcggctccaccggcatgatgccgccgggccaccgccgtcaactacaccacgtggatcatttgccgggttccctgtcgggggtacgttgttctacaagtaccgggcgtcacttgggtggggcggccacaacttactg

SEQ ID NO: 90319 - DNA, 1261 bp, Zea mays
  misc_feature: Ceres CLONE 1578251
  misc_feature: Encodes the peptide sequence at SEQ ID NO. 90320
  misc_feature (26)..(26): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (780)..(780): n is a, c, t, g, unknown, or other
aaaaaaaataaaataaaatatccccnccccccacccccannnaatanaataaataattatnnnnnntgannnnnnacaagctggagctcacgcggtggcggccgctctagaactagtggatcccccgggctgcaggaattcgtctcacccctagaaaaagtctcttccagaaacgtacctcgtcatctcttcgccttcgctacgcaattccgatccacgctgcgggccacttgtgacgactggcggaacccgcgagaaacagaggcgggcgagcggcgatcggagatggcgccggagaagccccggaaggaacaggaggaggagttgatgctggaggatggaggcatcgaggagagcccgcgccgcagcttcgaggactgcggcgacctccgaggaggaccgcggggagggcgatgacgaggaggagcgggacacccaccgcaacgggggggggtcgacgcgctcccttcctgccctaaaaggggccgccaagctcccgggaaacaacttgaacccctacaccaatcgcgtgcagtccccgggcctttgggctacgttaggggtcctttctaccaaggcaaagacctgccctccctcgtgcccgaggggccccgaggaaaagccgggggacctcgcgcgccctgcgcaaggccgaccctccgcgagatgagcggggcgtgaaaagacactgtaaatttcttttttgactaggagacgcatggttctccgaagaaacgccccctcgtgggtgggatcgcatgtaccacaatgcccccatgngtggtaagcccaacactccttctccagtctctccgcctagagtcggtgcggcaggggcgatgctgctcgcggggctcacgatacatatcctctccgatcacgcgagtgcgtaaccgtatcacagaagagagtgtagggcagctatatgtgtgaagcgctgcccagcatgcgatctgtggttgcagcttcggcgagacgcaggagctattgggacaagacgggtggaagaagaattgacgcggaggccgaagtatggactccacatcttttaccctgagggcggaccgacgtggggcggtccacgagccgaacacagcgcggtcgcgacgcagtcgtggcggtgtggtggaggctcggcggctgacctagaggcctacttcattgaagcgggaagtcgcactgcgctgtatgtacacacacagggccagacctcgacacctagacaataacgcgagagaaggctacgcactccggttagaaa

SEQ ID NO: 90320 - protein, 43 aa, Zea mays
  misc_feature: Ceres CLONE 1578251
MAPEKPRKEQEEELMLEDGGIEESPRRSFEDCGDLRGGPRGGR

SEQ ID NO: 90321 - DNA, 793 bp, Zea mays
  misc_feature: Ceres CLONE 1578253
  misc_feature: Encodes the peptide sequence at SEQ ID NO. 90322
ctggagctcaccgcggtggcggccgctctagaactagtggatcccccgggctgcaggaattcgtctcacccctagaaaaaacacaaaaaacctcaccttctcattccttcaagcgtcagcagcaaaaccagagcttcccttcaacccagcaagaaaaccaagcgacctagttagcgcagcggcagttatttgtgcagcccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccatcacccggaggctccgcgcgcagggcgtgcgcgggccgccctacacgttcttcaccgggagcctcggcgagatcaagcggctccgcggcgagggcgccgccgtcacgctggacgtcgacgaccacgacttcatccccatggtgcagccccatctgcgcaaatggatcgcgctctacgggcggacgttcgtgtactggaccggcgcgaggccgaacgtgtgcgtggcggacgtgaacgtggtcaggcaggtgctcttcgacggcaccggcctctacccaagaacctcatgaacccgcacatctccccgctgctcgggaaggggcctcgtccctcaccgacgggcgacgactgggaagcgccaaccgcaagggtcgtggcacccgggccttcaacatgggacaagctcaagactgatggacgggcaaaccatgtcctgaat

SEQ ID NO: 90322 - protein, 128 aa, Zea mays
  misc_feature: Ceres CLONE 1578253
  misc_feature: SWISSPROT Homolog: EC 1.3.3.9 Secologanin synthase
MGLAWMVAAAVAAVLASWAFNALVHLVWRPYAITRRLRAQGVRGPPYTFFTGSLGEIKRLRGEGAAVTLDVDDHDFIPMVQPHLRKWIALYGRTFVYWTGARPNVCVADVNVVRQVLFDGTGLYPRTS

SEQ ID NO: 90323 - DNA, 836 bp, Zea mays
  misc_feature: Ceres CLONE 1578254
  misc_feature: Encodes the peptide sequence at SEQ ID NO. 90324
  misc_feature (836)..(836): n is a, c, t, g, unknown, or other
tggagctccccgcggtggcggccgctctagaactagtggatcccccgggctgcaggaattcgtctcacccctagaaaaagatgtgcgtggcaacgtccaaaatccagaccgctggtaggagtacgagtatctcgtagacattgaacaacggctgcatggcgaccgcctgcgccacctccatccccctcgtctcggcgccctctgcatgcccgtccaagaagaccaccgtcgccaggttccggcgccgtacggcgacgtgcagggccagcagcggcggtggcggtggccgtggcggcgaaaatgatggcctcttgtggctaccccggcgggacgtgatgctcaacggcctgtccagtgtcgccgccgggctcgcctggtacccgggcgtcgcgtccggcgcggatgcggtgtgcaccagggccgacaaagtgaacgagaagaccgtgcagtgcacggacccggccgggcagcttccgtgccctctggtgtcgccgacggaccccgtggacttcaagccggaaagcaaggtgacgcgcatccggcagccggggcatctcctaaggcgggagtaccaggagaagtacaaggaggccgtcgcgaatatgaaggcgctaccggaagagaacccgctgagcttcgcggcccaggcggccatccaccaggcttactgcgacgcctactacaagtacgacccgacggccatggacgcgccgttcgacgtgcactttctcgtggatcttcgcgccgtggcacgcatgtacatctacttctacgagcgcgccctcgggcagctcatcggcgacgacacctttcgcgctgcgttctggaactgggan

SEQ ID NO: 90324 - protein, 226 aa, Zea mays
  misc_feature: Ceres CLONE 1578254
  misc_feature: SWISSPROT Homolog: EC 1.10.3.1 Catechol oxidase
MATACATSIPLVSAPSACPSKKTTVARFRRRTATCRASSGGGGGRGGENDGLLWLPRRDVMLNGLSSVAAGLAWYPGVASGADAVCTRADKVNEKTVQCTDPAGQLPCPLVSPTDPVDFKPESKVTRIRQPGHLLRREYQEKYKEAVANMKALPEENPLSFAAQAAIHQAYCDAYYKYDPTAMDAPFDVHFLVDLRAVARMYIYFYERALGQLIGDDTFRAAFWNW

SEQ ID NO: 90325 - DNA, 854 bp, Zea mays
  misc_feature: Ceres CLONE 1578255
  misc_feature: Encodes the peptide sequence at SEQ ID NO. 90326
ctccccgcggtggcggccgctctagaactagtggatcccccgggctgcaggaattcgtctcacccctagaaaaagtgacaaactcacagcacagacgttcctctcctcttacatcgtcgtcctcgctcccggtcccgtctgtttagtctagtctgctcttctcgcttgcaacccctgtactgtacgtgctaggcacacaggataactgcagctacagtagggcagcaaatggtttctggtgcgggtcatggtgggtacggccgttgcgacgaccggtatgccgtccacttccggggaaaaacagccgacaagtccaggaccggaggctggctgggatccaggctgatccttggatacagagctggccgatcgcgtgtgcgtgatggacatcaccatgaacatggtgacttacctcgttcgatagctgcacctctccaactcctagtacgccaccgtggtgaccaacttcatgggcaagatcaacctgctcgttctcgtctgcggtttcctcgacgacgccgaggacagacacaacctcagcaaggtcatatacaccacaaactccgccacaggatttgagcttcgctgacggatgaacactacagtgaataatcatgttttgcgccggctgtgtctgaacctcccgacgagcttctaagtgctaataagggcgtttcaagctaccccgggggggccagttgtgggctgcaagtaacccagacactttaaacactcgttgtcggaaaaagaaacttaattggctttaaacggcctaaaatttgtcccgggatttaacggttcagaaacagttttcttactggccccccacaaccctggggggaaagaaaaacccc

SEQ ID NO: 90326 - protein, 39 aa, Zea mays
  misc_feature: Ceres CLONE 1578255
MGKINLLVLVCGFLDDAEDRHNLSKVIYTTNSATGFELR

SEQ ID NO: 90327 - DNA, 690 bp, Zea mays
  misc_feature: Ceres CLONE 1578257
  misc_feature: Encodes the peptide sequence at SEQ ID NO. 90328
  misc_feature (300)..(300): n is a, c, t, g, unknown, or other
  misc_feature (398)..(398): n is a, c, t, g, unknown, or other
  misc_feature (408)..(408): n is a, c, t, g, unknown, or other
ctggagctccccgcggtggcggccgctctagaactagtggatcccccgggctgcaggaattcgtctcacccctagaaaaagtggactcctactcctactcctactcctactctctccccttcctcccgttgattgattgaggggattgctactaggcgggcgctagcactgcgaagcatctcgcctcatcgtctcctccgtgctccacttgcccattcttacgcgctaagcaacaggccagccggccgtagctccaaagcgggagccggagccggagccgggagctaaggggggccgtgnatgtcgtcgtcgccgacggccgcgccggcgccgaccacgccatcggctcccgcggccaacgcgacaaatccgccgccccgcgacccccgtccgcgccnccaccggggngggggggccccaaaggcttcccaaggccaaccccggccaggcggtcccggcggtcccagacggggcggcggccgtcccccctcggtccgggcccccgggcggtcttccacccccgggaaaatccctttggccctcggccccttctccccttttctcccccgggggacccccccccccccccgggggcccctcattggaaaaaaccccttttccccccctttttttccccggggaaaagggggggggggggcccccccccccttctttttggggggggggggg

SEQ ID NO: 90328 - protein, 45 aa, Zea mays
  misc_feature: Ceres CLONE 1578257
GAPRGGGRSRTSGSPGLQEFVSPLEKVDSYSYSYSYSLPFLPLID

SEQ ID NO: 90329 - DNA, 1312 bp, Zea mays
  misc_feature: Ceres CLONE 1578258
  misc_feature: Encodes the peptide sequence at SEQ ID NO. 90330
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (11)..(11): n is a, c, t, g, unknown, or other
  misc_feature (12)..(12): n is a, c, t, g, unknown, or other
  misc_feature (1239)..(1239): n is a, c, t, g, unknown, or other
nnnnnttaaannttccccttccctcgccagaccctcaccgaccgcttccgcccccctctttttgtatagagtaaaaactggaactccccgcggtggcggccgctctagaactagtggatcccccgggctgcaggaattcgtctcacccctagaaaaaaatgccactcgaacccagagctagctggttcttcccaaaatgcgttgaggcgcagcacttgactggacatctaggggtaaagcactgtctcggtgcgcgctgcgcgagcggtaccaaatcgaggcaaactgtgaatactagatatgacccaaaaataacaggggtcaaggtcggccagtgacacgatgggggataagcttcatcgtccagagggaaacagcccggatccccagccaacggccctaaatgaccgctcagtgatacatgaggtgggggtgcaaagagagccaggaggtttgcctagaaccacgccccccgttaaagacccccccactagctcacttgagggaagcgcccttttcccctgaaagattgaacgggggctaaagcggattcctgcccaaagactgggggggaaagttaaaaatatgccatcacgaaatggtggaaaccggtttccctcccctctttcaagtggggaaggccgaaatacggccgaaaaggctaggggggggcgtccggacccaaaatcaccggttaaaaccccgcaggaaaaattgtgcccccggcccgttttacgagtgttaccgcgttcagagactacctctctagtgggtggtagacagaaatccagcccacaacacatttaggtacccccccccctgataaaaataaacgcccccccgcgaatacgggggtgactgtttttccgcctctgcaccccgagacccacacataggggtttatattcccacagctccccacacaacgtataaaatgaaacgggggcccgccgaacacatgcctctaaaggcgggggctgcctcttctcagaggtgattccctctcctgcgcgtaccgcggtacaaaataatcgaggggggcccggtagatgagctgaatggaaagaagtgagtcagcacaaacatgtgtggtaagcccgaacataaggaataatacacaaccgaggatggtctacctataaccccgcgtcacctttatgcactcgatagcttgtgtcaccccggacgaccacgggctgcccctctctcggagcagagcatcacccccactatctggtnttacacgcgtacctctcatagctaggacttatggtggggttgtgtctatagcgcgtttacatattatagcgcg

SEQ ID NO: 90330 - protein, 59 aa, Zea mays
  misc_feature: Ceres CLONE 1578258
MPLEPRASWFFPKCVEAQHLTGHLGVKHCLGARCASGTKSRQTVNTRYDPKITGVKVGQ

SEQ ID NO: 90331 - DNA, 841 bp, Zea mays
  misc_feature: Ceres CLONE 1578261
  misc_feature: Encodes the peptide sequence at SEQ ID NO. 90332
ctggagctcaccgcggtggcggccgctctagaactagtggatcccccgggctgcaggaattcgtctcacccctagaaaaaagacccctcctccaaaaatcccagaataccttgggctcccgagcaggagagagcaatgcaacgagccatccggatagccgcggctgcgacaaggcgagcgctgtcgtcgtcggcggcgagggcatcaccccctcctccccgcggacccctggctcctggctggggcgccactaggtggctctgcagcgggcgggaggcgctgagctacgacgtggtgatcgtgggcgcaggccccgcggggctcgccgcggcgatccggctgaagcagctctgccgcgctgctgacaccgacctctccgtatgcgtcctggagaaggggctcgaagtcggtgctcatgtgctgtcggggaatgtgtttgagcccccagcctttggacgagctcattcccaggggaggcaagaggattctccaatccgaatttcctggtttcatctgaacaggttctggggtggttaacgaaaaacccaagcttggaaccctacccttcctccttttggacaccaaagggaaacttccgggattcagccttgaggccaattggggtgcctttggaatgggcccccaaaaacctaaagaaggtgggtgggtttaaaatgttttcccagggtttttgccggccaagggggaaaccctttttggggggaaaaacccaaatttgtttccgggggggcccccaacccaattgtgtttttgggtatttcgccccaggaggggggtcccccaaaagggggaaaaattttttcccccccgggggggggaa

SEQ ID NO: 90332 - protein, 133 aa, Zea mays
  misc_feature: Ceres CLONE 1578261
  misc_feature: SWISSPROT Homolog: EC 1.5.5.1 Electron-transferring-flavoprotein dehydrogenase
MQRAIRIAAAATRRALSSSAARASPPPPRGPLAPGWGATRWLCSGREALSYDVVIVGAGPAGLAAAIRLKQLCRAADTDLSVCVLEKGLEVGAHVLSGNVFEPPAFGRAHSQGRQEDSPIRISWFHLNRFWGG

SEQ ID NO: 90333 - DNA, 829 bp, Zea mays
  misc_feature: Ceres CLONE 1578262
  misc_feature: Translation starting site: 188
  misc_feature: SWISSPROT Homolog: EC 1.4.1.2 Glutamate dehydrogenase
  misc_feature (758)..(758): n is a, c, t, g, unknown, or other
ctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctactttcacgactcacagaggcaggccacgaaggatgctggggtgattgctggcctcaatgtgctgcgtatcatcaatgagccaaccgctgctgctattgcctatggtcttgacnagaaggcaaccagcgtcggtgagaaagatgtccctcatcttgaccttgggaggtggtaccttcgatgtctc

SEQ ID NO: 90334 - DNA, 599 bp, Zea mays
  misc_feature: Ceres CLONE 1578266
  misc_feature: Translation starting site: 264
  misc_feature (402)..(402): n is a, c, t, g, unknown, or other
ggagctcaccgcggtggcggccgctctagaactagtggatcccccgggctgcaggaattcgtctcacccctagaaaaaaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgccccgcgctgtcgggagcagccggagcgctgccgcgaggctgctgctgctcccgcctctccggctgcgccgcggccggcgcgccgcctccgcgtgcncggtgaaggcgggcctgcacgggctcgactccgtcggcgggccccatctccagggccgcgctgggagcgccccccaaggggcgggggcttttaaaaaaccttttccccaaaaaaaaaagggggttaaaccccggggggggggaaaaaccccccccccccccggggccccggggggggggaaaaaaaaaaacccccca

SEQ ID NO: 90335 - DNA, 850 bp, Zea mays
  misc_feature: Ceres CLONE 1578267
  misc_feature: Encodes the peptide sequence at SEQ ID NO. 90336
ctggagctcaccgcggtggcggccgctctagaactagtggatcccccgggctgcaggaattcgtctcacccctagaaaaactcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaagtatccaacattcgttgatgctcttcgtgacttggatgactgccttacaatggtgcatctggttgcggcatttactgctggtgacggtgaacgtgttgaggtccaacgaattcctaactggccgcagggttaaccatgaatggcaagcattccttttcccaaacccattctctgaagaaaaacatttttttcccggaaaggggaattttttttcccggctgaaaattcaaggaacaaaagatcccccggggtaaactccccaatgcctcttcaaccaaggttttaaaccggaggaagggtggaatttcaaagggggaaggcccttccctttccacaaaaatctcattggaaaaccccta

SEQ ID NO: 90336 - protein, 163 aa, Zea mays
  misc_feature: Ceres CLONE 1578267
  misc_feature (8)..(164): Pfam Name: Pescadillo_N Pfam Description: Pescadillo N-terminus
MPKHYRPAGKKKEGNAAKYITRTKAVNYLQVSLAIFRKLCILKGVFPRQPKKKVEGNHKTYYHTKDIAFLAHDPLIEKFREIKVHRRKVKKAVAKKNRDLADRLLNRPPTYKLDRLVLEKYPTFVDALRDLDDCLTMVHLVAAFTAGDGERVEVQRIPNWPQG

SEQ ID NO: 90337 - DNA, 851 bp, Zea mays
  misc_feature: Ceres CLONE 1578269
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (541)..(541): n is a, c, t, g, unknown, or other
nnnnnnttggggnnnnnnnnnnnnnnnnnnnnnnnnnncnnnnnnnnnnnnnnnnnnnnnnnnnnntccttttttttgaatgctggagctccccgcggtggcggccgctctagaactagtggatcccccgggctgcaggaattcgtctcacccctagaaaaacgaccgcttggcgcttcatcactcgtttcctttcgaaagcccgcgcacgcacgtcggtcgtcccgagcaggacctcgatcggccgagatggcgacgccgaacgggcttgcgcgggatcgagacgaccggtgaagaagaagcatgacatacggcgtgtgggtacgtacgacatgctgggcgccggtgcgcgcgcagaccatcggacgagctgcactccgctgcagcggaaagcgggtcggggccccaagcacgcccccaaacggggtggggggcccaacaaggcccatttaaagggggggggggccccaatttgggccctttttgccggggtgcgggaaattttccccgaaggggaaagagaggccccccccaccccccnaaaaaaaaaaaaggggggggcccccacacacaaaggggggggcccccctttgtgggggggggcccttcccttttgaaaaaccgggggttaaaaaaaaacccggggggggggcaaaaaaaaaaaagtgggggggccacaaaggggggggggggaaaacacccccccgcgcgggggggggggaaaaaaagagggggggggggaaaaatttgcccccccccccccccccccccccccccacacaagggggtgggggggggggcccccccccccctcttttttttttttatatccccccccccgcgcgggaggg

SEQ ID NO: 90338 - DNA, 783 bp, Zea mays
  misc_feature: Ceres CLONE 1578270
  misc_feature: Encodes the peptide sequence at SEQ ID NO. 90339
ctccccgcggtggcggccgctctagaactagtggatcccccgggctgcaggaattcgtctcacccctagaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgatgagatctcctccatggttctcatcaagatgcgtgagatcgctgaagcttaccttggcagcacgatcaagaatgctgttgtcacggtcccctgctacttcaacgactcacagaggcaggccacgaaggatgctgggggtgatgctggccctcatgggctgcgtatcatcaatgagccaaccgctgctgctattggctatggtcttgacaagaaggcaccagcgtcggtgaaaaaa

SEQ ID NO: 90339 - protein, 199 aa, Zea mays
  misc_feature: Ceres CLONE 1578270
  misc_feature (9)..(199): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVIPGPGEKPMIVVQHKGEEKQFAADEISSMVLIKMREIAEAYLGSTIKNAVVTVPCYFNDSQRQATKDAGGDAGPHGLRIINEPTAAAIGYGLDKKAPASVKK

SEQ ID NO: 90340 - DNA, 814 bp, Zea mays
  misc_feature: Ceres CLONE 1578272
  misc_feature: Encodes the peptide sequence at SEQ ID NO. 90341
  misc_feature (657)..(657): n is a, c, t, g, unknown, or other
  misc_feature (694)..(694): n is a, c, t, g, unknown, or other
acccgcggtggcggccgctctagaactagtggatcccccgggctgcaggaattcgtctcacccctagaaaaattgacacatcgttcatcggatccagtcctctcccgggatcacctccggctataaatttccgtccccaattcacccaatccagatgcgcaaacatcgaatcgtctcgctagtggctgccctactcgtgctgcttgcccttgccgccgtttcctccacgcgcagcacacaaaaggagtccgtggctgacaacgccgggatgttggcaggcggcatcaaggacgtgccggcgaacgagaacgacctccagctccaggagctcgcgcgcttcgccgtcaatgagcacaaccaaaaggccaatgctcttctggggttcgagaagcttgtgaaggccaagacacaagtggttgctggcacgatgtactatctcactattgaagtgaaggatggcgaagtcaataagctctatgaagctaaggtctgggagaagccatgggagaacttcaagcagctgcaggaattcaagcctgttgaagagggtgctagcgcctaaggatctgtcgtctccctgtgcaatttgctgcctgaagcgcaaaactaagttgcagaataaggagctgcttcggaacatgccagagcatgcacccntcgcgtattttcaaaaaatcagtgctcttaatgtaantatcttgaattgccgtgccattgtgtaataagtaatatcatggaataaacagtggctaatatggggtttctaaaatgtgtattaaacagccatcccatggccaaagtttctcaatattac

SEQ ID NO: 90341 - protein, 135 aa, Zea mays
  misc_feature: Ceres CLONE 1578272
  misc_feature (42)..(130): Pfam Name: Cystatin Pfam Description: Cystatin domain
MRKHRIVSLVAALLVLLALAAVSSTRSTQKESVADNAGMLAGGIKDVPANENDLQLQELARFAVNEHNQKANALLGFEKLVKAKTQVVAGTMYYLTIEVKDGEVNKLYEAKVWEKPWENFKQLQEFKPVEEGASA

SEQ ID NO: 90342 - DNA, 1216 bp, Zea mays
  misc_feature: Ceres CLONE 1578274
  misc_feature (14)..(14): n is a, c, t, g, unknown, or other
  misc_feature (55)..(55): n is a, c, t, g, unknown, or other
  misc_feature (63)..(63): n is a, c, t, g, unknown, or other
  misc_feature (71)..(71): n is a, c, t, g, unknown, or other
  misc_feature (92)..(92): n is a, c, t, g, unknown, or other
  misc_feature (775)..(775): n is a, c, t, g, unknown, or other
  misc_feature (1027)..(1027): n is a, c, t, g, unknown, or other
tttgtgggggcttnttccccttatttaattaaatataaatcctcttaccaacctncccctccncccacccnttacaaaactggaactccccncggtggcggccgctctagaatagtggatcccccgggctgcaggaattcgtctcacccctagaaaaattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctcttttgagggagggggaagtaataaaagggaaaaagctagcaagggggatttcccttgatcccatcatcggtgctacaaaatccctttagtttctagccaagggaggagggaaaaacaaaaacccaagcccctggatccccagcccggatgaatgttcccccattctgggggggggggggccgaccttcccgggcggccttttgaaaacccgcccccttcccgaatgaaaccaaatgtcccggccccggcccccccccaaaaaggcgcgccaaatgggggacaaaaaccccctcctttttatctttacaccccccctctattttgcggcggaaatttgtccccccgaaaaaaaaccacgctccacttgtcgttgtgtgtgggagaaaaaaacaacccccctccctcacacagagaggaaaaatgtattttctacccctctatggntgatccacgaaaggatggccgctgaagaattttcgtgttggcctacttttttatagacaacacccccagaggatgctcccaccacaccacgacggggtggggcgcccgccccttttgtgggttgggtgtggcgaaaatgctctttctctccacagaggggaggggtggtcggcagataaaaaaaaatcttgtgttggtggccccaaaaagagggggggaggattgccgtcacaaggccggtggggggggtgngtaaaagagaagaaaaaaaaacaacgggatggaagcggtagggtgggtgtggggtggcaacctcccccccaatcgcgaaaaaaaggcggcgccgcgccggaagaaatatttttttgttctcccccccgccacggggagaacatccttcggcacccccccagagggtgggcccccccccccccccccccg

SEQ ID NO: 90343 - DNA, 1169 bp, Zea mays
  misc_feature: Ceres CLONE 1578279
  misc_feature (749)..(749): n is a, c, t, g, unknown, or other
  misc_feature (966)..(966): n is a, c, t, g, unknown, or other
ggtggggggtgtgggtctggggttctcctcgcgcgtcggatgggcccggggtggggggttaatatccacatttcctaggggtatgggggggtccccgcggtggcggccgctctaaaacagtggatcccccgggctgcatgaattcgtctcacccctagaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcggggtccccagcagtgtggcactgacaaacacgcttcatggccgtcatcgttctcgccgcaatcctagtccttcccctcggccaccaaaagccaaacaggaaggccgccccccctgggaactatacgaaggaccgtggaaaccccagtctcctcaataaagggccggggggcccgaatgaacagggggaaaacctcctcccccctcccccccgggagggccccaggaaaaaggatcccccacggggggcacggccccaaaaacaaaaccttttggggcgaaaagggggagactccttggcgccctggggggagaacaccccccaacattttttgtggaaaaccaggggaggcgnaaatatagtatatattttagcgcttcttgcccgcgaggggggaagaaagggcgctgctcaccatatgtcctccggcgcgcctttaaaccccgggggggggtagagaaagagtttcccagctagcccaaccccctaagggcggccgccccacctcccccttcttcacggcagacaagagcgtgggcgtttgtgttgggggtagtattgagaccgacanctccccccccggaggttgtttattcactccccccgccaccaacaaaaatgctggggcggtggggcaaggtccggcgtggagggcgaagaaggtgactccccgccccggcgggggggagaaaaaagaaaagaaatcttgtttttttcggtgtcctccacaagaaaaacaagaatgtataggtggatgtctcttcggtggatggg

SEQ ID NO: 90344 - DNA, 898 bp, Zea mays
  misc_feature: Ceres CLONE 1578284
  misc_feature (810)..(810): n is a, c, t, g, unknown, or other
  misc_feature (811)..(811): n is a, c, t, g, unknown, or other
ctggagctccccgcggtggcggccgctctagaactagtggatcccccgggctgcaggaattcgtctcacccctagaaaaaacgagcggaagacagacaggcaggcaagcgagaccaaggcgggggcggagcgcgagaggcgacgcgagaggcgagaagtggaggcggtgctgcggtggcatgccatggttataaaaagtaacggagcgcgacgagggtagaaagaggaaggcccgccgcttccccttcttcattcccgtcccacacacgccgccgccgccggtgcggctcgcttccgtcccccccggtccgcgcgggctgcctgcgggagcagggtggcaggtcactccggctaccacgtgtggtggggaggcgacgacaccaccctatgctctgtcctcgcccgcagggtaagattgcagcagcagtgaatttggggagctgaagcattcatctgagacatggaaaaagtgatctgctgggcatttctccttcaacgcaagcagttctcgaaagaaaacccttgattggcggtggcttaaacccgggggaccctcccctccccccctcccggggaacaaccacaagggattttatgggtccccttggcccaaaaaaaaagagggcgggagggaatttttggccaaaagatttttatttttgggcttttgccgaaaacctccggggggaggggggcccaataaaagggggggggggaaaattttgggggggggcaaccaaaaattgggggggggccccacaaaaaaaatttgttttttttggggcccccccggggggggaaaatattttnncacgggggtggtgggaaaaccccccccggggggggggggggtcccccgggggggggggtattttccaacaaacaccctctttttttt

SEQ ID NO: 90345 - DNA, 1316 bp, Zea mays
  misc_feature: Ceres CLONE 1578286
  misc_feature: Encodes the peptide sequence at SEQ ID NO. 90346
  misc_feature (29)..(29): n is a, c, t, g, unknown, or other
  misc_feature (47)..(47): n is a, c, t, g, unknown, or other
  misc_feature (52)..(52): n is a, c, t, g, unknown, or other
  misc_feature (838)..(838): n is a, c, t, g, unknown, or other
  misc_feature (848)..(848): n is a, c, t, g, unknown, or other
aaaaatatattaccatacagcacgccctnctataacatatacaattntggtngggaaaagaaaaataaccttatttttagatgggtcaaaaccagaggccgctctaaaaaattggatcccccgggctgcaggaattcgtctcacccctagaaaagagccgcggcgtctccaagtacctcgctcgcaggagcaggttgcaaggagccagccactcctgcgagtttctggcgatggtggccgttgcggcgggaaggcgggccggcggcgttggtggccgccggagctcgggctgcggcgcggggcaggcacagcacaagctactagcgatcgccgtcgccgcgcgcttcgctgaggccgtggcgccgccgtctgcggaggcctcccgtgccggctccggcggctgttgcgtagagctcctcgagtgcctcctcggggctctgagcgtaaacgcggccccgcccccctgcgcaaaacaggcgggcccatgcactcgatccgcccaacgcccgccccccgagggaggggggggtccccgggaacaatcaggcaacagtccaaagcctcccccttcgggggcgtaattcccgggggcaaacgaggggccaatctctgtaattaaagaaaaggccgtcagagtgatgtcctacaccccaaaatgaccagaggagaaagggaaaaaggggggaggtccaaattctcacgggaccccctccacatggagcggggcgggccctgtgggagaagaaaaatatatgttttgggtgggtgctctatatcggggcgtatgacataataacgccccccctcctgactcttcttgtgggaggagtggaggggngtgtatattnttgtcgaagatatggcgccgcgccacagtggggcacccgccccgtagacaaaggggggcgccgccgacttattatgcggatggttgtcgcaccccaacaacaagagagggggtgcccgccgaaaagaagaatgctattgtatgccccccctctgtcgttaaaacagacatgtccgtagagtggggccacacaatttgttattggcggtaaagagggggagttggaaatcatatccaacaacgacaagtattttttcggtgactatgagtatataatctacctataacgacagagggtgggaaacaaatcatatataggaagggatgttgtccatactccgattactatactgcggatgctatgaacaaaaaaattacgcagggcgtatcttccgcgttgggtaatgagtcagcaatgaggtgtgggcggggcgcccaacaattatatattgttgtaagagtatgagaa

SEQ ID NO: 90346 - protein, 116 aa, Zea mays
  misc_feature: Ceres CLONE 1578286
MVAVAAGRRAGGVGGRRSSGCGAGQAQHKLLAIAVAARFAEAVAPPSAEASRAGSGGCCVELLECLLGALSVNAAPPPCAKQAGPCTRSAQRPPPEGGGGPREQSGNSPKPPPSGA

SEQ ID NO: 90347 - DNA, 801 bp, Zea mays
  misc_feature: Ceres CLONE 1578287
  misc_feature: Encodes the peptide sequence at SEQ ID NO. 90348
  misc_feature (617)..(617): n is a, c, t, g, unknown, or other
  misc_feature (689)..(689): n is a, c, t, g, unknown, or other
acccgcggtggcggccgctctagaactagtggatcccccgggctgcaggaattcgtctcacccctagaaaaaatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttgacggtatccagcgacctctaaaaacatcgctattaagtcaggagatgtgtatattcctcgtgggtgttcagttcctgcccttgacaaagatgtattggtgggaatttcagccaacgaagctaggtggtgggagatgtcatcacanggtggagatctataccgctactgtttttggagaacacattgatggcacaccatgttgctcctccaccggggncttatggggaaaataagttacattgcaccaagctgggccagtacaacctgcaggacacaggtgctagaaattggaatttccagggcataaaaaagaaattttacaatgcttc

SEQ ID NO: 90348 - protein, 177 aa, Zea mays
  misc_feature: Ceres CLONE 1578287
  misc_feature (22)..(84): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (149)..(149): Xaa is any aa, unknown, or other
  misc_feature (173)..(173): Xaa is any aa, unknown, or other
MAYGDRVTTFEDSEKESEYGYVRKVSGPVVVADGMGGAAMYELVRVGHDNLIGEIIRLEGDSATIQVYEETAGLMVNDPVLRTRKPLSVELGPGILGNIFDGIQRPLKTSLLSQEMCIFLVGVQFLPLTKMYWWEFQPTKLGGGRCHHXVEIYTATVFGEHIDGTPCCSSTGXLWGK

SEQ ID NO: 90349 - DNA, 1205 bp, Zea mays
  misc_feature: Ceres CLONE 1578288
  misc_feature (60)..(60): n is a, c, t, g, unknown, or other
  misc_feature (61)..(61): n is a, c, t, g, unknown, or other
  misc_feature (68)..(68): n is a, c, t, g, unknown, or other
  misc_feature (69)..(69): n is a, c, t, g, unknown, or other
  misc_feature (870)..(870): n is a, c, t, g, unknown, or other
  misc_feature (921)..(921): n is a, c, t, g, unknown, or other
  misc_feature (983)..(983): n is a, c, t, g, unknown, or other
  misc_feature (1020)..(1020): n is a, c, t, g, unknown, or other
  misc_feature (1070)..(1070): n is a, c, t, g, unknown, or other
tttttttttgttttttttgttagggggaggtgaggggctggggggtggcggtcttttttnnaaacttnntttgaaaagtggggctccccgcggtggcggccgctctataactagtggatcccccgggctgcaggtatttcgtctcacccctagaaaaaacgcagcggaacagagacagggttgctggccatatctccgcgggggaggactccaacatgctaccctctacgccagaagggtagcccgcgcatgcggcgggctgccgaggtctatcaaaggcagcggagcgcgactaatgtagaaagaggaaggcccccctcttacccttcttcattcccgtcccgcacacgaccaaccgccgccagtgccgctcgctgccgtgccccccggcccactcgggctgcatgccggagaagactggcggggcactcatgatgacagtcgtgggggaaggcaagcacacgaccctgtgctttatcatggcccgcagggcaaaattgccgcagcacccaattgggcagcctggaaccttcgtactgacacatggagaaaggggatctgctgggcactatcttcctatgaacgcagggcaacttctgcgcaaagaatgactcattgcatttgctagtgatcgttagacgcaacggggaaacaactcctcctctggtaagcctctctgcggaggaacctaggaactctaggggccactcatgatcggtccgcagtccactggggttcgtgactgaacacagtccagggccgttgcatcgtctaaattttggtttccgcctggcaaagtgtcaactccaaagtaatcccctgcgcgtgccctcaatagacacaaggaaacctccccgttatctttgtccnggggactcgggggtggcgacaaggccttagacacttgctgggcgggcattntaggtaattatacttttggccctggggtgccggtgaaggcccttacacagaaatcttgttanttccctgggcgccaaattgggaatataaagtcaggantctgggggcgaaaattttgtggccccaaaatccgtatggccgtcccaagncgccactaagaaaaatgttgcgttgcgaaaggggtaagaggcacccctgtgtcgctctaaaaaatcaccagttccgcactctcgagaagatagtgccccccacgtttgtatatgcacacaaaaaggtgaggcggg

SEQ ID NO: 90350 - DNA, 704 bp, Zea mays
  misc_feature: Ceres CLONE 1578292
  misc_feature (308)..(308): n is a, c, t, g, unknown, or other
  misc_feature (417)..(417): n is a, c, t, g, unknown, or other
ctcaccgcggtggcggccgctctagaactagtggatcccccgggctgcaggaattcgtctcacccctagaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcnttcgtcgttttgaatttgatgtactaatggagtctaagggtgggcagaagtctagcagtagtcgttccatgatgtatgaagctccccttggctacagcattgggggacngttcgaccctggccggagggcgcgaaagaaagttccaggtctggctgctttacttcaaactggcgcaaaagaagcccattcctggatatccccctttttgggcttcccctcggttcctaggaaggttttagggattttcctttttccgggacacctttcggatttcctttacccaaatcccccccctgggggcccgggcgtggctttttcccgtggaaaaaatttcgaaccccagagttctccccccccggttcctttgggggctccccctgggggaagggttcccc

SEQ ID NO: 90351 - DNA, 800 bp, Zea mays
  misc_feature: Ceres CLONE 1578294
ctccccgcggtggcggccgctctagaatagtggatcccccgggctgcaggaattcgtctcacccctagaaaaaatccggcccgcgcgctgtttaggtagaattctctcatagcagggtggggctccgccgccggcgctcatctgctcctagaggtgaccggaccaatgaactcggcgagtttggagatagagaatcgcttttcgcagcctgcggtctgctgggtcaggtggtgttgaaagggagaagttaaagatctgttccaaagatcacgcgcgcgcgctcgcgatccacgggtacctcacttagcttcgacctctcgaattggatgtgcccctgcaggatgaggttggcaacaagtccatctgtgggcattacctgatgtatgtgactgccgccccccacaagtttgaggaggttctacctgcggggaggttcgcagaagtcccagtctgctgggtcctcctgctgcaccaaagaacccatgctgataccccgtctgagcggccttggctcctaggctttaggatttctttttcggaaggttcgattcttaccaagtcccttgggcctggccgcttaccggaacgagccacaaaagcccccaggctgtgctcggagaagaacctcccgtcatccctttttaagaggatggggttttccagctacccctgcggccagggggattgttcctttccgggtgtccgggttttttcctataggcgccgcgggattttgcgaggttttaccgggccctaagatgaagcccccattgggaaaatggccctcctccccagagggg

SEQ ID NO: 90352 - DNA, 715 bp, Zea mays
  misc_feature: Ceres CLONE 1578296
  misc_feature: Translation starting site: 177
ggagctcaccgcggtggcggccgctctagaactagtggatcccccgggctgcaggaattcgtctcacccctagaaaatttttgttgtctactcaatgaccttttatgccgtggacgctgtgagccttgtctcgtattttgacatcccatcaatgactgacagtgaattgatgctggatgtacattgacctccctttaggggccgttgggttgttccgcatgctcttcctcttcctgccaggcgcccgacgctcggttctcttacagcttatcgatattcaatttgagcatgctacaagataccacctctggtcggggcatctcacgatggctctctttaaattgcatggctcgctctatgtagactcgcacggcccatgcatagggcgcctccatcgaagaacgtaattcaatagaagcgatattggagtagcaaacctgcctggtcgtgatcagactaggcagccgacctacttatgtgggtgacatctcttcgacccgtgaggaagaggttcttcgagctcttcttctacacccagcagctcgacatcgtcttcatcgtgttcttggcgtttcatgtcgccgacttcatctgcagtacttgtgctgggagctgtgttcctcttcatgctacgacgcttcttttgagttctggcaatcaagggccatagtcgacatcttttcacccccttgccgcccttgtgggacggggggac

SEQ ID NO: 90353 - DNA, 728 bp, Zea mays
  misc_feature: Ceres CLONE 1578297
  misc_feature: Encodes the peptide sequence at SEQ ID NO. 90354
  misc_feature (372)..(372): n is a, c, t, g, unknown, or other
ggagctccccgcggtggcggccgctctagaactagtggatcccccgggctgcaggaattcgtctcacccctagaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctcccaccttggntctcgcctcaggggaggcatgcagatcttcgtcaagaccctcactggaaagactatcaccctcgaggtggagtcttctgacaccatcgacaacgtcaagggcaagatccaggaacaggaggggatccctcccggaccagaggcgggtcatttttggctggcagcaatttcaggacgggggccccctttccgaattcaacatttgaaaagagagcccccccccactgggttttgcgctcccagggggggggatgggaaattttttgggaaaaaacttggagggggaaaaaaatttcacccctgggggggcgaaggctcttcggaaaccccttgggaaaaagggagagggcgcaaatc

SEQ ID NO: 90354 - protein, 96 aa, Zea mays
  misc_feature: Ceres CLONE 1578297
  misc_feature (6)..(83): Pfam Name: ubiquitin Pfam Description: Ubiquitin family
  misc_feature: SWISSPROT Homolog: EC 3.1.2.15 Ubiquitin thiolesterase
  misc_feature (71)..(71): Xaa is any aa, unknown, or other
MQIFVKTLTGKTITLEVESSDTIDNVKAKIQDKEGIPPDQQRLIFAGKQLEDGRTLADYNIQKESTLPPWXSPQGRHADLRQDPHWKDYHPRGGVF

SEQ ID NO: 90355 - DNA, 837 bp, Zea mays
  misc_feature: Ceres CLONE 1578298
  misc_feature: Encodes the peptide sequence at SEQ ID NO. 90356
  misc_feature (717)..(717): n is a, c, t, g, unknown, or other
  misc_feature (837)..(837): n is a, c, t, g, unknown, or other
ctggagctccccgcggtggcggccgctctagaactagtggatcccccgggctgcaggaattcgtctcacccctagaaaaatcagtttgcgtggattgccatcgccccttcctccacctctgcgctccaccacctaataattgattccactgccaatacctgcgatgagtgccgccatgccgccggcgatggaccccgcggcggcgggggagatggcgcgggaggccgccgcgtggtgctcgctgcacggcctcgtcgtcggggtccgcgccgaccagagatcagcaacggtccctggtgttggtttggtccatgctccattctccttgctcccagcacattttccagagtccttttggaggcaggcgtgcgagctcgctcccgtttttaacgagcttgtggaccgtgttagcatggacgggaatttcttgcagaatgctttgtccaaaacaaggcaggttgatgatttcacatctaggctcttggaaattcacaggaaaatgatggaaataaataaggaagagaatattcgcttggggttgcaccgatcagattatatgctggattcagaaacaagttctcttcttcaaatagagctcaacaccatttcagcatcatttcctgggcttggtttccttagttagtgatcttcacaggtccttaataaacaatatgggacttctttaagtctagaacacaaagaggttctgcaaatgcngctagcactcaattttctgaagcattggcccagcatggtctgagttaatattgacagtgctgtaattatgatgattgtcagccagaagaaaaaatatgtgtcaaaactgtctcctcccgn

SEQ ID NO: 90356 - protein, 155 aa, Zea mays
  misc_feature: Ceres CLONE 1578298
  misc_feature (1)..(155): Pfam Name: GSH_synth_ATP Pfam Description: Eukaryotic glutathione synthase, ATP binding domain
  misc_feature: SWISSPROT Homolog: EC 6.3.2.3 Glutathione synthase
MPPAMDPAAAGEMAREAAAWCSLHGLVVGVRADQRSATVPGVGLVHAPFSLLPAHFPESFWRQACELAPVFNELVDRVSMDGNFLQNALSKTRQVDDFTSRLLEIHRKMMEINKEENIRLGLHRSDYMLDSETSSLLQIELNTISASFPGLGFLS

SEQ ID NO: 90357 - DNA, 830 bp, Zea mays
  misc_feature: Ceres CLONE 1578299
  misc_feature: Encodes the peptide sequence at SEQ ID NO. 90358
  misc_feature (830)..(830): n is a, c, t, g, unknown, or other
ctcaccgcggtggcggccgctctagaactagtggatcccccgggctgcaggaattcgtctcacccctagaaaaaagcacaccacacaacacaacacaataatacagcaaaggaggctagcagaagtgcaggattaataagctaagctagtagaaattaagcaaagcataggcacagccatggctacctcctctggttcttgccttattattagcctgttggtggtggtggtggcggcggcgctgtcggcctcaacggcgtcggcacagctgtcgtcgacgttctacgacacgtcgtgccccagcgcgatgtccaccatcagcagcggcgtgaactccgccgtggcgcaccaggctcgtgtgggggcgtcgctgctccggctccacttccacgactggctcgtccaaggctgcgacccgtccattctgctgaacaacacgtcccggggagcaaacccagcccgccgaaacttaactcttgaacccgagggcccttcgaacttcttcaaacagcatcaagggcccaggttggaagccggcttgccccggggcgttctttccccttgggcccaaaattcttgggccggtcggccgccccgcgaaaggaaattttgtcccccccccgggggggccctttccgggaacccgggcctttttgccccaaaaaagggactccaaccggggttccttttccctcaagccaaaaaaaaggggaacctccccccacctccccaaaagggttgagagccccccaaaagacacttggttttaaacccgccctctccccgccacaaaaaaaaaaaccccttagaagacgtgacacccaataaan

SEQ ID NO: 90358 - protein, 187 aa, Zea mays
  misc_feature: Ceres CLONE 1578299
  misc_feature: SWISSPROT Homolog: EC 1.11.1.7 Peroxidase
MATSSGSCLIISLLVVVVAAALSASTASAQLSSTFYDTSCPSAMSTISSGVNSAVAHQARVGASLLRLHFHDWLVQGCDPSILLNNTSRGANPARRNLTLEPEGPSNFFKQHQGPRLEAGLPRGVLSPWAQNSWAGRPPRERKFCPPPGGALSGNPGLFAPKKGLQPGFLFPQAKKKGNLPPPPQKG

SEQ ID NO: 90359 - DNA, 832 bp, Zea mays
  misc_feature: Ceres CLONE 1578301
  misc_feature: Encodes the peptide sequence at SEQ ID NO. 90360
ctggagctccccgcggtggcggccgctctagaactagtggatcccccgggctgcaggaattcgtctcacccctagaaaaaatcatcgcccacgtacacacccaattcctcgcaactgggctcccccgcctccacgacactgccccccgcctcaagtccgccgcctccattcttcagctctcctatcctccgtagtctgcctgtacctattggctgaagaagagctgacccccactttatcaagagttgctcaacaatggacactggctgcctgtcatctatgaatattactggagctagccaggcaagatcttttgcggggcaacttcctcctcagagatgttttgcgagtagtcactatacaagctttgccgtgaaaaaacttgtctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggatttggctggtctatcaacagcgaagtatctgggagatgctggacataaaacccatattgcttgaaggaagaaaaggtttgggggggaaaagggtacctgcttggaaagaatgaaaatgggaaaattggtaccaaaaacggggccttcaatatctttttttgtgagagctttatccccaaacatacagaaaatcttgttttgggccagactttaaggatatggaaggaacgctttttaacagggggaaaaaagaacaacctcc

SEQ ID NO: 90360 - protein, 120 aa, Zea mays
  misc_feature: Ceres CLONE 1578301
MDTGCLSSMNITGASQARSFAGQLPPQRCFASSHYTSFAVKKLVSRNKGRRSHRRHPALQVVCKDFPRPPLESTINYLEAGQLSSFFRNSERPSKPLQVVVAGAGFGWSINSEVSGRCWT

SEQ ID NO: 90361 - DNA, 751 bp, Zea mays
  misc_feature: Ceres CLONE 1578302
  misc_feature: Encodes the peptide sequence at SEQ ID NO. 90362
ctccccgcggtggcggccgctctagaactagtggatcccccgggctgcaggaattcgtctcacccctagaaaaatcccccgatccaatctgtcgtccagacatcagcgaaatgacgacctgcttgccgtctgccgctctgagaactccaatttggacgcgccgtttgaccgaatactgatctccgcattccaacgctcaaacaccacccgggcggctgcgcccccaactccccccgtccgcccaacgcccatcccccaaaaggctccgatctgattccgagccccgccaggcgccagccttctcccgccgcgtcgcacgtgcgccccaccccatactcacgctcgagccgcgatcccatccgggggttccgatgcggtcgccggcgctcctggccgccgccctagccgcggtggcactcctagctgccggtgccggagtcgcggtggccgcgacggaggaggcctacgtcacgctactgtacggcgacgagttcgtgctcggcgcgcgcgtccttgggaagtccctccgcgacaccggcacgcggcgcgacatggttgtgctcgtctccgacggcgtttccgagtactcccggaagctcctacaggcagacggttggatccgtgatcgtataacgttactgggctaatcctaatcaatttaaggcaaaagaggttttgggggcgttctaccccaagctgaaagatatttaaacatgaccaagctacaaaaaaagtttgttttaccttggac

SEQ ID NO: 90362 - protein, 91 aa, Zea mays
  misc_feature: Ceres CLONE 1578302
  misc_feature: SWISSPROT Homolog: EC 2.4.1.186 Glycogenin glucosyltransferase
MRSPALLAAALAAVALLAAGAGVAVAATEEAYVTLLYGDEFVLGARVLGKSLRDTGTRRDMVVLVSDGVSEYSRKLLQADGWIRDRITLLG

SEQ ID NO: 90363 - DNA, 824 bp, Zea mays
  misc_feature: Ceres CLONE 1578303
  misc_feature: Encodes the peptide sequence at SEQ ID NO. 90364
  misc_feature (607)..(607): n is a, c, t, g, unknown, or other
tcaccgcggtggcggccgctctagaactagtggatcccccgggctgcaggaattcgtctcacccctagaaaaaataatgcccagtgcggcagtgcctgccaccgtctaagcccaccccaagtctccgccgtcaacccgtcctccccatggccgccgccgccgccatctctctatccttccactttcgtttccgcccgccccttccatctccacgtacccccacgcgccacgctcccttttccttgttctccccttcccttcttgccccctgccgcctccgcgtcgctcccggccgcccctcaccgtccccgtggcgccccgacgtgcgggcgcgcgctggaagcaccatcggggcgccgcctgcgcttgtgcgcccaggcggagccgtggagacggaccgcctcccctccgacgtgcgggaccgggccatggaggcggtcgaccacttcggcggtcgcgtcaccataggagacgtcgcttctcgcgctgggctgcagctcgcgcaggcggagcgcgcgctccaagcactcgccgccgacactgaaggcttcctggaggtatcggaggacggggaggtgctatacgtcttcccaaaggactacagggncaagctggctggcaaatcgtttaggatgcgggtcgagcctctggttgacaaagcaagcaagtgggtgcttatctggtaccgtgttcatttggcactgcgctcattgcctcaattgtgctggtgtacactaccatcaatgccaatctctcaagctcaagtaatgaatgaaaatggtcttgggaggccggccgagaaccttaggggtctactatcatca

SEQ ID NO: 90364 - protein, 132 aa, Zea mays
  misc_feature: Ceres CLONE 1578303
  misc_feature (60)..(60): Xaa is any aa, unknown, or other
MEAVDHFGGRVTIGDVASRAGLQLAQAERALQALAADTEGFLEVSEDGEVLYVFPKDYRXKLAGKSFRMRVEPLVDKASKWVLIWYRVHLALRSLPQLCWCTLPSMPISQAQVMNENGLGRPAENLRGLLSS

SEQ ID NO: 90365 - DNA, 807 bp, Zea mays
  misc_feature: Ceres CLONE 1578304
  misc_feature: SWISSPROT Homolog: EC 3.4.23.40 Phytepsin
  misc_feature (700)..(700): n is a, c, t, g, unknown, or other
ctccccgcggtggcggccgctctagaactagtggatcccccgggctgcaggaattcgtctcacccctagaaaaagcgacttgaattgctggttcggtgtctgatgcgggctcatctgcttgttgcaatccgctttcccccgattgattcttacgatttccaagtagttttgtgttatcttctctctctcttttgggaaaaaagggggttcaatcctgttgggcatcgactcaccgggttttgaggtttttcgtgggcggctttgatcctcggtcgatccgatctttgtcaggctttcaccagacgttgcaaaatccgctcgcaaccagcgttattatcagccggaaacagtccttttcttggttgtactgcgctttccccactgatgcatctgttcgatctaaccggccttcgctccgccttgggctgccgcagatcagcgaacatgggaacccgcggcgtcgccctgctgctcctcgcggcggtgctgctcctccaggcgctcctccccgcgtcgtctgagggcctggtgcgggtcgcgctgaagaagctgcccgtcgaccagaacggccgcgtcgccgcgcgccttctccgccgaggagaggcagcgcctcctcctccgcggctccaacgctctgggctcatgcggcgacgacgactccgacgtcatcgcgctcaagaactacatggacgcgcagtcnttttggggagatcggcgtcggctcgccgcagcagaagttcaccgtcatcttcgacaccggcagttccaacctcctgggtgccgtcctccaagtgctacttctcgatc

SEQ ID NO: 90366 - DNA, 797 bp, Zea mays
  misc_feature: Ceres CLONE 1578305
  misc_feature: Encodes the peptide sequence at SEQ ID NO. 90367
ctccccgcggtggcggccgctctagaactagtggatcccccgggctgcaggaattcgtctcacccctagaaaaaaggtggaaaaccctttcaccgtcctcctgcgtcgccactcgccagagcggagcagcgagcggcgcgcgcgatggcaggcggcggtctccagggagccaagaagcgcaagcgcgagcacgcggaagggaagacaaagcctcggaagcaagtcaagggaggcggggacggagcgaagcggaagagccactcggccgccggcggctacactgcccatggcggcgccggcgaagttgtggcgaggaagaagaccccggttacccccaaggagaagcgcctcgcggccaaggaaatgtcggaggccaggaagatgaagaggaggcagcattacagccttgagaaggaactaacgaaattgtgggaaaagatgagatgtcacgatgtgagcaaagaggagaggtccaaggcagtaagtcaggctatccataaaatggatgggaaatatttggacattgccacatcacatgttactgcacgtgttcttcaaacatgtgtaaagtggtgctcggagtcagagagggatgctatctttgatgttctacaaccacatttgcttactctttcttgcaagaatatgccgtttttctttgtaaagagcttatagaactcgcctcttaaaaacagtttgccagtttcatatcttccctttcctgggcggggtggcaaaccttcctcatcatactattgggagctgcagtccgttgattatcattttcagccaaggaa

SEQ ID NO: 90367 - protein, 176 aa, Zea mays
  misc_feature: Ceres CLONE 1578305
MAGGGLQGAKKRKREHAEGKTKPRKQVKGGGDGAKRKSHSAAGGYTAHGGAGEVVARKKTPVTPKEKRLAAKEMSEARKMKRRQHYSLEKELTKLWEKMRCHDVSKEERSKAVSQAIHKMDGKYLDIATSHVTARVLQTCVKWCSESERDAIFDVLQPHLLTLSCKNMPFFFVKSL

SEQ ID NO: 90368 - DNA, 783 bp, Zea mays
  misc_feature: Ceres CLONE 1578308
  misc_feature: Encodes the peptide sequence at SEQ ID NO. 90369
ctggagctccccgcggtggcggccgctctagaactagtggatcccccgggctgcaggaattcgtctcacccctagaaaaaaatcctacaccccggttataaaaacccggcgcccgccgtgtcacctcacatttcggaagctagctagctctgccctctgctcggggctcctccttcccagtaacaactaacaagtctacacacaggggacaccacaagtacatcgccaccgacggaggaggaacaacgagaaccccgatgaaaattgcagccgcggtgaccgcgcccacgtccgcgccagtgcacgtcgcgccgcgccacaccaacaccgcggtccacccgcgcgccaacgccctcacggagccgtcaccgctcaaccccaacacaccagcacaagcgctcctctccgccagcccaagcagctagggagactgccgcgaaaaaatgacaggtcccgaggtgacctcacaagacaggtccaagggctcaagtaaggctcctcatgagacgaatgggaaaaatctggacatcgccacatcgcatgttaactgcacagtgttcttgaaagatatgcaagagcgcgcgctccgatcccggagagggatggccatctcttgatagtctacaaccacatcttgcctcactccctggtatgcaagaaatatgaccggcctccctagtaaaaaaagttaaacgaaactcccctcttaaaaaaaaaggtatgccagttttcaaaaccatcccctctcaggggccttggtctggcaaagccatccttccatag

SEQ ID NO: 90369 - protein, 57 aa, Zea mays
  misc_feature: Ceres CLONE 1578308
MTGPEVTSQDRSKGSSKAPHETNGKNLDIATSHVNCTVFLKDMQERALRSRRGMAIS

SEQ ID NO: 90370 - DNA, 867 bp, Zea mays
  misc_feature: Ceres CLONE 1578314
  misc_feature (55)..(55): n is a, c, t, g, unknown, or other
  misc_feature (625)..(625): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (655)..(655): n is a, c, t, g, unknown, or other
  misc_feature (706)..(706): n is a, c, t, g, unknown, or other
  misc_feature (788)..(788): n is a, c, t, g, unknown, or other
  misc_feature (793)..(793): n is a, c, t, g, unknown, or other
  misc_feature (858)..(858): n is a, c, t, g, unknown, or other
aaagctggagctcaccgcggtggcggccgctctcagactagtggatcccccgggnctgcaggaattcgtctcacccctagaaaaagccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcgggatctggtttggggttttcagttaaggagcagaaagcccccttatgggaattgcacaaagatggggcttggcaccccaaaaagctacctttggtaaaggcacttggccagggaaagcaccgccatacttcctacattcccctggccaccctcctggaaagacttcccaaagcccacgagaagttacgccgataatttccccgcccccaggagttttgccaccaccaaagtgggggccccgcgacaaccgaggccgggtcgtccaaacagctgtgcgctcgcctcaaaagaaacacccccctgggcctctnggggtgggggactttnnnnnagccgcgtgnacccgtggtgtaggtcaccgatcgcgcaggccccccccgcgggggctgcgnccggtcggcatggagaacccactccccgccatactcgccacccggcagacactaacgcgcgaggtaccccacacacaaccgncaccntctcatccacctcgtacccccctcccccccgctcacagtccgtatcagcgagatcctctctcctntcaaccccg

SEQ ID NO: 90371 - DNA, 902 bp, Zea mays
  misc_feature: Ceres CLONE 1578315
  misc_feature (141)..(141): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (488)..(488): n is a, c, t, g, unknown, or other
  misc_feature (561)..(561): n is a, c, t, g, unknown, or other
  misc_feature (609)..(609): n is a, c, t, g, unknown, or other
  misc_feature (804)..(804): n is a, c, t, g, unknown, or other
  misc_feature (824)..(824): n is a, c, t, g, unknown, or other
  misc_feature (834)..(834): n is a, c, t, g, unknown, or other
  misc_feature (853)..(853): n is a, c, t, g, unknown, or other
  misc_feature (854)..(854): n is a, c, t, g, unknown, or other
  misc_feature (857)..(857): n is a, c, t, g, unknown, or other
  misc_feature (860)..(860): n is a, c, t, g, unknown, or other
  misc_feature (862)..(862): n is a, c, t, g, unknown, or other
  misc_feature (864)..(864): n is a, c, t, g, unknown, or other
  misc_feature (865)..(865): n is a, c, t, g, unknown, or other
  misc_feature (867)..(867): n is a, c, t, g, unknown, or other
  misc_feature (869)..(869): n is a, c, t, g, unknown, or other
  misc_feature (870)..(870): n is a, c, t, g, unknown, or other
  misc_feature (873)..(873): n is a, c, t, g, unknown, or other
  misc_feature (875)..(875): n is a, c, t, g, unknown, or other
  misc_feature (876)..(876): n is a, c, t, g, unknown, or other
  misc_feature (882)..(882): n is a, c, t, g, unknown, or other
ggactgcccgcggtggcggccgctctagaactagtggatcccccgggctgcaggaattcgtctcacccctagaaaaagtgcgcgcatcatttgtgaaaagcagccgcaaaaatacactcatgttcaggaatggacgtctantgacaccatctgcccactccatgtccaggccggcgtgaagagggacacgaaggtgaggctgggagcgtggtcctgggacgcgtccaccggcgaggagctgcgcgtcggcgccggactcgccgaaccttacgactcggtatggtgcgcccgtggagtactaccagtccacaggcctccttcctacgcatggctcctcccttagcgggggttcacgtttaaatgggcggatttaaccccccccccgggaaggtgcgtcccaccaaggccttttcttttgtgccggaaaaaaaaaattggggtggggcccaccccccacaaaaacaattattttttttttgtggannntnccttggtggtggggggaaaaaccgggagaaaaacccccccccgcggggggaaaaaaacaccccatattatatntcagggggggtgccccccgcccgtgtgtttttttttagataggaggcnggcgcgacacctctttttttttctccccccccgcggagagaaaacacccccccccaaaaaaaaatatctccattgaaaagaaaaaaaagggggggcttctttcccccctccctctaaaacaaggggaagaggggcgggaggaaaaaaattgtttctctcaacacttacttttcttcttttctactttatgtgtanattctattttttattaactncgggcggcgnggccggggcctcatcaganncanccncncnnancnngtnannagaggntaggctctgcgtcctctcca

SEQ ID NO: 90372 - DNA, 838 bp, Zea mays
  misc_feature: Ceres CLONE 1578319
  misc_feature: Encodes the peptide sequence at SEQ ID NO. 90373
  misc_feature (619)..(619): n is a, c, t, g, unknown, or other
ctccccgcggtggcggccgctctagaactagtggatcccccgggctgcaggaattcgtctcacccctagaaaaaataccgcaccaccaccaagcaccgcaaccggagccggagccagaggagggcgagaggccgaggggagaggagcgaaggaggccgccgaccgaccgtgcgtccggccccgcggcggcgtcggcaggtcgtagacgacagacgagcagtagcagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagcttccgcgcctgcgtgccgctcgccacgcacgccgacatcgagccctacattgcgcgcatcgccgacggcgacacgtcccccgtgctcaccgccaagcccatcacctccatctccctcagctccggcacgacgcaggggaagcgcaagtacctgccctttaacccaggagctcngtcagtccacgatgcagatataccgggacttcctacgccttcagggacagggcgtttccccgtgggagacgggcaaggcgctgcaatttcatctacggcagccggcagttcaccaaccaagggcggggctgacggggacgacggcccaccaccaacgtgtaccgccagccgagaagttcatgcccacgaatgcgcggcattccattcccaggtggtgcc

SEQ ID NO: 90373 - protein, 191 aa, Zea mays
  misc_feature: Ceres CLONE 1578319
  misc_feature (119)..(119): Xaa is any aa, unknown, or other
MPEKEAQAAAFCGEAVIAEFESLTRDAAAVQRDTLRRILADNACAEYLRCRGLAGRTDAASFRACVPLATHADIEPYIARIADGDTSPVLTAKPITSISLSSGTTQGKRKYLPFNPGAXSVHDADIPGLPTPSGTGRFPVGDGQGAAISSTAAGSSPTKGGADGDDGPPPTCTASREVHAHECAAFHSQVV

SEQ ID NO: 90374 - DNA, 864 bp, Zea mays
  misc_feature: Ceres CLONE 1578321
  misc_feature: Translation starting site: 103
ctcctcggtggcggccgctctagaactagtggatcccccgggctgcaggaattcgtctcacccctagaaaaaaatgtgggtgtcgattcccggagcttcgctatgcagcgccttctcacgctggtggcaaccctgctggtgctgctggtgtcgagcgcatggctggcctccatccccttcgccttcgtcgactgggacggctcctacgacaatactgcggcgctcggcgtccagcaacatgtgataagcatcaacggcaagttcccagagggcgtcgtgaacgtcagcaccaaatgaaacgtcctcgtcgacgccctgcaacgaactcgacgatcacctgcctgtcagctgtaacgggatcgctcacctgataaactgctggcaggaccgggtgctatgcagcatctgccggatcccacccgggtggaacaagacggaccagtgcaaggagaaggaccagataggtacctgcttctacttggcatccaccgacccgctgcactcctcgggggaattgcagggggatcctcatacagaagcgggtacgttatcctcatgcccgtttctacccgccaccaactgctaacaaccccgttctttaaataggtaaaggggttaccacaaagaacaaaccggattccgtacgaagaaccgtggaaaaaggacaaagggacctcggtattaccggacggcagagaaggtataaaccggaagggggaacggtaacccgtctttaacaaaatggcactgttgcggaggatgttttcagaaaaagaaaaccctttaatggcaccatggccgggcaaggaaaggtacccccaatggggggaggcacaaacggtggagaggacccccttcggaaca

SEQ ID NO: 90375 - DNA, 826 bp, Zea mays
  misc_feature: Ceres CLONE 1578322
  misc_feature: Encodes the peptide sequence at SEQ ID NO. 90376
ctccccgcggtggcggccgctctagaactagtggatcccccgggctgcaggaattcgtctcacccctagaaaaacccctcttcttttcccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaaattgctatctatagagaggagccctcccattgaagaagttatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctgttcctatatttgtgaagcttcttgggtctggtagtgatgatgttcgtgagcaggctgtgtgggctttgggcaaatgtgctggcgattctccgaagtgtcgtgaccttgttctcgccatggtgcaatgatgcctctgctaggccagttgaatgagcatgcgaagct

SEQ ID NO: 90376 - protein, 198 aa, Zea mays
  misc_feature: Ceres CLONE 1578322
  misc_feature (4)..(92): Pfam Name: IBB Pfam Description: Importin beta binding domain
  misc_feature (101)..(142): Pfam Name: Arm Pfam Description: Armadillo/beta-catenin-like repeat
  misc_feature (144)..(184): Pfam Name: Arm Pfam Description: Armadillo/beta-catenin-like repeat
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKSGVVPRFVQLLTREDLPQLQFEAAWALTNIASGTSENTKVVIDHGAVPIFVKLLGSGSDDVREQAVWALGKCAGDSPKCRDLVLAMVQ

SEQ ID NO: 90377 - DNA, 795 bp, Zea mays
  misc_feature: Ceres CLONE 1578323
  misc_feature: Encodes the peptide sequence at SEQ ID NO. 90378
  misc_feature (630)..(630): n is a, c, t, g, unknown, or other
ctccccgcggtggcggccgctctagaactagtggatcccccgggctgcaggaattcgtctcacccctagaaaaaggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgaggaggtcgtcgtgaccaccaagcataacgatgacgagcagtacgtgtggggaatccaagcggggcnggtcggttcactgttactcgtgacacgtctgggggagcagcttgggcaggggtacctagattacccttttcccccaagaaagatcagttaaaataccctggaggaacgtcgcctccaaggatttggtccagaaacaactcctgagtcattcagctacccccttct

SEQ ID NO: 90378 - protein, 185 aa, Zea mays
  misc_feature: Ceres CLONE 1578323
  misc_feature (28)..(169): Pfam Name: HATPase_c Pfam Description: Histidine kinase-, DNA gyrase B-, and HSP90-like ATPase
  misc_feature (156)..(156): Xaa is any aa, unknown, or other
MATETETFAFQAEINQLLSLIINTFYSNKEIFLRELISNSSDALDKIRFESLTDKSKLDAQPELFIHIVPDKASNTLSIIDSGIGMTKSDLVNNLGTIARSGTKEFMEALAAGADVSMIGQFGVGFYSAYLVAEEVVVTTKHNDDEQYVWGIQAGXVGSLLLVTRLGEQLGQGYLDYPFPPRKIS

SEQ ID NO: 90379 - DNA, 1004 bp, Zea mays
  misc_feature: Ceres CLONE 1578326
  misc_feature: Encodes the peptide sequence at SEQ ID NO. 90380
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
nggttggagggnnacaaacaagcggagggcagccgcgcccctcaantnngngtggggggannnnaaaataaaaaaagaaacaaaacccacgcaccgccgtggcggccgctccacaacagaggatcccccgggctgctccgattcgtctcacccctagaaaaaggaaaaccctccaaccctagccgggatccgacaacgcctccatccctagccgcctcctgcaagtttcagagctcaagagtcggggcgccatggcgacagagacggagactttcgcctttcaggctgagatcaaccagctgctctcactcatcatcaataccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccagggtccggggaccaagggagttcatgggaagccccttgcttgctgggcgcctgaatgtggcctaatggaatggggccaagttccgggtgtcccgggtttccaaactcctgcccctaaccctcgttccgcccggaagaaggggttccggtccggtgggaacccaccccaaaggccaattaaccgggatgggaaccgaaggccaatgtaacggggggaggagggaaaatcccccagggggcgggggccgggggttcccgtcttccacctggtctaaccctccgagggaaacaaccgttcctggggggggaagaccaagacctttgtggccaggggggggtaccctcaaagaaatataaccagcctttgttctccctccaaagggagaagaaaatcacaggtttaagaaaaaatacccttttgagaggggaaggcgagtcgaccccctccaagagggc

SEQ ID NO: 90380 - protein, 120 aa, Zea mays
  misc_feature: Ceres CLONE 1578326
MATETETFAFQAEINQLLSLIINTFYSNKEIFLRELISNSSDALDKIRFESLTDKSKLDAQPELFIHIVPDKASNTLSIIDSGIGMTKSDLVNNLGTIARVRGPREFMGSPLLAGRLNVA

SEQ ID NO: 90381 - DNA, 828 bp, Zea mays
  misc_feature: Ceres CLONE 1578327
  misc_feature: Encodes the peptide sequence at SEQ ID NO. 90382
ctccccgcggtggcggccgctctagaactagtggatcccccgggctgcaggaattcgtctcacccctagaaaaaaaaaattctcctagcccgtgagtctgctatcccctctgagctgacggcgatcctctttctcctcatccgcatgagctgcttcttgtcggtggtcaggaaggaaagcacctttctgctctgggtgctgttcctggtctcggagactgaccccaggatcgtcggcagcttccttgcgcactcagctcatcaccaggatgaccaccgtcaggaatgactggtggcacggcgcatgtcgcccccaacctccccaagtaccaaactttacgatccggcgtctgcttcgttggggaacttgtgggagccatcgccacttccgcagcttgcttttgctcccattgccgatgacagctctccgtctccctgcttacagccggatgccagtgcgccgctgccccaaactgatgaagactttgtggggcgatcagcccttcctcgcgtccaaagtgggggtggcttatacgccttctggtcagcagcacccctcagggaatccaaacccggagggggccactaggttgggaacggccgggggaaatccgccatggtgggaaagaatttcctcatgattggtgacccttgcccgtccctggaggaaggttttgaacctttgaccccggctgggcctgggggctccatttttaaccggagagtttcgtttgcataaccccccccaagggaaaggaaaaaattttcttcaagggttttggcccctccaaaaaaaaaaaaccccccccggtgttgtgtaaaagggaaa

SEQ ID NO: 90382 - protein, 47 aa, Zea mays
  misc_feature: Ceres CLONE 1578327
MSCFLSVVRKESTFLLWVLFLVSETDPRIVGSFLAHSAHHQDDHRQE

SEQ ID NO: 90383 - DNA, 1117 bp, Zea mays
  misc_feature: Ceres CLONE 1578330
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
ggggggtggtgttnnngtggtgcggctggcgtcgggggtcgcccgcgtagcacacccaaaaaggggtggggagtttttttgcgnnnnnnnaaaagctggaactcaccgcggtggcggccgctctagaactagtggatcccccgggctgcaggaattcgtctcacccctagaaaaaacctcaattccacacccagcggcaaggccgcggggcgcccgcgcccaaacgccaaaagcctagctccccacccacccaccccaagcaccgcgaggccgccgggcgctcgcacacggtcgccacggatgcgcgcggcccgctcgcggacctcgacgacaccccggtcgcttgccgcggctgttccgccatggacgagcccgagaaagtgaggggcaggtaggatgcgacgtcgggccgcgaggctggcggcgcctaagaggccggggatgggttccagctcttgaaccatggcaagaacaagaacagggcggccagcggccaccaccccccggactgctggcctcggcttctggccgctggcgcccgggccagtgcgggacgttcaccaccggagaaagggaagccgcccccggggcgcccgggggggcccaagggccaagggtggcacttttctttggaaaaccaaggcatttcccccgggcccgctagggaacgtagttctccaaaagtccgggaggtggggatataacttaccaaaggcccatttcccgaaagcaattggtcttggggcctggggaggccgaccaagagcggaaaaaaaaggggcaatcccccggaaacggtgggtttaccacccaccggcctggggaaaagaaaccccttgcgcccctgtgtttggaaaccaaagagtttcccgggtggacccatgaagaaaagtgggtcccccctcgaacccggaagaaaacctccccgtggggagaaccccccccccttggaatttctaaagaggggaattatcccccccaattttatcccgccctggggtttcgggggaattccaccacgagaggcgcctataaaacaagaaaatttgaggcgtgaaaggaaaaagttgtaaaaaaagcgcggcacaccctggaaatcctccccttgttaaagaag

SEQ ID NO: 90384 - DNA, 737 bp, Zea mays
  misc_feature: Ceres CLONE 1578332
  misc_feature: Encodes the peptide sequence at SEQ ID NO. 90385
ctggagctccccgcggtggcggccgctctagaactagtggatcccccgggctgcaggaattcgtctcacccctagaaaaaagctctccccctttttttcctgcccacatacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggcggctgcccccgcgcctcatgcgggggttcgcgtccaagatcgagcccaagaagctgggcgtcagcctcatcgccggctgctgcctcgcgctcctcacctacgtctccctcgccaagctcttcgcaatctactcccctgtcttcgctagctcggccaacacgtccgcgctgatgcagcagaacgcgccgccgacctcgtccaagccgtccgtgccggagacggagaccatcccgccgcacgagacgataggcggcgggcggcgacaactcggatcccgtcgatctgcgtgagggcgcgacgggctcccaagagccccggctgcccggaaactgccctcccgaaggaagaacctggcgggcggggtcccaaaaaaacccagggtttcccccccccggaaaagaccaaccggccaaagaattcccggcggggcccgaaaccccaccccccaaagcgccttttggcgcggaaaaaga

SEQ ID NO: 90385 - protein, 113 aa, Zea mays
  misc_feature: Ceres CLONE 1578332
MTSTAYSRSSKLPGGERRLPPRLMRGFASKIEPKKLGVSLIAGCCLALLTYVSLAKLFAIYSPVFASSANTSALMQQNAPPTSSKPSVPETETIPPHETIGGGRRQLGSRRSA

SEQ ID NO: 90386 - DNA, 815 bp, Zea mays
  misc_feature: Ceres CLONE 1578333
  misc_feature: Encodes the peptide sequence at SEQ ID NO. 90387
gagctccccgcggtggcggccgctctagaactagtggatcccccgggctgcaggaattcgtctcacccctagaaaaaatcgtcctcgatcggcacgacaatatgatggggttcaacctgctggcgtttctggcggcgaggagcctcatgcacgcgttcaacctgtctgttgggctcaactgctggatgccgctcgctccccacctgccggaggccctcgccgtcctgtacggcgtgctccccccgcacgccgggtggctcacacggcgccctggctcgctgcgccacctggagccacagcgggagccggggccgcgtaaaccagaacgtccgactctccatgctaagcgtctactactgagaccaccgcacgaaggtcgattgacagcaggcgccacgcaagggcgctcctagctgctgtacctgctcccgtcttgctcgtggtggcaaatgtagaccatcatgagaccggcgccacactctgcaacttagcgtcgactagcaacgaagatctttgaaatacatgccacacggacacgggagtcctgcattcttgttacttgcataagatactagaactacgatacagcatgggaggaaaactcgcagaagctctcattcccaaccgccggcagttgcatagtagaacacgtctattaattacgctgggacagcttctgcttacaaccggccgaaacaggccggtttactctcgggggaaatgaaggctagaaaaactgccaagttccaacttaccaagatcccgggaaaatcgccttagaggggaccttgtctttgagtaaccaccggagcctg

SEQ ID NO: 90387 - protein, 102 aa, Zea mays
  misc_feature: Ceres CLONE 1578333
MGFNLLAFLAARSLMHAFNLSVGLNCWMPLAPHLPEALAVLYGVLPPHAGWLTRRPGSLRHLEPQREPGPRKPERPTLHAKRLLLRPPHEGRLTAGATQGRS

SEQ ID NO: 90388 - DNA, 884 bp, Zea mays
  misc_feature: Ceres CLONE 1578336
  misc_feature: Encodes the peptide sequence at SEQ ID NO. 90389
  misc_feature (884)..(884): n is a, c, t, g, unknown, or other
ggagctccccgcggtggcggccgctctagaactagtggatcccccgggctgcaggaattcgtctcacccctagaaaaagtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtgccccccgaggtgggcagggggtcgtcgtcggcgaccacaatgctcagcaggggggggagcttccttcgccggccggcggttgccgcgggtggtccctcccaacgaggcgcccgcccgtcgtaccgaaaaactgtggggggttcctggcggcgccccgaggaacaaaccgcctgggcggggaacccccccggggaccttgatggcaccctcctggccggctccttccaggaaaaaaggaagggggggcccccctccctgggaaccccccagtgaagggaaccccccccccttgtgccgaaccacttgggggggacccccaagccctgggggggggagaaagaaccccccn

SEQ ID NO: 90389 - protein, 161 aa, Zea mays
  misc_feature: Ceres CLONE 1578336
MSALLDLLMGIFRQQTLGGAALELAALAAPLWLAALVGLLIGWACPPRWAGGRRRRPQCSAGGGASFAGRRLPRVVPPNEAPARRTEKLWGVPGGAPRNKPPGRGTPPGTLMAPSWPAPSRKKGRGGPPPWEPPSEGNPPPLCRTTWGGPPSPGGGRKNPP

SEQ ID NO: 90390 - DNA, 757 bp, Zea mays
  misc_feature: Ceres CLONE 1578339
  misc_feature: Encodes the peptide sequence at SEQ ID NO. 90391
ctggagctcaccgcggtggcggccgctctagaactagtggatcccccgggctgcaggaattcgtctcacccctagaaaaaactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatgggggggcagatcgaggtcgtcaagtgctccctcctcggcttcgtcctctccaacaggctgctcgtggtcggaacgtccctccttctgcgggcggcgtcgtcaccctcgggttccgaccagccgtaccaacggacgcaaggcgggacgtc

SEQ ID NO: 90391 - protein, 195 aa, Zea mays
  misc_feature: Ceres CLONE 1578339
MRKYASEAGGLRAARQGPHGRSLTARTAHSMSTTALRTKSKSAASLLRRVPFAPLRPVLANLQEVFLGTKLAVLFPAVPLAIAAQCAHFGQVWVFTLSLLGLIPLAERVSFLTEQIAIYTGPTVGGLLNATCGNATELIIALFALMGGQIEVVKCSLLGFVLSNRLLVVGTSLLLRAASSPSGSDQPYQRTQGGT

SEQ ID NO: 90392 - DNA, 880 bp, Zea mays
  misc_feature: Ceres CLONE 1578340
ctccccgcggtggcggccgctctagaactagtggatcccccgggctgcaggaattcgtctcacccctagaaaaaggaactcccgaaagggctgccgtccgatgggtacacgaaagtgacgaagttgctttgactactgaaccatgcctggatcgtcggagcgaattggatgatcgggccgagggctgccccctcttcccctcgctctcctttccttaatattcaccgtcgagtcatcaaagccgtcaactaattcggaggggctcggctggcccggtcgccctacgctactggcgcttccaaaggcgaagctctcgtctttggcgaccagcaaagcaaacggagggagggctaaaacctttcgttttgaagcaagggatgagcgcgaaagccgttgcgcttccgtacacgcgcatactcttgctccgtcgcgcgttaggttaggttagtacttagtacttaacttagtacaataacgcgcagccgttttgggcgggacacggttctctaaaggcgaagactctgaagtgggcggaacactcggcccagcggggcgaacatgccggctcccggctccgcgcaacctgctgaaacctttcgaagcacctttcacgtggtgaaccgaagtcgtcctggtccttacctttcctcatttcaggtccctcggccttttttcacctttccgtaggggggccctttagtccttttgatttaaagtaaaagggtcgccaagagaaacaagaaccgttaccccccccttgccattattccgccgaagggatcctttaaataagtccggttcggccgaaacggtttggtccactaagggccaaacccacggggtttttaataactcttccccgggaatatagaaacccttt

SEQ ID NO: 90393 - DNA, 833 bp, Zea mays
  misc_feature: Ceres CLONE 1578341
  misc_feature: Encodes the peptide sequence at SEQ ID NO. 90394
  misc_feature (468)..(468): n is a, c, t, g, unknown, or other
  misc_feature (710)..(710): n is a, c, t, g, unknown, or other
tccccgcggtggcggccgctctagaactagtggatcccccgggctgcaggaattcgtctcacccctagaaaaagatgtgcgtggcaacgtccaaaatccagaccgctggtaggagtatctcgtagacattgaacaacggctgcatggcgagcgcctgcgccacctccatccccctcgtctcggcgccctctgcatgcccgtccaagaagaccaccgtcgccaggttccggcgccgcacggcgacgtgcagggccagcagcggcggtggcggtggccggggcggcgaaaatgatggcctcctttggctgccccggcgggacgtgatgctcaacggcctgtccagtgtcgccgccgggctcgcctggtacccgggcgtcgcgtccggcgcgaatgcggtgtgcaccaggcccgacaggtgaacgagaagaccgtgcagtgcacggacccgggcgggcagcttccgtgccntctggggtccgcgacgggaccccgtggacttcaagccggaaagcaggtggacgcgcattccggcagcgggtggatcttctgagccgggggtacccggagaaatccaaggaggccctccccaaaaatgaagggctccccgaaaaaaaacccggtgaagttttggggcccaggggggccatcccccagggctattggggaagccctattaaaatttttaccccacagggccaagagaccccccnttcaaaggggcctttttggggggaaatttcccccccgggggccccccatgtttatttttatttttttaaaagggggcccctgggggggtttttttgggggaaaaaaacctttttggggtgggg

SEQ ID NO: 90394 - protein, 91 aa, Zea mays
  misc_feature: Ceres CLONE 1578341
MASACATSIPLVSAPSACPSKKTTVARFRRRTATCRASSGGGGGRGGENDGLLWLPRRDVMLNGLSSVAAGLAWYPGVASGANAVCTRPDR

SEQ ID NO: 90395 - DNA, 1074 bp, Zea mays
  misc_feature: Ceres CLONE 1578345
  misc_feature: Translation starting site: 303
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
nnnnngggaanttnnnnntgcggtggtgggaggtgagggtggggggggagattataattgatgatggnnnnngggtttttgttttatagctggagctcacctcggtggcggccgctctagaactagtggatcccccgggctgcaggaattcgtctcacccctagaaaaaacgcttcgctctagtcagaaggtttcttaggaactcccgggctcgtaggacatcgggacgatgatgggagggcgcgctctgctgctgcttcctggtctcggcgctgctcgttcagatccgcgcctctgacccgatgctgtacaagccgtttgatgatgacttcgagggtagatggatcgtctccaagaatgatgataccgaggtgtatggaagcatgccacgagtgatcggcatgaggactatggcctccttgtttgtgacaagcgaggaaataccccattatcaaggagcttgatgagccacctacctgaaatggatggggccccccgtcccggcaatttggaagttgagacctcaaaaatgggccttgaaaagggggaaggtggcctacatttaagggttcttccaccccctcaaggaatgccctgggatgggggactccccaaacgaagttttggaatttgatggaagaaacttacattttacaacctaatttgttgtgttttggggggccacaaaaaacaaaaagctgtgggggggggatgcaaaaacccaatgcccggggggggtgttcaaggttttttcgcgagcccctcttaaagaggggacgccccactggagaactccccctaaaaagaaactcgtgtagaaaatagctagtgggtgtgaaaacaccctctttcgaccgcgcgaaaaatgtttcccgcccccccccttttctgggggtgcccgtctaaagggaaaaaaatgggctcctgtcctcccctggttgtttgaacgctacacggggaaacgctttttgaggaagcgcgcaggaaaaaccatggagggggcccaaagaatatctttgttctcgcgagtaggtggagaaagaacaaaagaatgaaagagggggggaaccttct

SEQ ID NO: 90396 - DNA, 780 bp, Zea mays
  misc_feature: Ceres CLONE 1578348
  misc_feature: Encodes the peptide sequence at SEQ ID NO. 90397
ctccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagcagggcgccgcggcgagccagccgctgagcgtggcgatcccgccggagccgtccatcacgccggtgatccaagactttacggatcccaacctgttttatctaccagcgtattactacggaggctacgacagttccatgagcgagtgggatgattatccgagatatctaaattcagatggagtggagattgccccagcggtatacggagatatttatgggatatgggtatgctcc

SEQ ID NO: 90397 - protein, 135 aa, Zea mays
  misc_feature: Ceres CLONE 1578348
MAAVAPPPAPAPAPVPAPAPATGPVADQTTDLLQKLSLDSQPKPADATQPAAATAKKQGAAASQPLSVAIPPEPSITPVIQDFTDPNLFYLPAYYYGGYDSSMSEWDDYPRYLNSDGVEIAPAVYGDIYGIWVCS

SEQ ID NO: 90398 - DNA, 1214 bp, Zea mays
  misc_feature: Ceres CLONE 1578350
  misc_feature: Encodes the peptide sequence at SEQ ID NO. 90399
  misc_feature (973)..(973): n is a, c, t, g, unknown, or other
  misc_feature (1214)..(1214): n is a, c, t, g, unknown, or other
tttgttgtgttgtgcgtctttggagggggaaggaaaccgctgagagccacccgagaattgatgacatacccaaaaaagtggggctccccgcggtggcggccgctctagaactagtggatccccccggctgcatgaattcgtctcacccctagaaaaactctttccagccacctcactcttcactagccatctgctccactgaaatggcggcggcacacttcctcttccacctacctcaccatcggacgcaaaaccctaagccccgccccctccgtagccacagccgccacctccgtctccttccccggcacgcagcacccatgcctcgtcgccgcctccgcggaccaccacctcgccgttggctgcgaaggtctgctcgccgggaggtcatggggaccgccatggccggcgctcgacttctagacctgccgtgtacagagactgaaaaagtgtcccctgggccggcaataaggactcatgattgtacagggggtggaaaaggattcacagacgggggtgggcgaggaggagcgcgtggaagcgcaattgaaccacaggcggtggtgtagtgagacacgtggagactacgaacgcgcgcggaagcagcgacgctccggaaacgtgcgcgatagaacggcgtccgcggagcggggaggccatgtaggcggaacatacctcatggcgcgttctggaaggaggcgagaagagggacccacggagaacgcggggtacgcagtagaggaaggacggttgagaaatgagggatgggcggcagaccgacgactgaggacgcgaataagaggcaatggcggtgtagagagcaatgaatgtttcacatggcggagcgggagtcgatgtgctgtgagtgcaaaacaattagtattccataacgagactcgttgcgaagcaaagagaggcaggatggggggagtgcgcggtgatgacggctgtatgagaggcatcacgccaccanaccagcggagacatgttatcgtgacgtcgaataagtggtcagcgcagtagggtgtcctaatctgaggagacagcagatctctaccgatacatccctaatcgagtactccacgatgcatagagcacatagtgtacctgaaggtaggtcgtggttctatcagcatgtggggaggggctggtgctggatcgatgtgatgcgagctgtatgtaagccgaggagagatggattagataacatgcgn

SEQ ID NO: 90399 - protein, 55 aa, Zea mays
  misc_feature: Ceres CLONE 1578350
MAGARLLDLPCTETEKVSPGPAIRTHDCTGGGKGFTDGGGRGGARGSAIEPQAVV

SEQ ID NO: 90400 - DNA, 788 bp, Zea mays
  misc_feature: Ceres CLONE 1578355
  misc_feature: Encodes the peptide sequence at SEQ ID NO. 90401
  misc_feature (696)..(696): n is a, c, t, g, unknown, or other
ctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctaccctgggacgtatcattaatgttatcggtgagccgattgatgagaagggtgatantacgacaaaccacttccctcctatccatcgtgaaagcccctggcttcgttgagcagggcactgagcagcaaaattcttggtactgggatcaa

SEQ ID NO: 90401 - protein, 196 aa, Zea mays
  misc_feature: Ceres CLONE 1578355
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (180)..(180): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDXTTNHFPPIHRESPWLR

SEQ ID NO: 90402 - DNA, 1201 bp, Zea mays
  misc_feature: Ceres CLONE 1578356
  misc_feature: Encodes the peptide sequence at SEQ ID NO. 90403
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (39)..(39): n is a, c, t, g, unknown, or other
  misc_feature (101)..(101): n is a, c, t, g, unknown, or other
gggtgggggttgttnntnnnnnnnnttttttacttatcnattattaattattcttattttttttttgttattatgctgggggggcaaactgggactccccncggtggcggccgctctagaactagtggatcccccgggctgcaggaattcgtctcacccctagaaaaagtctggtattcctgaagtcaaagcttatcttaatggggttgatgcctattctatattagctcctagcacactctttgttaagatttttggttcaatacttggagtttcagctggattcgtgctaggaaaggaagggcccatggtacatacaggggcatgcattgccaacttgcttggtcagggtggatcacgcaaatatcatcttacttgtaactggctacgctactttaagaatgacagggacaggagagatttgatcacatgtggatctgcagctggtgtggcggctgccttccgtgcacctgttggtgggtgttctggtttgctcttgaaagaagcagccatcatgggtggccaaagtgcttctttttgttggaaaaacatttctttaacaaacttgctgtttttttgcccggtggggtattttgaaggggggccttaatttgaaggtttcctggtcccgaaaggcgggggaaaaaaatgtggggggccttccctttcccgggggcaaaagggggggggaaatattggaatatcccctgttgtgttgtggagataatccccccagaggttgttccacacaacctgtggtttttttcgcacaggtgtttctccttaacacacaatatttgtatctccttctccccccgggaaatatcctctttattatttttttgtccacaaatatattttttaatgaggtcccccccccttgggaggggaaaattaaaaaatatttggggggggggcggaaaaaatcactctttcttttgggggaagaagagcgccctctcctcttccaacaaaaattaattatacttgttgttgttggggaaaacaaagagaatatccactctccgcccgaaaaggtttttttatatagagggctttttttttttcccaacacctagaaagaagaaaggggtgtctctcccccctcttgtttcagaagataaacccctcttttcccccacccttattataacaccatttatctcaattaaatcccccccccttctatatatttgtgttt

SEQ ID NO: 90403 - protein, 100 aa, Zea mays
  misc_feature: Ceres CLONE 1578356
MVHTGACIANLLGQGGSRKYHLTCNWLRYFKNDRDRRDLITCGSAAGVAAAFRAPVGGCSGLLLKEAAIMGGQSASFCWKNISLTNLLFFCPVGYFEGGP

SEQ ID NO: 90404 - DNA, 871 bp, Zea mays
  misc_feature: Ceres CLONE 1578357
  misc_feature: Encodes the peptide sequence at SEQ ID NO. 90405
tcaccgcggtggcggccgctctagaactagtggatcccccgggctgcaggaattcgtctcacccctagaaaaacccccttgcaagcaagcagctgctctcgtgtgacctctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgctgccccgccgcgcgccgccgtccccgtcgccctccgcctccacgcgcgccaagccgcgcccccctcccgcccccaccgacgactcgctggacaacccggatctggggcccttcctcctgaagcaggcgcgcgacgccatgctgtcgggcgaaggggcggcggcacccagaaaattccagggaaggccccggaagcccggcatgcagggggtatcgaagcgccgataggcatggggatccatagtttaggacccgggaaagataccttaaggtatcggaaacaccatgccccgggggggcgaactggggtggtgactaaaacggcggtgcccgccgcacaatggggggggaggtataaatttcttccagaggcagagattaaagaaagaaagctgtggggggagtagatatagtgagacgtccgaacacagacaggcataagatacaatgaacgaaagtgaggagaaaaaaaaaaggtcctgacggaaaacggtgaagaggggggtggaaagtggcgaaacacacccacagcaagtgggagaagtagtgcgtggaagggatgagga

SEQ ID NO: 90405 - protein, 29 aa, Zea mays
  misc_feature: Ceres CLONE 1578357
MLSGEGAAAPRKFQGRPRKPGMQGVSKRR

SEQ ID NO: 90406 - DNA, 1212 bp, Zea mays
  misc_feature: Ceres CLONE 1578360
  misc_feature (60)..(60): n is a, c, t, g, unknown, or other
  misc_feature (91)..(91): n is a, c, t, g, unknown, or other
  misc_feature (1212)..(1212): n is a, c, t, g, unknown, or other
gggtagtaatgggaggtgtgggggagggaggggggtaactggtccgagcatctacctggntgcggcgtgggtgggaaactggagctcaccncggtggcggccgctctagaactagtggatcccccgggctgcaggaattcgtctcacccctagaaaaacctggccaccaccggcgcgggcgagccagctgcgcgcgcgcgctcgagcggcggcggggccgtgtccgggtacggccgcatcaccggcgagatcctccggcggcacgaagccttcgaggagcggcggaagcggtgggggcagctggggaacttcacggagctcgagcgcgtggcggccgaagcgtgggcgctcggggccgccgcgtgggaggaggcctctgcgttcgacggcgacgtcgactacatcgcctcccgcgacgtcgccggggagggcacggccaaatgcccaggctcgctcgcgctcggcgccggggagaccacggcgtttcctgccatgcgggctggcccgccgggtccggcagtttaccgggggttgggaaaggcgccggacggagccggcccggaagttctttccaagggcccccggaaaccgggaagccggccacgggggaaaaccggggacacggtgaccttgggttggggcccccaactttcccccccggggtagaaaaaagcctgtgccaccacgggggcccctggggccgccgccaacctataacctcaaaaccggtgggcgcatatagaggagagagccccccccccccccttataagaggaaaaaaaacacctcgttggggcccacaccccccccgtgctgaaaaggggaccccccggcgcggggggcgccctttttggcccccccccgacgggggcgcagaaaatacgcggggggggagaggccaaaaaaccccccgcggcccccccccccccgtggtggctctctgtggaggagagatagttgtgaaaaaaacacccccccctgggggctttttctcccgggaaaaatatgctcgcacacttggtggtggggggcccaggggatggcaaaaaatagggagagatgtggtgcgcacaacaagtggtataccccccctttttttctgggggagagaccccacattagaacccctcgtggcgccccaatatggagatattatagagagagaaattggtgtggaaaaaaaagtgggacaccttgcggtcaaggaaacan

SEQ ID NO: 90407 - DNA, 791 bp, Zea mays
  misc_feature: Ceres CLONE 1578366
  misc_feature: Encodes the peptide sequence at SEQ ID NO. 90408
tggagctcaccgcggtggcggccgctctagaactagtggatcccccgggctgcaggaattcgtctcacccctagaaaaagttgctgttctattcgggtacagaacacccattggtttggaagccatcaccaccaccacctataataaattgcacgagatttgccgcgagaccgcatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcaaggccaagaagcctcctcccacttgctgcccatca

SEQ ID NO: 90408 - protein, 133 aa, Zea mays
  misc_feature: Ceres CLONE 1578366
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQEASSHLLPI

SEQ ID NO: 90409 - DNA, 883 bp, Zea mays
  misc_feature: Ceres CLONE 1578369
  misc_feature: Encodes the peptide sequence at SEQ ID NO. 90410
  misc_feature (814)..(814): n is a, c, t, g, unknown, or other
gccgtggcggccgctctagaactagtggatcccccgggctgcaggaattcgtctcacccctagaaaaaagacgacacgccaccagcaccaaccatccggcgagatggagaccccgccgcggggtcggtggccgccagggttccgcttcagccccaccgacgaggagcttgttctctacttcctgaagcgccggatcgcctccgggcgcccctgtccctacgtcgccgacgtcgaagtgtacaagtcacacccctcccacctcccccgagaggtcggggctgcaaaacggggacagggagggggtcctcttctcgccggagggaccggaagtaccccaaggggttgggggggccccccccccacctggggacgggctacctggaagggccccgggaaaagacccctttttttttgggggggggggccggggcggttgggcaaccagaaaaaaaccctgggggttccccccttggggccgggccccccccgcggggggggggggccccccgggaaacttgggggggttttttgtgtgcacccacaaaaaataatttcaccccccccctcttctttttcagaagatagagagggggtatgccccccccccccccccgccgtggggttatcttaaaaagaaaaaggggggggggggggggggggagttgatttttgtttcttaatcacggccgccccgggaaaatttcaaaatgagtagagtggttggggggggtcgcccgccgcaatagaaaaaaaacaaaaattaatataaggggtgggggcaggggccgcgtgtggggtggcttctctataaganaggggagggcggacgaacattcccctcacaacccaggaggggggagggcggacacccctcctcctcccc

SEQ ID NO: 90410 - protein, 175 aa, Zea mays
  misc_feature: Ceres CLONE 1578369
  misc_feature (9)..(131): Pfam Name: NAM Pfam Description: No apical meristem (NAM) protein
METPPRGRWPPGFRFSPTDEELVLYFLKRRIASGRPCPYVADVEVYKSHPSHLPREVGAAKRGQGGGPLLAGGTGSTPRGWGGPPPTWGRATWKGPGKRPLFFWGGGPGRLGNQKKTLGVPPLGPGPPRGGGGPPGKLGGVFCVHPQKIISPPPSSFSEDREGVCPPPPPAVGLS

SEQ ID NO: 90411 - DNA, 823 bp, Zea mays
  misc_feature: Ceres CLONE 1578370
  misc_feature: Encodes the peptide sequence at SEQ ID NO. 90412
  misc_feature (772)..(772): n is a, c, t, g, unknown, or other
ccccgcggtggcggccgctctagaactagtggatcccccgggctgcaggaattcgtctcacccctagaaaaagtcagttctcatcccatgcacgcatcggcatatatcaatggcgagctcctcctcctccgagcaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcttccaggagctcatccgctacggcgagttcgcccaggccacctacgacagcttcgactacgaccgctttctccccctactgcggcagctggcagtaccccgcggaggactttcttccacgacgtcgggcctcggcggcatccggctaacgagttcacccgctaanttctacgccacctggaaacgacctccaagtccccaaacttcgggcatcagt

SEQ ID NO: 90412 - protein, 172 aa, Zea mays
  misc_feature: Ceres CLONE 1578370
  misc_feature (155)..(155): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLFQELIRYGEFAQATYDSFDYDRFLPLLRQLAVPRGGLSSTTSGLGGIRLTSSPAXFYATWKRPPSPQTSGIS

SEQ ID NO: 90413 - DNA, 775 bp, Zea mays
  misc_feature: Ceres CLONE 1578371
  misc_feature: Encodes the peptide sequence at SEQ ID NO. 90414
  misc_feature (590)..(590): n is a, c, t, g, unknown, or other
  misc_feature (674)..(674): n is a, c, t, g, unknown, or other
  misc_feature (690)..(690): n is a, c, t, g, unknown, or other
ctcaccgcggtggcggccgctctagaactagtggatcccccgggctgcaggaattcgtctcacccctagaaaaaccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttangaaagattgttgacaccgtggatggcggcaacctttattgatttctacataaatgtctttgcgatatcggtctgggttgctcancaagtatcatcatggnatatcactaccattttggattgtcttggctgatatggcttgggaagcatcacaacatggcggctactttgtcatcccacttttca

SEQ ID NO: 90414 - protein, 160 aa, Zea mays
  misc_feature: Ceres CLONE 1578371
  misc_feature (1)..(161): Pfam Name: DUF1475 Pfam Description: Protein of unknown function (DUF1475)
  misc_feature (157)..(157): Xaa is any aa, unknown, or other
MAAQGSLVMWRAVFAALGLLMVATLVYTLATDGSPFRLELFTPWMVATLADFYVNVIAISAWVIYKEANWVSSAVWVVLLFCFGSAVTCAYIVKKLLEVTSAGSSQDPLDLLFIRQGNLSQRKCSYVVIGRVIFSILGIFMAAVVTYTVITDGLPFXKDC

SEQ ID NO: 90415 - DNA, 2038 bp, Zea mays
  misc_feature: Ceres CLONE 1578373
  misc_feature: Encodes the peptide sequence at SEQ ID NO. 90416
agacgaagtggggcgcctagcttcttactagttttttttttccttgcgcaaagcttgcacttgctgagagagagggagagagaaatccagagataaaggcgcttcattcattccctctcctgctttctctctccaacccatccgtcctctctctccacacataaaaaccaacgaagcgggcgagtgatcaggcagaggcagcaggcaggaaataaatttgaagaaagctagacctctgatcagcaggagctcatgggcgccatgatggcctccataaccagcgagctcctcttcttccttcccttcatcctgctggccctcctcgccttgtacaccaccaccgtcgccaaatgccacggcacccacccgtggcgccgtcagaagaagaagcggcccaacctgcccccgggcgcccgcggatggcccttggtcggcgaaactttcggctacctccgcgcccacccggccacctccgtgggccgcttcatggagcggcatgtcgcacggtacgggaagatataccggtcgagcctgttcggggagcggacggtggtgtcggcggacgcggggctgaaccgctacatcctgcagaacgaggggcggctgttcgagtgcagctacccgcgcagcatcggcggcatcctgggcaagtggtccatgctggtgctcgtgggcgacgcgcaccgcgagatgcgcgctatctcgctcaacttcctcagctccgtccgcctccgcgccgtgctgctccccgaggtggagcgccacaccctgctggtcctccgctcgtggccgccctccgacggcaccttctccgcccagcacgaagccaagaagttcacgtttaacctgatggcgaagaacataatgagcatggaccccggcgaggaggagacggagcggctgcggctggagtacatcaccttcatgaagggcgtcgtgtcagcgccgctcaacttcccgggcacggcctactggaaggcgctcaagtcgcgcgcgtccatacttggagtgatagagaggaagatggaggacaggcttgagaagatgagcagggagaagtcaagcgtggaggaggacgaccttcttggatgggccctgaagcaatccaacctgtccaaggaacagatcctggacctcttgctgagcctgctcttcgcggggcacgagacttcgtccatggcgctcgccctcgccatcttcttcctcgaagggtgccctaaggccgtgcaagaactccgggaggagcatctcctgattgctaggagacaaaggctaaggggggcgtccaaattgagctgggaagactacaaggaaatggttttcacgcagtgtgttataaacgagacattgcggctcggcaacgtggtcaggttcctgcaccggaaggtcatccgagatgtacactacaatgggtacgacataccgcgggggtggaaaatcctgccggttctagcggcggtgcacctggactcgtcgctgtacgaggaccccagccggttcaacccttggagatggaagagcaacaacgcgccaagcagcttcatgccgtacggcggcgggccgcggctgtgcgccgggtcggagctggccaagctggagatggccatcttcctgcaccacctggtgctcaacttccggtgggagctggcggagccggaccaggccttcgtctaccctttcgtcgacttccccaagggcctcccgatcagggtccagcgggtcgccgacgaccaaggccatcgtagcgttttgaccgagagcacaagaggctgagagggaggaggcagttcaatttttcgttgcattttgagggctgtggtctcgtgttttatgtagattgtgattattattattatacatactaaaacaagatagaagcacgtatagacagagcaaagaggaggatggtccaaaagtgtttggggtagataaaatgtgtactcactagggttgtaataaggccggtccatggcccatgtcaagtaatactagagatatatagaatatagtggatatccaacaaaaaaaaaaaaaaaaa

SEQ ID NO: 90416 - protein, 506 aa, Zea mays
  misc_feature: Ceres CLONE 1578373
  misc_feature (51)..(487): Pfam Name: p450 Pfam Description: Cytochrome P450
  misc_feature: SWISSPROT Homolog: EC 1.14.13.93 (+)-abscisic acid 8'-hydroxylase
  misc_feature: Functional homolog of the protein sequence given in SEQ ID NO 96888
  misc_feature: Useful for making plants with modulated seed number
MGAMMASITSELLFFLPFILLALLALYTTTVAKCHGTHPWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 90417 - DNA, 822 bp, Zea mays
  misc_feature: Ceres CLONE 1578374
  misc_feature: Encodes the peptide sequence at SEQ ID NO. 90418
gagctccccgcggtggcggccgctctagaactagtggatcccccgggctgcaggaattcgtctcacccctagaaaaagaagagcgtgcagagcgatacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaagagcaacatcgtttcttttcaccgagtaccaaatatgttggtatccttcatggctatcttcgctggttgtgatctttcctcttctttgggttcggttgagggattcagcacgaaaaagccagccctggaccttttggaagggacaagtactggcagccctggctctggtcccttggaactcttttaagcaccgggggccccttcttggcgtggggagcccttcacctctcctgggggccccccggggttttcctttgggggcattaaaaaaatttggccccccaattttggcgaaaaagggccccaaaaaaatctcccccctttggaaaaaactcttattaaaaaagggggggttttgtttttgcaaaaaaaggcttcttttttattaaaccccacgagggggttttttc

SEQ ID NO: 90418 - protein, 208 aa, Zea mays
  misc_feature: Ceres CLONE 1578374
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNVVVKCAEIQNAISERATSFLFTEYQICWYPSWLSSLVVIFPLLWVRLRDSARKSQPWTFWKGQVLAALALVPWNSFKHRGPLLGVGSPSPLLGAPRGFPLGALKKFGPPILAKKGPKKISPLWKKLLLKKGGFCFCKKRLLFY

SEQ ID NO: 90419 - DNA, 1192 bp, Zea mays
  misc_feature: Ceres CLONE 1578378
  misc_feature: Translation starting site: 328
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (15)..(15): n is a, c, t, g, unknown, or other
  misc_feature (57)..(57): n is a, c, t, g, unknown, or other
  misc_feature (1167)..(1167): n is a, c, t, g, unknown, or other
  misc_feature (1178)..(1178): n is a, c, t, g, unknown, or other
  misc_feature (1186)..(1186): n is a, c, t, g, unknown, or other
  misc_feature (1187)..(1187): n is a, c, t, g, unknown, or other
nnnggggggggggtntggggcttacttatatacaaagctaaatagggaatataaganggggggggaagagaggaaaagtggagctccccgcggtggcggccgctctagaactagtggatcccccgggctgcaggaattcgtctcacccctagaaaaaagccaggccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctaggaggaggcgcggcgccggcggagatggggtccaagtacacgcgcgggtgctgcggctggctgatcgtggcgctgattgcggcgctggtggccacagccgcgatgttcgccatcatgaagcgcaagcccgggggcccccacatcaagcctctgccggtgcccggggccgcggggggcatccacttcaaggtccggggacgcgcctcggggtccgcgccccacatccttccaaggtcccggaaggggggggaaaacgtggagaaaaaacctggatgccggcggggggggggggaattccggggttggaaccgtatggggaaagggaaaaggggggcctggaatactttctccaagggggaaagggtaatgaaatggcgtgggcgggattccaaaggaaagggttccacccctcctccacggagggagggttttccccaagggggggaagcgggggtgctccctcccctcggggaatcggggagggcccctcgggtagtgttcgacgcgggggggaaatctctagattttgtaatcgcgccctggccaaataagcccctcaagtggggggagaccgccggggtcctcactgaggggggtctctccttgatcatcctgggggtatataacaacacgggttgttccccccttatgatggggggcgtgaggacaaattcgccctgtggtgaggggagccaggtgggtggtaccgggataggataacccccgagggtgcacgcggggaggtgcagaccggtgaatctctgggacagcgccacagggtgtgggtatgtgcggagcaaagggcggcgccgggaagaagactatcggggagccctgtggatactgaaaaaaagacgtaccctnggaagactccnggggctannataaa

SEQ ID NO: 90420 - DNA, 763 bp, Zea mays
  misc_feature: Ceres CLONE 1578379
  misc_feature: Translation starting site: 485
  misc_feature (546)..(546): n is a, c, t, g, unknown, or other
  misc_feature (554)..(554): n is a, c, t, g, unknown, or other
  misc_feature (555)..(555): n is a, c, t, g, unknown, or other
  misc_feature (664)..(664): n is a, c, t, g, unknown, or other
ctcaccgcggtggcggccgctctagaactagtggatcccccgggctgcaggaattcgtctcacccctagaaaaaacccaaaactccgctctcatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatcggcaacttgctgcagggctgggacaatgcgacaattgctggagccgtcctgtacataaagaaggtttgggggtcggtaaagatacacgtattgaagaatacataattggtcccgatgatgaacttgctgatgaagggctggctccagatccagagaagatcaaactatatggaccntgaagaanngctatcttgggttgcccgacctgttcgggggacaagtgctcttggaagcgcgttaggtctcatctctcgtcatgggagtatgggcggctagtcagggtaagccccctcnggaatcctatggtcactcctttttcggaagtgttcatggaaaagaatgcctggagatcatgggggaagcattgagggagcacatttggttttcccaacc

SEQ ID NO: 90421 - DNA, 891 bp, Zea mays
  misc_feature: Ceres CLONE 1578380
  misc_feature: Encodes the peptide sequence at SEQ ID NO. 90422
ggagctccccgcggtggcggccgctctagaactagtggatcccccgggctgcaggaattcgtctcacccctagaaaaattttctccccaccccaccacacccgcgtcaaccaaccaaaccctagaaggctctcgccctcgtccccaatccctcgccgccccgcgatccccgccgcccgcaggccaaaaccctacgcgtattgctcgacgccgggtatagacagtgtaatcactttgtcagaaatgccttctgcatccaagtccaaggcaaaagaaagatcagctgcaaaagttgcaaaagagcaacccaaggttgctgcaaagccaatgggaaatgctacacttgcaagttcttataacaacctgtctggaaagttccatgttctggaaccatcaagctctttgttgggtagccaaggcatcgataaattcaggaatacagatgaaatagatgagcattctcgcagctcccatggtacaggggatttcgattgtgcctccaacaatggtagctgttctggtgactcagaggatacaaaggataaatcaaccagcactgcgtcccgagtagactctgttccctggatgtgatattgataaaccgtgagaagattagacggaaaaaatgagaaagaaccttcaaaagacggaaggggagggggtgcccaaaaagttaacacgagccgttggttagggaatacatttatggcccagaaaaagttgggaacccatttggcgcaaaaagccttggtttgccaatgggggtttcctcccagcaggaatcaaggcgaacggaatggcgctttttataacacaaaaatgaagggggtgggcggtttagaaggagaattccgggttacccctgtgggcacgcggccaaacatttcgtgag

SEQ ID NO: 90422 - protein, 115 aa, Zea mays
  misc_feature: Ceres CLONE 1578380
MPSASKSKAKERSAAKVAKEQPKVAAKPMGNATLASSYNNLSGKFHVLEPSSSLLGSQGIDKFRNTDEIDEHSRSSHGTGDFDCASNNGSCSGDSEDTKDKSTSTASRVDSVPWM

SEQ ID NO: 90423 - DNA, 736 bp, Zea mays
  misc_feature: Ceres CLONE 1578384
  misc_feature: Encodes the peptide sequence at SEQ ID NO. 90424
ctcaccgcggtggcggccgctctagaactagtggatcccccgggctgcaggaattcgtctcacccctagaaaaaatacgcccgcacacccgcaatccagccaccgccgcgatccgcccgcccgtgcatgccgcaaccgcgcgatccgcccgcccgccgcaaaaccgccgcgatctcgcggcccgcccgtccgccatccagccaccccgctgcgaccgctccgtgcatgcctccactgtcgcgatccgcaaaaccgctgcaaaaccgccgcgatgtgaccggcgagatccgcccgcccgccgaccagccgtgaccggcgagatccgcccgcccgcccaccgcaaaccccgcgcgcgaccgctccgcaaccgccgctcccgcccactcgtcgcgcaatcctctcctcctacccatctgctccgcaatccccgccattgttgcatcagatgcagaaggaggctatggcgccgcagcacgctccgcccgacttctcgcatggaggttgcggcggcgagaggaagcggcagtgcgaggcggaccccgtgtcccggcagctcttgtcgttgcagcagcagcaaccgcaggcgacttggacgaagcagcagcagcaaccaagcgcagtggcccaagttcatcaacctggcgcaactgcacaagcggccgacgacgggcctccggctcgaattggacgagagctcggagcacgtgccgtgcacgccccctttcctcggcagcct

SEQ ID NO: 90424 - protein, 97 aa, Zea mays
  misc_feature: Ceres CLONE 1578384
MQKEAMAPQHAPPDFSHGGCGGERKRQCEADPVSRQLLSLQQQQPQATWTKQQQQPSAVAQVHQPGATAQAADDGPPARIGRELGARAVHAPFPRQP

SEQ ID NO: 90425 - DNA, 866 bp, Zea mays
  misc_feature: Ceres CLONE 1578386
  misc_feature: Encodes the peptide sequence at SEQ ID NO. 90426
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (866)..(866): n is a, c, t, g, unknown, or other
ctggagctccccgcggtggcggccgctctagaactagtggatcccccgggctgcaggaattcgtctcacccctagaaaaaggcctagcacagatgcagacggctgcttcgtttgggtatgcggcgggacggggacctcggaagcgagctacaacgacgtccccccccccccacccacagcagtcatggggtcggtgccgccggcagagggggacaggcgccagccccagcagcagccgcacgtgatgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctcctcggccccccccggttccgcttcaccgccattgacgacgggcttccgccctccgacgccgacgccacccaggacgtccccaagctctgctactccaccatgaccaccttgcctaccccggttcaagggaccttattgtcagggacaatgccgagggccgaggcccagggacgcccccgccgtgacgtggcgtcctcgccgacagcataatggagcttcgggcctccgcgcccgcgcggggagctcgggtctccgctgtgccccacgtttctggaaccgccaagcgcccggcgggctttcattgggcttactaactaattacccgcccacccttcgttcgccagcgggggtatttcggtcccccccttttaaaaaatggaaagccggtaagctttccccccgaacggggggttccctcttgggaaacacccgctccttnnncaaaaattggggatattcccctttgtggccgccn

SEQ ID NO: 90426 - protein, 138 aa, Zea mays
  misc_feature: Ceres CLONE 1578386
  misc_feature: SWISSPROT Homolog: EC 2.4.1.121 Indole-3-acetate beta-glucosyltransferase
MGSVPPAEGDRRQPQQQPHVMMIPYPAQGHVTPMLQLAKLLHTRGFHVTFVNNEFNHRRHLRARGPGALLGPPRFRFTAIDDGLPPSDADATQDVPKLCYSTMTTLPTPVQGTLLSGTMPRAEAQGRPRRDVASSPTA

SEQ ID NO: 90427 - DNA, 794 bp, Zea mays
  misc_feature: Ceres CLONE 1578387
  misc_feature: Encodes the peptide sequence at SEQ ID NO. 90428
ctcaccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaagctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaaaggcatggaccccaccgtcgagcgcttgaagagcgggttccagaagttcaagaccgaggtctatgacaagaagcccgagctgttcaagcctctcaaggccggccagaacccccaggaacatggggttcccccggctccgaactcccgcgtggtgccccgtcggtgaccctggggcccgcagccccggcgaaaggccttcaccgtcccccaaacatccccctcccttggtcccccccccctcccaaaaaaaatcaaaggacccccccggcacagggggtc

SEQ ID NO: 90428 - protein, 101 aa, Zea mays
  misc_feature: Ceres CLONE 1578387
  misc_feature: SWISSPROT Homolog: EC 4.2.1.1 Carbonate dehydratase
MSSCLCLPKKKEGPAKEKPSTDTPTSSLLQNQKPSQPPPPPSKASSKGMDPTVERLKSGFQKFKTEVYDKKPELFKPLKAGQNPQEHGVPPAPNSRVVPRR

SEQ ID NO: 90429 - DNA, 841 bp, Zea mays
  misc_feature: Ceres CLONE 1578388
  misc_feature: Encodes the peptide sequence at SEQ ID NO. 90430
ctccccgcggtggcggccgctctagaactagtggatcccccgggctgcaggaattcgtctcacccctagaaaaaggagagagaaagcgagctgaggagcgcaggcgctgtcgctggcgaggacatgctcgcggcagcgcttttatgggctcaaaccatatgcgtgtcccgaacggtggagagcggcaaccactactcgccttcgtctcggacctcacgcgctcctgggctgcctcttcctgctagaaaccgtcgtgtcgcgggaggcttgctctgcgactgaaagcgccaatctgctgtgccttgggtggcgcccgcaggagtggaagtggaaccccagccaccagccggtgctgtgatggacgcgcaggggcagctggatttggtcatgcgtgcccggagcatgaccaccgagtgaaagaccgaggacgccctcgggacctccccaatcagaccaagataggccgagcgcgcccgcgcggtaagaggagccgcgcgacctacgtgcacaacctctccgaccattaggaggacgagcaggatcagcgcccatatgacggcgctgcagaccatcatacgcaactcgagcaagacggacaacgcttccatgcttgatgatgccattgactacatgaagcatcatcagctcccggtgccacatgttgtctaagaggcaatgcctcgtagcagcgcccagggaaacctgtctggagcacccaagactgtgggggccggtataaatgtactcggcaatgaaacccagccggtcctcaggcatcaaagtccggtgtaggggtttcaagcaggaaaaggaaattgctgcacaacgtcttccgactgag

SEQ ID NO: 90430 - protein, 38 aa, Zea mays
  misc_feature: Ceres CLONE 1578388
  misc_feature: The sequence is a functional homolog of SEQ ID NO 1488 in the 11/479,226 US patent application
  misc_feature: The sequence is a functional homolog of SEQ ID NO 712 in the 10/412,699 US patent application
  misc_feature: The sequence is a functional homolog of SEQ ID NO 901 in the 11/479,226 US patent application
  misc_feature: The sequence is a functional homolog of SEQ ID NO 1169 in the 11/479,226 US patent application
  misc_feature: The sequence is a functional homolog of SEQ ID NO 2420 in the 10/374,780 US patent application
  misc_feature: The sequence is a functional homolog of SEQ ID NO 524 in the 10/412,699 US patent application
  misc_feature: The sequence is a functional homolog of SEQ ID NO 812 in the 10/225,066 US patent application
  misc_feature: The sequence is a functional homolog of SEQ ID NO 120 in the 10/225,068 US patent application
  misc_feature: The sequence is a functional homolog of SEQ ID NO 160 in the 10/374,780 US patent application
  misc_feature: The sequence is a functional homolog of SEQ ID NO 540 in the 10/412,699 US patent application
  misc_feature: The sequence is a functional homolog of SEQ ID NO 624 in the 11/435,388 US patent application
  misc_feature: The sequence is a functional homolog of SEQ ID NO 944 in the 10/225,066 US patent application
  misc_feature: The sequence is a functional homolog of SEQ ID NO 1188 in the 11/479,226 US patent application
  misc_feature: The sequence is a functional homolog of SEQ ID NO 534 in the 10/412,699 US patent application
MTALQTIIRNSSKTDNASMLDDAIDYMKHHQLPVPHVV

SEQ ID NO: 90431 - DNA, 1170 bp, Zea mays
  misc_feature: Ceres CLONE 1578389
  misc_feature: Encodes the peptide sequence at SEQ ID NO. 90432
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (91)..(91): n is a, c, t, g, unknown, or other
  misc_feature (653)..(653): n is a, c, t, g, unknown, or other
  misc_feature (807)..(807): n is a, c, t, g, unknown, or other
  misc_feature (808)..(808): n is a, c, t, g, unknown, or other
  misc_feature (927)..(927): n is a, c, t, g, unknown, or other
gtggggggggggggggggnncttctcncgtgaccgccgcactcctaccctttaaccttttataatttggtggtaaaaactggagctcaccncggtggcggccgctctagaactagtggatcccccgggctgcaggaattcgtctcacccctagaaaaaagcaggccaagcgcaccaccaccacagacatcatcagatcaccacccagtgcagcaaaagaaagaaagaaagaaaagaaaaaggcaggcgcgccaaaatggacaacggcggcagcaacggctccgccaccgcctccgcctgctgcaacggcaaaattaaccgcgggccgcacgtggcgatgctggcgacgcccgggatggggcacctgatcccgctggcggagctggcgaagcggctggcgtcgcggcacggcgccacggccacgctcatcacgttcgcgtccacggcgtcgcccacgcagcgcgcgttcctgggcctcgcttcccgccccgcggtggtcctcaactggtccctcccggcccgtcgaaccctctccgaacctggcccccggcggcccgccggccaattcaaagaacccgcccattgttcccgaaaggaagttggcgccgcccgccttcggggttgccccggggcgcccttgaaacggggccgttntccctcttcgccccgggggccctctcataaggggtggggaaaaacaaccggggagcccgggggtcctcactcccctttgggtggcctgggtaccccctatctcaacaatgggagaggcgcccctaaaaaaaactactatctttgtttttggggnnccgggcgcacccgcaaaaaaaatctcacgccattttgtggataaatcatcccgagggcgaccccccgcctcgatacaccttcagcggggggggggtacgcccccccacacccgctcccnaggggggggagaacaatcacgtttcgcctttcccccccaaattcctaaaaaaacggggggcacattgtgggttctcactaaagcgcgccgccttagacccctctcccaccaccgtggtcgcgcgaaaataccttcgtagaaccccccccaccccgtggtacccgcggggcgcgcgttttccccggggagaaaaaaggtcaccgagataaccacacacgttgttcccctttgccaccggggggg

SEQ ID NO: 90432 - protein, 198 aa, Zea mays
  misc_feature: Ceres CLONE 1578389
  misc_feature: SWISSPROT Homolog: EC 2.4.1.218 Hydroquinone glucosyltransferase
  misc_feature (133)..(133): Xaa is any aa, unknown, or other
  misc_feature (185)..(185): Xaa is any aa, unknown, or other
MDNGGSNGSATASACCNGKINRGPHVAMLATPGMGHLIPLAELAKRLASRHGATATLITFASTASPTQRAFLGLASRPAVVLNWSLPARRTLSEPGPRRPAGQFKEPAHCSRKEVGAARLRGCPGAPLKRGRXPSSPRGPSHKGWGKTTGEPGGPHSPLGGLGTPYLNNGRGAPKKNYYLCFWGXGRTRKKNLTPFCG

SEQ ID NO: 90433 - DNA, 804 bp, Zea mays
  misc_feature: Ceres CLONE 1578390
  misc_feature (342)..(342): n is a, c, t, g, unknown, or other
  misc_feature (343)..(343): n is a, c, t, g, unknown, or other
  misc_feature (356)..(356): n is a, c, t, g, unknown, or other
  misc_feature (387)..(387): n is a, c, t, g, unknown, or other
  misc_feature (399)..(399): n is a, c, t, g, unknown, or other
  misc_feature (751)..(751): n is a, c, t, g, unknown, or other
tggagctccccgcggtggcggccgctctagaactagtggatcccccgggctgcaggaattcgtctcacccctagaaaaattccttcccagttcggcagttccctccctccctcctcgtcacctaatccgccccgtcgccccggaagcttcaagaaggtggacggtcggagggacgggctacatggggggctgcttctggtagcttcggtcgcccgccgcgccgccgccaggtcagtcagcgccgtcccgtgcctcgtcggtcgcgtggcacccgcccttctcttactcctcaccccgtcgctgtcggcccccacccgcattcgcaacgccgggcccgatccnngcgcgccctccgnattcccgcccccacccttaggccccgcccgncctcctttttcnttttactggtagcaagctcccctccaaaccctaactttcattccccggttcgcaagcccccgtttggggggggttgaacccttttttttccggccccgggcccccgggttctcggggcccggggaaattttttccaaccctcacctggggaattttttaaaaaaaagaaaaaaaggggcttttttttttctccaaaacgccccaaaccgtgtttttgggtttttcccccccttttttttgcgcaaaacccgttttttttttttttttttaaaaggggggggtttctaaaaaccccggggggggggcaaaaaatttttttaaaaaaaacgcccccccccccggagaaaaaaancactttgtgggacgggggggggcgccccaccacattttttttttttttgaaac

SEQ ID NO: 90434 - DNA, 806 bp, Zea mays
  misc_feature: Ceres CLONE 1578391
  misc_feature: Encodes the peptide sequence at SEQ ID NO. 90435
ctccccgcggtggcggccgctctagaactagtggatcccccgggctgcaggaattcgtctcacccctagaaaaaagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtgagtactgcatcaaataaattgagatgatcagatgaatttatcagctgtcttactcgactgctggactcaggactgaaaaatctgtggtgc

SEQ ID NO: 90435 - protein, 123 aa, Zea mays
  misc_feature: Ceres CLONE 1578391
  misc_feature (28)..(124): Pfam Name: SBP56 Pfam Description: 56kDa selenium binding protein (SBP56)
MAGAAAVETAAAAAAAAAAANGKACCHAAKGPGYATPLEAMEKGPREKLVYVTCVYNGTGINKPDYLATVDLDPSSPTYSQVIHRLPVTHIGDELHHSGWNSCSSCHGDPSAKRRFLILPSLL

SEQ ID NO: 90436 - DNA, 764 bp, Zea mays
  misc_feature: Ceres CLONE 1578396
  misc_feature: Encodes the peptide sequence at SEQ ID NO. 90437
ctccccgcggtggcggccgctctagaactagtggatcccccgggctgcaggaattcgtctcacccctagaaaaactcgtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgtacacgctcggaaaggatggccgccgggtgcatgtcatcgagagggatctgacaggacctgacagaattgtgggcgagctgttgcaacctgggaagttacttgaaattaattgagttagggctccaagaatgtgggggaagaaattgatgcccaacggggtgctgggttacgcatttattcaaagatggaaagaaacacaaagctttgcttatcccctaagagaaagtcccaattctgatggttgctgggtaggagccttcaccaa

SEQ ID NO: 90437 - protein, 119 aa, Zea mays
  misc_feature: Ceres CLONE 1578396
  misc_feature: SWISSPROT Homolog: EC 1.14.99.7 Squalene monooxygenase
MAAMAAAGGVGLHLIGAATATLIAAVLVAAVLGRRRRARAQAPPVEGKPAPEAGCAVGDGAGPDGGTDVIIVGAGVAGSALAYTLGKDGRRVHVIERDLTGPDRIVGELLQPGKLLEIN

SEQ ID NO: 90438 - DNA, 876 bp, Zea mays
  misc_feature: Ceres CLONE 1578398
ctggagctccccgcggtggcggccgctctagaactagtggatcccccgggctgcaggaattcgtctcacccctagaaaaaatgtgctgctggtgtacctctcttccttgtccttctcacactggatgtgtgatctactgctcccagagcgctatccattgccggggaacaagcatcttgttgccagccacctctatggcgagctccgacattggctccacctgctcccccaaggacctgccgggtagctacggtctgcccctcgtggtcgccgtgcacaacctcctctgcttcatctacttgcgctggtctgactagcacttccagtccgccatgaagaccatctgctcacccttgatgctcatgatcatgccggctggccgattcttggcatctcgacacaagagtcgcttccgtcctaaactccatgatcttccccatgctcgatcccgtcgtacttgcgcagaagaatgtcatgtccaccggcacttctgtgcagtcttgctgcaatctctgttggtcatcaagtactatctctcgtgttcccctcagagcccacccacacattggcgaatcgtgatatgattaaccgacctgatctacgtcatgcactacctggtcccaacatgcctctccactatgatgatgaccgactccacccttgaagtcggtactaggccaatggtggcaaaggccgagtgaaccagggaccacgaactttttcctcccttggacttaggcttccgaaggccaactttcgttttggcccccctttgggaacccgaaattgacaaaaggggcggaccaaacaaaggccgtgcccaagggggttcatattggggccctccccctcagttgggtataaagggtgggaccg

SEQ ID NO: 90439 - DNA, 1226 bp, Zea mays
  misc_feature: Ceres CLONE 1578399
  misc_feature: Encodes the peptide sequence at SEQ ID NO. 90440
  misc_feature (21)..(21): n is a, c, t, g, unknown, or other
  misc_feature (29)..(29): n is a, c, t, g, unknown, or other
  misc_feature (50)..(50): n is a, c, t, g, unknown, or other
  misc_feature (51)..(51): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (562)..(562): n is a, c, t, g, unknown, or other
  misc_feature (795)..(795): n is a, c, t, g, unknown, or other
  misc_feature (804)..(804): n is a, c, t, g, unknown, or other
  misc_feature (910)..(910): n is a, c, t, g, unknown, or other
  misc_feature (913)..(913): n is a, c, t, g, unknown, or other
  misc_feature (937)..(937): n is a, c, t, g, unknown, or other
  misc_feature (941)..(941): n is a, c, t, g, unknown, or other
  misc_feature (974)..(974): n is a, c, t, g, unknown, or other
  misc_feature (977)..(977): n is a, c, t, g, unknown, or other
  misc_feature (981)..(981): n is a, c, t, g, unknown, or other
  misc_feature (1004)..(1004): n is a, c, t, g, unknown, or other
  misc_feature (1053)..(1053): n is a, c, t, g, unknown, or other
  misc_feature (1056)..(1056): n is a, c, t, g, unknown, or other
  misc_feature (1114)..(1114): n is a, c, t, g, unknown, or other
  misc_feature (1148)..(1148): n is a, c, t, g, unknown, or other
  misc_feature (1156)..(1156): n is a, c, t, g, unknown, or other
tggtggggatttccggggatnaaaaaatntggtggtataatgacacccannaatntannntttttttttttaaaaactggagctccccgcggtggcggccgctctagaactagtggatcccccgggctgcaggaattcgtctcacccctagaaaaatcgtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctgcgggtggagggaaaccccccccggaaagcaggctgcccggtccggtgaccccgggggctccccaccggccgcaaccggactgtcatcctcccctccggngcccggcagggggccggacatcctgcgaccggggccccgccccccccccccgcacaggggattgcccccggcccggggcgcccttggccccactccgtggaaaggggatttttggagacaaggagaaccctcgcaccacacaaaaagcttcttccgctgggccccacaacccgaggggtgtggaccaacaccaccccgtggagataagggggttctcaacatctctatgtggnaaaaaaganatataaaaatcacccaccaacagaccggtttaaagaggagggaggctgtctggaccaaacgaacagaaatagctttgggcgccgctggcgccacagaggatagaantantggtgagctgcgggcgcctccccnaagnacagggggcatccgcccgccccacggcagactnatnaganttgggtttttgtagtgtcccgcncactagatgccgcgcgcgcatgccgcagtcacgccacctcccccggcgnccnttagggctatcacaacacaccccgatttggagaaagacaaaacgacgctcgcggtcantatcaaccaccccaccgcacgcagagtttattantacacgancttctacagcaacagcgggggagctagggctttcataaccactcgcgaggcgtcggcagtcttgacacag

SEQ ID NO: 90440 - protein, 158 aa, Zea mays
  misc_feature: Ceres CLONE 1578399
  misc_feature (77)..(77): Xaa is any aa, unknown, or other
  misc_feature (157)..(157): Xaa is any aa, unknown, or other
MAAMAAAGGVGLHLIGAATATLIAAVLVAAVLGRRRRARAQAPAGGGKPPPESRLPGPVTPGAPHRPQPDCHPPLRXPAGGRTSCDRGPAPPPRTGDCPRPGAPLAPLRGKGIFGDKENPRTTQKASSAGPHNPRGVDQHHPVEIRGFSTSLCGKKXI

SEQ ID NO: 90441 - DNA, 810 bp, Zea mays
  misc_feature: Ceres CLONE 1578405
  misc_feature: Encodes the peptide sequence at SEQ ID NO. 90442
ctggagctccccgcggtggcggccgctctagaactagtggatcccccgggctgcaggaattcgtctcacccctagaaaatatctagctgccctcccatccagcagcccaccccccacccacctcggacctgctgctccctccactcaccacccccggccgagcgaattgaagaagctccccctctgaactgaagcaatggcagacggcaatgccggtggcgccgctcgagtcctgttctccatcctcggcctggcgctggcgctgccgctgccgctgctcgtggccggcgacgacccgtaccggttcttcacgtggacggtgacctacggcgacatctacccgctggggcgtcaagcagcagggggatccttgatcaacaaaccagttccccggggcccgcagaatcgagggccgtcccccaaccgaaaaccctccattattcaaaggtctttcaacaaggctccaacgaaagcccgtttccctcctccccccggggagcgggggctcccagccgggggggggggggaaactccctttttccaaagaaaaaagggcgttgggccccggggaaaccaaacacggggccccccaaaacccccccccccggggggggcccccaaaaaattttttacccccctaaataatttttatttggtccgggggcgccccccgggggggccccccaaaaaattgggggggggcccccccaaaaaaaaaaaaaacaattttcccccccccccccggggggggcggccttcccccaaaaaaagaggggccccccccgggggggggtgttttttctgtgcgcg

SEQ ID NO: 90442 - protein, 37 aa, Zea mays
  misc_feature: Ceres CLONE 1578405
MPVAPLESCSPSSAWRWRCRCRCSWPATTRTGSSRGR

SEQ ID NO: 90443 - DNA, 784 bp, Zea mays
  misc_feature: Ceres CLONE 1578407
  misc_feature: Encodes the peptide sequence at SEQ ID NO. 90444
  misc_feature (625)..(625): n is a, c, t, g, unknown, or other
ctccccgcggtggcggccgctctagaactagtggatcccccgggctgcaggaattcgtctcacccctagaaaaaagcaaccttcttcttcatcttctccagtcctccctcccgccccgtccatcgacacagcagcttgcttgtcaccaagctagccaagcaggaggagtaagagtacagccagagagagagagagagagagcaccaccctgattccacccaccgctgtcccttgcttatttacaggcgttcgtgatcaccaacagctactcgtcagctagagagagtgcaacgggccgggcagagctagagagagagagagagaaagcggccttctttttctgtgttcaccaagcaacaaccccagtccaagctctccgtgttggccgatcgtttccggcgaacagagcaagcaactcacagccccggaggcgactgactgactggcgcaactgtgttgctcgatccatcgaagcagacgcaggcggcggattcgcggaggagagatgatgagggagcagagcctcctggaggcgacgtgcggcgacctcttcgaccacatcgacgacctgctcgacttccccaaggaggactcggccgccgacgtgctcctgctggacgcgccnggcgccggggagcccgctgtcgtcggcgcgcatcatcgacgtcggccgcgccggcagtgcgcccgctccccccgcgctggcgccgtcgcttcccgcgcagcaagacaccaccgccttcttcgccacccgcggggcccgacgtgttcgaccccagggacg

SEQ ID NO: 90444 - protein, 93 aa, Zea mays
  misc_feature: Ceres CLONE 1578407
MMREQSLLEATCGDLFDHIDDLLDFPKEDSAADVLLLDAPGAGEPAVVGAHHRRRPRRQCARSPRAGAVASRAARHHRLLRHPRGPTCSTPGT

SEQ ID NO: 90445 - DNA, 876 bp, Zea mays
  misc_feature: Ceres CLONE 1578410
  misc_feature: Encodes the peptide sequence at SEQ ID NO. 90446
ggagctccccgcggtggcggccgctctagaactagtggatcccccgggctgcaggaattcgtctcacccctagaaaaagccgcactcgctccagcggccagccggccacaggcaactatggccgcctctgccgccgccgcggggcctgctacctttctcccgcgcctcccctcgccacggtctccgtctcctatgctccctcctctcggacggagagcccatcccgtcgccgctccgctctgtctctccgccaagcgccgcgcctgcgccgccatgggctccagctcctcctccaactcaggaaatcaaacgtcactgatgctgccgttcagctttacattcgatgaagattcttctagttccagaaggctatatagatggaaaagggtattgctcaaagtaagtggggaagctcttgccgggaatcacacagaaaacatcgacccaaagattacaatggctattgcaagagaagttgcttctgtcaccaaactaggtgtagaagttgctattgttgttggccgtggcaatatctttcgtgggggcctctggggctggatgtattgggcttgaacgctcatcggcgaataactcggaatgctggccactgggagaaaagccaaatttctccaacccaccatgggaaacattcgaaatcccaacccgggtccaaacggcctcccgttttgtcaaaatttccaaaaccttcatatccccaaaaaagggttcaaaatttttgaaaaaaggaaaaagttgtgaatatttgtccgcggaaaaaaggaaaaccttttttcccaaaaaatgaaaaagcgggggcgccccccttgggggcccaaatattatgggagagggggggtgtaaaaaacaaaaatgtgg

SEQ ID NO: 90446 - protein, 151 aa, Zea mays
  misc_feature: Ceres CLONE 1578410
MAASAAAAGPATFLPRLPSPRSPSPMLPPLGRRAHPVAAPLCLSAKRRACAAMGSSSSSNSGNQTSLMLPFSFTFDEDSSSSRRLYRWKRVLLKVSGEALAGNHTENIDPKITMAIAREVASVTKLGVEVAIVVGRGNIFRGGLWGWMYWA

SEQ ID NO: 90447 - DNA, 851 bp, Zea mays
  misc_feature: Ceres CLONE 1578411
  misc_feature: Encodes the peptide sequence at SEQ ID NO. 90448
ggagctccccgcggtggcggccgctctagaactagtggatcccccgggctgcaggaattcgtctcacccctagaaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtacgtcgtggagtccaccggcgtcttcactgacaaggacaaggctgctgcacatctcaagggtgggtgcaaagaagtttgtatctctgccccaagcaaagacgcacccatgtttggtgttggtggcaatgaggaacagtccacctcggatggtaaacttggttccaatggctagctggaacaaaaaatggccttgctccccttggctagggtcattccagaacaacttcggcatttgttgagggggtttaaataaaaacttgttcaggccctttccctgcccaccccgaaaaaatgggtggaggggaccctcaacccaaaaggaactttgaaaaggtgggccaggggcctttccaaccttttaaaacaaatatttccctaagaaaaaacccgggggggtggcccaaaggga

SEQ ID NO: 90448 - protein, 152 aa, Zea mays
  misc_feature: Ceres CLONE 1578411
  misc_feature (4)..(145): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGCKEVCISAPSKDAPMFGVGGNEEQSTSDGKLGSNG

SEQ ID NO: 90449 - DNA, 780 bp, Zea mays
  misc_feature: Ceres CLONE 1578414
  misc_feature (709)..(709): n is a, c, t, g, unknown, or other
tccccgcggtggcggccgctctagaactagtggatcccccgggctgcaggaattcgtctcacccctagaaaaagctgttgctgtccccgctaatgagctcctccgtacgcttggccaaaaaagcacgctaaactccacgtaccacccacgtgccccggcgaccaccctctgaccctcgtccccgtcgttccccagatctcctctcgcatctcggcgtgccaccaccaccaccctcaccgcagcccactccactccaccgctacactgaaaccaaccaccacgccacggcaccacccaaacccatccctaaatcccgagccccaaaacccccgtacgcgcccgccgcgccgcaatggcacaccaccgccgcgccccgctcctccccatcctcctcctcctcctcctcctgctcgccaccaccacggaacccgcggcgcccggcgccgcatcgcgctcggagccgacgctgccagtgccgccggtccaagccgccgcggtgcccccctccgcggcgctggcgtcgacgcctccgccggtctcgccctcggccgcggcgctcgcggcattcctcgccaaggccgacccggcctcccgcctgcgcctccccagccccgccgcctcgccctgctcccgcccgggggtcacctgcacggccaccggccatatcatccgcctcgtcctcgagtcggcggggctcaacgggacgttnccgccgggcacgctctcgcgccctcgcgagctccgcgtgctcagcctcaagtccaacgcgctccacgggcc

SEQ ID NO: 90450 - DNA, 1119 bp, Zea mays
  misc_feature: Ceres CLONE 1578416
  misc_feature (1)..(1): n is a, c, t, g, unknown, or other
  misc_feature (2)..(2): n is a, c, t, g, unknown, or other
  misc_feature (17)..(17): n is a, c, t, g, unknown, or other
  misc_feature (18)..(18): n is a, c, t, g, unknown, or other
  misc_feature (37)..(37): n is a, c, t, g, unknown, or other
  misc_feature (42)..(42): n is a, c, t, g, unknown, or other
  misc_feature (54)..(54): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (64)..(64): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (96)..(96): n is a, c, t, g, unknown, or other
  misc_feature (783)..(783): n is a, c, t, g, unknown, or other
  misc_feature (785)..(785): n is a, c, t, g, unknown, or other
  misc_feature (815)..(815): n is a, c, t, g, unknown, or other
  misc_feature (864)..(864): n is a, c, t, g, unknown, or other
  misc_feature (998)..(998): n is a, c, t, g, unknown, or other
nnaaaatttaaggggannaatggtagtgataaatacnggtcntcgggcggggannannnntttntggaaaaannnnnnnnnnnntggactccccgnggtggggggcgctctagactagtggatcccccgggctgcaggaattcgtctcacccctagaaaaaggttgatggccggccacaattccaacccaagctctaacctacgacctccgccgattccgctcgcgtctgcctccgccctccgcccaaaacccaatccagggccaggccaggccaggccaaccaaaccctaggcactgcgccacgcctagcgcgcgtggtatccatgggctgaccgcgtcccggtggggagccccgatccggagctagggttccgtcctaagcgggccccccatggagtgggacagcgagtccgacggcgcccggagcttccaccccccgcattgaggaggggggggagggagaatcacgaaccgggcaagccatcgccggaaggttgccacctcccagctgtctattatagtataattacgaccaattacgcctattttgaagggcaacagactcggacacccaacaggggggctcagcagaggcctaaatacacccgagaccacacaccgtgactcgagcagaaggaagggtgccccaaaatcaaccccacatcacttataagagcccgccaacatgcatgtgggaaagggagggtgcgacacggtacgtcttaaccacttagtgcttgtctgaacagtgcacgtgcagtaactatatactagcgtactcnanatatttctcagccgacctcttttcttcgangtcgtctttcatcacgatcaggcaactgggccgtccttctcacccatcngtgtacttggagagactcgcgcatccccccacctctatattacatcatgaagcgaaaatcccgactctcgtcatctccggcattaagtgccagactcaccacaccgtcagacagttctcatgccctagctctcngtctgggatcccgcgggggcggcgcgggaggcggcatcaccaacaaccgaaacacgaactcgccccgtccattacccgtcctagttcagctcaaagctctagcctctaccaagcagaacca

SEQ ID NO: 90451 - DNA, 1197 bp, Zea mays
  misc_feature: Ceres CLONE 1578417
  misc_feature (780)..(780): n is a, c, t, g, unknown, or other
  misc_feature (801)..(801): n is a, c, t, g, unknown, or other
  misc_feature (805)..(805): n is a, c, t, g, unknown, or other
  misc_feature (823)..(823): n is a, c, t, g, unknown, or other
  misc_feature (880)..(880): n is a, c, t, g, unknown, or other
  misc_feature (940)..(940): n is a, c, t, g, unknown, or other
  misc_feature (1028)..(1028): n is a, c, t, g, unknown, or other
  misc_feature (1030)..(1030): n is a, c, t, g, unknown, or other
  misc_feature (1197)..(1197): n is a, c, t, g, unknown, or other
ttgtgccgggtggtgtgcttggtgaacgcccctcctaagagggagtcgagaccgactagccgtgtctatttgttttgtatgaaactggagctccccgcggtggcggccgctctagactagtggatcccccgggctgcatgtattcgtctcacccctagaaaaagctgttgctgtccccgttaatgagctcctccgtacgcttggccaaaaaagccgctaaactccacataccacccacgtgccccggcgaccaccctctgaccctcgtccccgtcgttccccaaatctcctctcgcatctctgcgtgccaccaccaccacactcaccgcagcccactccactccaccgctacactgaaaccaacctccgcacctcggcaccgaccaaacccatccctaaatcccgagcccctaaaccaccgtacacgcccgccgcagcctcatggcacccgctcgtgcgggctcggtcctccccatcctccgtcgtcctcctcgttcttggctggggctcctccacggaaaacccgcggcgccccggggccggaattctgtgcttcggaaagcccatctccgggcagttgaccgcccgtgcccccgaccgctaccgcgtgatagcacgctcgctgttgtgggtgaggcatgggatgacttatagaggcggcttctgggcgcggggggcgagggagagcacttgcaggggtcgcagccgaggcgggtgccctgggtgttagtgggataatttgtcggagtgggggggcgccggaggaagatgggtttgggngagaccggcgtccgcggaggnccgngttgagctgcgcgatggngcgtgttgtggcggggtcgcgggtttggtcggaccgcaacaggcgcctctgtgcgancggcgtagcagccccagctagtgcgccgcgcgtgagccgcttccgccgagtagcgccccntgtgggcaggggtgtccggaagcgcgtggagcgagtgtgcgggctcggtggcgctgcgaggggtgtgagacgtcgaaagatggccggngntggaggcctttgtgcggccggagagatagcgaaggtgggtgggggggtgtctagaagcagtgtggacgctgtttccgcgcctccgcctgggtgagagtgggtggagagtgggagggtatagggggctgagggccaacatgctggagggtgtgctgggacgtggggan

SEQ ID NO: 90452 - DNA, 839 bp, Zea mays
  misc_feature: Ceres CLONE 1578419
  misc_feature: Encodes the peptide sequence at SEQ ID NO. 90453
  misc_feature (839)..(839): n is a, c, t, g, unknown, or other
tggagctccccgcggtggcggccgctctagaactagtggatcccccgggctgcaggaattcgtctcacccctagaaaaactacgcgcacacgtcaaactgtcccacacgacctgtacctgccccgccgccccccggacgcaaccgcgtccgaccaccgccgccggaaccctacgcccccgcctcgccgcgccatggcggatccgccgcccgtggctgcctccgccttgccggcgcagcccgaccaggtcgccgcctccgtgtccaccccgcagaaccccaaccctaaccccctcctctccccccaaatccccccgtccccgaccgtctccgacctctccgcgcacatctcgtccccgcagcagctcgacccggtggctgcggcagctgccgcttcgggcggcgggggatccatggattaccccccgcgcccgccgcagctgcaggcgccttcgcccacgcaggcggggcccggcgccgccgggtttggccagatcccccgctcggggtcggcctcacgcctctccacggccagccagctccagcagtacgcggctaggatgtacggcgggcagatgagcttctcgggtgggggaggtctcgtgggccagcagcagcagctggcggggcgcgcccccgtgcttgggcaggcccagctggggatgctgcaaggccagggtaacgcgggatctgcggcacattttgggcttcagtcgcagatgatggcgcaagctaggcaaaagggcatggcacaaaggcacccaattgaataatgctaatacagctcaagcgctacaagggagccagcacatggggtgtcatgggtacctatgggggatgn

SEQ ID NO: 90453 - protein, 192 aa, Zea mays
  misc_feature: Ceres CLONE 1578419
MADPPPVAASALPAQPDQVAASVSTPQNPNPNPLLSPQIPPSPTVSDLSAHISSPQQLDPVAAAAAASGGGGSMDYPPRPPQLQAPSPTQAGPGAAGFGQIPRSGSASRLSTASQLQQYAARMYGGQMSFSGGGGLVGQQQQLAGRAPVLGQAQLGMLQGQGNAGSAAHFGLQSQMMAQARQKGMAQRHPIE

SEQ ID NO: 90454 - DNA, 835 bp, Zea mays
  misc_feature: Ceres CLONE 1578428
  misc_feature: Encodes the peptide sequence at SEQ ID NO. 90455
  misc_feature (623)..(623): n is a, c, t, g, unknown, or other
  misc_feature (624)..(624): n is a, c, t, g, unknown, or other
  misc_feature (707)..(707): n is a, c, t, g, unknown, or other
  misc_feature (710)..(710): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaaaggactgtaggaggagcgacgcatcgcaacgccaacactcacagttgactatcccaccaaggtaacggacacaagcttccctgcagctcgctctcgcattctatctccctcccagtcccagacccagtcccagctgttgcagcctccgaacatccaaagctcctgcactgcacccctgtcagtcaggcctctagctgcagccaaaaaccgctggccttgaacatctccccatccgcctcccgcggcctgccacgcgacatgattgagtcgcgggctgctgcggagctcagctgcccccgcacgccgctggcgacgccttctgcttgcccgcctctgcccgcccgccttccctgatccctcctcccctttgcttccgcacgaagatctgggcgtgtcttcttccgacaaagctgttcaggcaggggagagtgcctgtttcgagggggcgtggagcggagccggagccatggggaagaagggcaagtggttcggcgccgtcaagaaggtcttcagccctgaatccaaggagaagaaagaggagaggctaanngaggaagtcagcaggtagcaacccgacgccggtagatctgaccccgtctacctccttggaagtcaatctttcggtgccaccgnctncagctcctcccccagttcttcaccaggccgaaggaggttgggggtcccctgaagccgagcaggagcagagcaggcntgtcgcccgtgggaaggaggcccctggctgccgcccccagcggcaggcg

SEQ ID NO: 90455 - protein, 33 aa, Zea mays
  misc_feature: Ceres CLONE 1578428
  misc_feature (28)..(28): Xaa is any aa, unknown, or other
MGKKGKWFGAVKKVFSPESKEKKEERLXEEVSR

SEQ ID NO: 90456 - DNA, 799 bp, Zea mays
  misc_feature: Ceres CLONE 1578431
  misc_feature: Encodes the peptide sequence at SEQ ID NO. 90457
  misc_feature (690)..(690): n is a, c, t, g, unknown, or other
  misc_feature (736)..(736): n is a, c, t, g, unknown, or other
  misc_feature (786)..(786): n is a, c, t, g, unknown, or other
ctccccgcggtggcggccgctctagaactagtggatcccccgggctgcaggaattcgtctcacccctagaaaaacttgcgccgcctgtccccgcgccctcgaaacctttttctcccaaaacagatttcgtcccggcgctctcctgcaaagggcggctagctgtcgccggtggatacgtttcacctctgtctcactgcttgggggggttctgcttcttcctgctttcccaagagagggccagcagcagacgaagcgagcaaagcgcgcaggaaccgctcggtctggtgattttaaggggcgaggtcgtgttcttgggaggcggagagacacgagctctctctcttcctgtcctctttcccgcggcttctctcttgtcttgctccaagagggcaaaactcgtcggggtagggaaatggcggaggtgaagccggaggagataagccatccgcccatggagcagctccaggggttcgagtactgcatcgactccaaccctccctggggcgaggcgatcatactgggcttccagcactacatactggcgctgggcacggcggtgatgatccccacggtgttggttcccatgatgggcggcgacgatggggacagggtcagggtggtgcagacgctgctgttcgtgacggggataacacgctgctgcagtccctcttcgggaacccgctgccgacngtcatcggcggttcctacgcgttcgtcatcccgataatggcatcantcaggacccgtcgctttctgggatacccgacggtcatgagaagttcctcngagacatgaaggg

SEQ ID NO: 90457 - protein, 104 aa, Zea mays
  misc_feature: Ceres CLONE 1578431
  misc_feature (93)..(93): Xaa is any aa, unknown, or other
MAEVKPEEISHPPMEQLQGFEYCIDSNPPWGEAIILGFQHYILALGTAVMIPTVLVPMMGGDDGDRVRVVQTLLFVTGITRCCSPSSGTRCRXSSAVPTRSSSR

SEQ ID NO: 90458 - DNA, 843 bp, Zea mays
  misc_feature: Ceres CLONE 1578432
  misc_feature: Encodes the peptide sequence at SEQ ID NO. 90459
ctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccaagctgggcagcctcagccgcgacgagctgtggcgcaaggtgtggggggaggccacctacgacctcgccaccgtgctcgccttcctcgccgtcctcgccttcaccatctccgtctacatcatgtcccagggcccagggcccgtgtacctcatcgacttcccatgcctacaaggcgggcccaagaagctccaaggggtcaaaggggggagtttcatccaaccggggcgcgcaaagtccgggcaaagtttcaacaaggaacagcccggggccgttccaagtcgccgttttggggggcccaaggtccgggggtattgggggaaacaaggtccgtaacaatggccgccccctgtggcggggtttccaaaacccccaaccggccccgggtttgggccccccccccattggaaagggaaggggcgcccccctcccccaagaa

SEQ ID NO: 90459 - protein, 186 aa, Zea mays
  misc_feature: Ceres CLONE 1578432
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAKLGSLSRDELWRKVWGEATYDLATVLAFLAVLAFTISVYIMSQGPGPVYLIDFPCLQGGPKKLQGVKGGSFIQPGRAKSGQSFNKEQPGAVPSRRFGGPKVRGYWGKQGP

SEQ ID NO: 90460 - DNA, 816 bp, Zea mays
  misc_feature: Ceres CLONE 1578433
  misc_feature: Encodes the peptide sequence at SEQ ID NO. 90461
ctggagctccccgcggtggcggccgctctagaactagtggatcccccgggctgcaggaattcgtctcacccctagaaaaaggcctttccatctgccgttcgcccagcgtgttctccctctagtgcggcaactgggcgaccgccgccgccgcttactccgggtgcccaggcattcgtccgtaccttctcaggccttcatcgcgtccttcgccggcgacgatcaccgacaaggatggaaagaacaattaattccttgatgtacaaaggatctattcctgatgcaattaatcaatcaagaagggagaagaagctctttgtagtctacatatcaggtgaagatgaggcttccagtagtttggaacagtcatcactgattgatgaaaacgtggttgaagtgatcggtagatgttgcatcttattgcatctcaagcaaggcaatgttgatgcatcacagttttcagctatctatccccagaagtctgtaccaagtatatcagtgattggactgaatgggagtctgctgtggaatcatgatggatatatcaactctgaaaatctgaaagaagcattgagaaagcgtgggctgctcttcatctacaagagacagcagcgaccttgttgacagcatcacttgctaccagaaattctgaacctgtgaattctgccactacggtttttgccagctcaagggggcccttctacctttagaaaaccttcctgattatccaggccatcccccaaatgttccggggccaatgaaaattgcccattcaaccgaaccggaatcccaaagtcccaaaaaaccccggcccttttt

SEQ ID NO: 90461 - protein, 129 aa, Zea mays
  misc_feature: Ceres CLONE 1578433
MERTINSLMYKGSIPDAINQSRREKKLFVVYISGEDEASSSLEQSSLIDENVVEVIGRCCILLHLKQGNVDASQFSAIYPQKSVPSISVIGLNGSLLWNHDGYINSENLKEALRKRGLLFIYKRQQRPC

SEQ ID NO: 90462 - DNA, 802 bp, Zea mays
  misc_feature: Ceres CLONE 1578435
  misc_feature: Encodes the peptide sequence at SEQ ID NO. 90463
  misc_feature (288)..(288): n is a, c, t, g, unknown, or other
  misc_feature (297)..(297): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (306)..(306): n is a, c, t, g, unknown, or other
tggagctccccgcggtggcggccgctctagaactagtggatcccccgggctgcaggaattcgtctcacccctagaaaaaactcacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaagggnggcgggggntggnnnacngggaggagtgggtggtcctgaagctgatgggggacgcggagactcttctggtgcgcaacgaggggctggtggacatcatccgggacgtgctgttcgtgtgcttcacccaccagtgcagactcctcgtgccactaggaggactcgcaaggtgagccgggatacggtccgtcaccggtggcgacgcggtgtaccggggagacgaccatcagcttgccccgtctaggactaccgcacctcggaccgcatggtggtgggcgcacaccgggcggtccggccaggaccccggttccaggatcctgaaaggcggccgtgggggcatgggacacaccaagacccggcatggacggaagcgttgaaccatgaaaggacgtggcggttccaatgttcgccggcctgtcccggcgactggcttcatcccacgaccaccgacttgcgggcccagcttcctttcaacgaaggccggccgactctcccgccgggggaagcaggagcaagg

SEQ ID NO: 90463 - protein, 41 aa, Zea mays
  misc_feature: Ceres CLONE 1578435
MGDAETLLVRNEGLVDIIRDVLFVCFTHQCRLLVPLGGLAR

SEQ ID NO: 90464 - DNA, 841 bp, Zea mays
  misc_feature: Ceres CLONE 1578438
ctccccgcggtggcggccgctctagaactagtggatcccccgggctgcaggaattcgtctcacccctagaaaaaaccccgcaagtcgaggccttccgctggctctcgctcgctcgctcgccccgcgactggttgcctctccgccccgaccctgccctgagaccggagacgaccgcgccccgcggtggcgctgcgacccgcgatacggaaattccccgtttaattgcatattggacatgtcttgtggcgtttgattggagaatttaattcttcccaacgatttccgttcttcggaggcttccatcttggtttcagttctgcaggttgtgtgtttgtgatctgtgactgagaggggaggaattccagtcagtcgtttatgaatcctggggcctgtgcttactagagggagggcaaggcaagttaggatccgagatgagggggagaaatgactccgggaacagcaagccggttgtgctgtgctgtgtgatgatcgtgtgcctatgcctcctcttcttgtatttctcgggctccaatggacaggctgggagcaccgcatttgagtacggggacaaattctcacggtcacttggatggggcagtgatgatggttctgaagagtccattttgggaccggggatgcagatgatgtcaagcctaagagctttcttgggtgtgatgaccggcactctgaactgatcccctgctgggatcggaacctgatatatcaaatgaggctgaagctggattaaaccctgatggagcacttggagaggcatggccctccacctgaaagggggttttaattgctggattccccccccacatgggtattaaggccctac

SEQ ID NO: 90465 - DNA, 772 bp, Zea mays
  misc_feature: Ceres CLONE 1578439
  misc_feature: Translation starting site: 155
  misc_feature: SWISSPROT Homolog: EC 3.4.22.16 Cathepsin H
ctccccgcggtggcggccgctctagaactagtggatcccccgggctgcaggaattcgtctcacccctagaaaaagtgccagcgcccagcaggccattctgctcgccttactccctcacagaacccagtaaaatattgccagtcccgccgtcgggatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaaaactggaaggacgatggggattgtgagcccagtgaataacagggccactgtggatcatgctgggacttcagcactactggtgcacttgatgctgcatatacccaggcaactggcaagcccatctctctctctgagcacagcttgtttgacgggggttttgcattcaacatttcggatg

SEQ ID NO: 90466 - DNA, 1122 bp, Zea mays
  misc_feature: Ceres CLONE 1578442
  misc_feature: Encodes the peptide sequence at SEQ ID NO. 90467
  misc_feature (29)..(29): n is a, c, t, g, unknown, or other
  misc_feature (32)..(32): n is a, c, t, g, unknown, or other
gttttggtttggggggggtgggggtgggnctntctttcttttattggtagttgtggttgggttttaaatatgtgttgtaagctggtactccccgcggtggcggccgctctagaatagtggatcccccgggctgcaggaattcgtctcacccctagaaaaaggccagcgcccatcaagccattgtggtcgccttactacctgagagaagccaggataatatagcccgtcccaccggcaggatggccccacgccgcctgctcgtgctcgccgtcctcgccctcgcgggcaccgccgccgcggacgactccggcttcccggactcctacccgatccgccctgtcaccgaccgctcggtctccgcgctcgagtccacagtcttcgccgcgctcgggcgcacccgcaaaacgcttcggttcggacgcttccccggtcgggtacagccaagagcttcgaagatcgcggcgggaaggcccttaaaccggttcagggatccttcctcccaaaaggccttccaaccttggtcccgggtgccacccaaccaggaaaagggcctcctcccttacccggccctccggggagtcaaaacgggcctttccgccgggaaccaatgggaaccttgggggaagcgaaattgtcccccgttcgcgagaaccacacgtgggtttccgggcttgctcaacccaccccataaaatatttgggggttgccctggccccccccaagggggtttattccccgcggggcttatattctctcccccgaggaattatttctgtgatgatacctttatccagaagcaagaattggcccccccccttcccccccgcgaaggatacccaagagagaaaaacctggtggaagggagggaagggaaatttgggtgatatttttgtgtgcaagcccccctcgggtggtaaaaaaaaaccccgggggggcccaaacatgggggggttttcctatggggcttgtggaagcccttctatgagtaatctacccaggggggagacaccatttaaagagcgccgcgaatttttgcaccccaagaataaaacttgtgagaaatgccccctttactctctctctttattagaagagaaaacacccctgtgggggaaagagggg

SEQ ID NO: 90467 - protein, 214 aa, Zea mays
  misc_feature: Ceres CLONE 1578442
  misc_feature: SWISSPROT Homolog: EC 3.4.22.16 Cathepsin H
MAPRRLLVLAVLALAGTAAADDSGFPDSYPIRPVTDRSVSALESTVFAALGRTRKTLRFGRFPGRVQPRASKIAAGRPLNRFRDPSSQKAFQPWSRVPPNQEKGLLPYPALRGVKTGLSAGNQWEPWGKRNCPPFARTTRGFPGLLNPPHKIFGGCPGPPQGGLFPAGLIFSPPRNYFCDDTFIQKQELAPPLPPREGYPREKNLVEGREGKFG

SEQ ID NO: 90468 - DNA, 944 bp, Zea mays
  misc_feature: Ceres CLONE 1578443
  misc_feature: Encodes the peptide sequence at SEQ ID NO. 90469
  misc_feature (15)..(15): n is a, c, t, g, unknown, or other
  misc_feature (57)..(57): n is a, c, t, g, unknown, or other
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ggggggggttccctnttcccctccctccattcctaaatctatattaatatatcccanannttatatnnnnnaaaagatggaactccccgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaaagattgttgtccatcacaagggtgaggagaagcagtttgcagctgaagagatctcctctatggttcttatcaagatgcgtgagattgctgaagcttaccttggtagcacgatcaaaaatgctggggtcacagtccctgccctacttcaatgactcacaaaaggccaggccacaaaggatggcgggggtggattgctgggccttaaatgggctggcgtatccttcaaccaagccaaacaggctgcaacctattcccctaatgggtccttgaacaaaaaggcgtaccccggtggccgggtgaagaaaaaaaaggccccccctctcctttgaaactttggggagaggggggaaccctttgtgaagggtgttccccgggggtgggcggggggga

SEQ ID NO: 90469 - protein, 155 aa, Zea mays
  misc_feature: Ceres CLONE 1578443
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPKIVVHHKGEEKQFAAEEISSMVLIKMREIAEAYLGSTIKNAGVTVPALLQ

SEQ ID NO: 90470 - DNA, 811 bp, Zea mays
  misc_feature: Ceres CLONE 1578447
  misc_feature: Encodes the peptide sequence at SEQ ID NO. 90471
  misc_feature (313)..(313): n is a, c, t, g, unknown, or other
  misc_feature (471)..(471): n is a, c, t, g, unknown, or other
tggagctccccgcggtggcggccgctctagaactagtggatcccccgggctgcaggaattcgtctcacccctagaaaaaccgatgatgacgatgacactgacagctgctcaactcctctaccaccacccctgccacccggtatagattgggaggacttggatccttacaacgttcgccccttgagtttcccatctccatttgctgacaggaacgatgaagaggtggcctcgcaggttgccatggacaatggtcctgaggtacacacagaatttgatggagaggaggatgaaagtgtgcttggcattgtggatnaggtccatgtgaatccagccaagagtagggctctgggtgatggcaactctttcactgtgagccagtaaacaaggattcagactctgtggcagtgccttggaagagtatgaagtcatttgtagagattgtttagggagattgacaagtacttcttgaangcagccaccagtggtaaatgaccttgtgaattccttttggacccccgctgggggggcggcctgattccctttaaaattgggaggcaaacaaaggggcccgggaaaaaaatccccaattcggcgaaaggggtttttcccacccctttttttggggaacggggggttttttaaaaattccccgcagggtttaaaaggggaaaacccccacggtttcgaaaaatcccaaggggcctttcgggggaaatgggggtccccccgggggggaaagacaccttgtgaggaaacccttttttttaagaaaagggggaaaaaaaaaacccccccccaaggtgttttttcc

SEQ ID NO: 90471 - protein, 46 aa, Zea mays
  misc_feature: Ceres CLONE 1578447
  misc_feature (25)..(25): Xaa is any aa, unknown, or other
MDNGPEVHTEFDGEEDESVLGIVDXVHVNPAKSRALGDGNSFTVSQ

SEQ ID NO: 90472 - DNA, 815 bp, Zea mays
  misc_feature: Ceres CLONE 1578454
  misc_feature: Encodes the peptide sequence at SEQ ID NO. 90473
ctccccgcggtggcggccgctctagaactagtggatcccccgggctgcaggaattcgtctcacccctagaaaaaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctcctccatcgccaccaccgccgtcgcccaccagcacgccgtgccctccgccaccgtccagctccggcggcaagtgccccaagaacgcgctgaaactgggcgtgtgcgccaacgtgctgggcctcgtcaaggtgtccatcggcaaggtgcccaccgactcgtgctgcccgctgctggacggcctcgccgacctggaggccgccgtctgcctctgcaccgcgctcaaggccaacgtgctcggcatcaacctcgacgtcccccgtcaagctcaccctgctcctccactactgcggcaagagcgtccctcagggctttctgtgcggctaatatataactagtggctaggttcgtcactagccttcagttggccatgcaatatttggggaattcctccttctttcccttctaagttcacccactgtatggtaccgtgccccccctcccaatcccggaaaggttttccttttgggaaattggcctttcccctttcaaaccccttccccccaaaactttgctttggaaaaattccccactcttgcct

SEQ ID NO: 90473 - protein, 149 aa, Zea mays
  misc_feature: Ceres CLONE 1578454
  misc_feature (63)..(140): Pfam Name: Tryp_alpha_amyl Pfam Description: Protease inhibitor/seed storage/LTP family
MASVTRFPAVALVLLLAASAFLASEVAACGGCPKPTPPPPSPPPPSPTSTPCPPPPSSSGGKCPKNALKLGVCANVLGLVKVSIGKVPTDSCCPLLDGLADLEAAVCLCTALKANVLGINLDVPRQAHPAPPLLRQERPSGLSVRLIYN

SEQ ID NO: 90474 - DNA, 1135 bp, Zea mays
  misc_feature: Ceres CLONE 1578456
  misc_feature: Encodes the peptide sequence at SEQ ID NO. 90475
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (790)..(790): n is a, c, t, g, unknown, or other
  misc_feature (793)..(793): n is a, c, t, g, unknown, or other
  misc_feature (836)..(836): n is a, c, t, g, unknown, or other
  misc_feature (1062)..(1062): n is a, c, t, g, unknown, or other
nnnnaaacccaaaaaaacgagaaaacaagagacaaagcgtggcgtgtagaaagatagaactggggccggtgcgaaaggtggagtccccgcggtggcggccgctctatactagtggatcccccgggctgcaggaattcgtctcacccctagaaaaaatgcggcactcgcacgatcaatgtacacattgcccgtccatgccaccacatccagcatcatcccaagcctcggaacccccgcgccgtcctcctcctccggttccagccgccccaggctcaggctcatccggaaggccccagtattcgccgcccccgccaccgtcgtgtaaacgggagggcgggcggctgacgagtcaaacgagagagatcgagagagaaagaaagggagggcatcctccaggcggcggcgataagaggggaggagagtgaggccctgagaacaggacgaggagaagaagaagatggagcaactgccgtctggccttccgaaaaaaaagaggagggtgtcagccaaacgaaaaacccgtgcctcggaatacccccccaaccctccggtcaactccgtttcagaaaaccgaggaaaggcccccttccgcaaaaccctttcgcaggccttcccttcccaacctacgaagaaggagactttacccttacccccatagggagagcccttgtgagaaaacacccccccaaaaccacaattcctcgaaaaagagggggctcctctttttgcaaaaaacagaaaggcgccgtgaggagttttctcccccccaagacgaaaaaagtgtttttgncanacaagagaaccacccgaataagagttatctcttatttggttanccgtataggggaaaaggcacccacggagaaaccctggaatatgtcgaaaaggccccctcttctctcataaaggagtccaacgggccaccaaagaggaggccgcccacaaggtgcaaacaattggagggtggatgtgcgccccctaaggcgcctacccgtaacataacaccgcgcagtgggaggggccaacagccataggtatggaacccactgagagggacctaantatagccacaaagggaaagaaccttttgtctcgagtaccgcgtaaaaataccccccgtccatgggttgccgcc

SEQ ID NO: 90475 - protein, 49 aa, Zea mays
  misc_feature: Ceres CLONE 1578456
MYTLPVHATTSSIIPSLGTPAPSSSSGSSRPRLRLIRKAPVFAAPATVV

SEQ ID NO: 90476 - DNA, 884 bp, Zea mays
  misc_feature: Ceres CLONE 1578457
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
tccccgcggtggcggccgctctagaactagtggatcccccgggctgcaggaattcgtctcacccctagaaaaatacggcagcgacgcctcccccgctcgcctcctctctcctcctcaaggctcaagcgaaggcgagcgcgatagaaagctcaagccacttcccaacccgctccccccctcgccgcgatttcctcacatggcagcgctgcgcctccgcgagtcactcgagaggaacagcccctgctcctgcttctccgacccctgtccctgcgccgccaacacgcgccgcccccgtcccgatctcgccgcccccgccgccgggcccttctcgtccctccgcgtccatcgcccctgctcctgatccggctctcttcttcctcccttctcgcgccgtagattgcagccgcggctctgattctgctcccgccgtttgtctcgcggtcgcgggttcctgggagcttctgggttctggctccgtccctaaccggtgttgccatgggggaagagtgagtttctcctggcgccgattgatggggggggtcttggcttcccgtttgaagggtgggggaagtggttgggtcatgaattcctgaatttggggggctttggttttgttgcagggcaaaaaaaagcaggggccccgcggggggcggggaaccaacctggaccgaccatcagcgaaccccggaccggcggtcgggtcgtactcccaaccggggctggcgcggacttttcccaacctgataacgcccaccgaagagcgttcagacctgccaggggagttcccgcccgtgaacaaagtaacttggagaccgcgttttatggggaaggagggggggatgcttccaagggaaagagccgcgctgggggatgagaggannnnn

SEQ ID NO: 90477 - DNA, 828 bp, Zea mays
  misc_feature: Ceres CLONE 1578458
  misc_feature: Encodes the peptide sequence at SEQ ID NO. 90478
  misc_feature (472)..(472): n is a, c, t, g, unknown, or other
  misc_feature (490)..(490): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (508)..(508): n is a, c, t, g, unknown, or other
  misc_feature (509)..(509): n is a, c, t, g, unknown, or other
  misc_feature (517)..(517): n is a, c, t, g, unknown, or other
  misc_feature (808)..(808): n is a, c, t, g, unknown, or other
  misc_feature (809)..(809): n is a, c, t, g, unknown, or other
ctccccgcggtggcggccgctctagaactagtggatcccccgggctgcaggaattcgtctcacccctagaaaaaaatcgagctcctctccttctccgaagcactgaagctccagcggctgccctgcctgacagccacttcgcacgaccaaattaaagtgactttctccttctccccttgttcgatcctattccttccacttccactctctctttgcttccccgccctctccgccgcgcttttgctgatccgtgtgctgtgtgtgtgtgtgtgcgcgcgcgcgcgcttcaacttgaagaagcgcgggcgatcgagatggcgcacgaccccagcctgggcttcgcggactacttctcggcggcggcggcggctgcggcggcgggcgccacggcgatggacgacgacgtcggggcgccggagctctatggcctgcatgccgacgacatggagttcctcggcatgcgtgggctggncgccatgccccctgccgngggacnnncacaccacanncacattangggcacagcaagggcgggtgcgctcttcgacgacgacgacgcgggggtgggggcagacgtcagcggctccggcgaacgacccccccatgggcctttctgagcgagcagcagcagccgcagcaacccccgggcgccgcttgtcctttgtcccttgggcccggcccgaacctttacaaccaacctttcacaaaaaagaacccacctttgccggggggggggggtcccttcttcccgggggccccttctgggagaccacccccccgggggggccggggggtgggaaaaaaattnncagggccggaatcttcctt

SEQ ID NO: 90478 - protein, 100 aa, Zea mays
  misc_feature: Ceres CLONE 1578458
  misc_feature (53)..(53): Xaa is any aa, unknown, or other
  misc_feature (59)..(59): Xaa is any aa, unknown, or other
  misc_feature (61)..(61): Xaa is any aa, unknown, or other
  misc_feature (62)..(62): Xaa is any aa, unknown, or other
  misc_feature (65)..(65): Xaa is any aa, unknown, or other
  misc_feature (68)..(68): Xaa is any aa, unknown, or other
MAHDPSLGFADYFSAAAAAAAAGATAMDDDVGAPELYGLHADDMEFLGMRGLXAMPPAXGXXHHXHIXGTARAGALFDDDDAGVGADVSGSGERPPHGPF

SEQ ID NO: 90479 - DNA, 1218 bp, Zea mays
  misc_feature: Ceres CLONE 1578462
  misc_feature: Encodes the peptide sequence at SEQ ID NO. 90480
  misc_feature (19)..(19): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (795)..(795): n is a, c, t, g, unknown, or other
  misc_feature (837)..(837): n is a, c, t, g, unknown, or other
  misc_feature (934)..(934): n is a, c, t, g, unknown, or other
  misc_feature (1218)..(1218): n is a, c, t, g, unknown, or other
ggtgttttgtgtttttttngggtgtgtgcggggggggggggggcgagcctcacgcccctttnnntggtgnnnnaaaaactggagctcaccgcggtggcggccgctctagaactagtggatcccccgggctgcaggaattcgtctcacccctagaaaaagtgccagcttgagcattccactttgctagccagcatatacttacacgtagctagcttaataatcagcagctggtgcagcaagagtaacagctagcgacgacgaccatatggcggcgaagcagccagtcgtcgctgctgctgcctccggccaccccaagatgggggaggagaagctgatcatcccgccggaaaaggtgcggttcatagacgtgctgtcgatgctgctcctgaggcgccccttcaccagctacgcattcgtgggaggccggcgaccagaaccgcccccgacctggggcagcacgccccggtaactggcttcggtcgcgcttcaggcgaggcccatccagaaaaggacgcttcagcggggggcctaatttacccggggttcttgtttggggttgggcgccccgtgcgtccgaaggtgtcggtccttctaaatttgtgggtgggcggggcctaaaggagaggggggccttaacctccgagggaatgttttttttgattaaagcccgccctttgtcaagaaatgtggtaaaaaggccttggggttggtttatccccccacacgcttgaatagacctcggtgggaaagggggacgacgacacccaatgaaatcctatttgcttgcggggggangtccgctctttttttattattatatacactgtgggattacanttaatattcctgcaacccatagaggcggagagaggcgcacaaccccgcgtagagcgtcctggggaataaaaacccccgcctacttctgtcgctcccncatcacgcccatgcccgaggagagtcaagatccacccaaaataaaaggaaaaccaccttagaagcaggagctcgtagtcacaagtgtgaggtggtgataggggtggttgtaatttagcatgagagaaacccaactgttgagatagggataatatatctgggcggggcggagaaaataatgctcaaatatactactatctagtcggagagagaagtgtgttgaacaaagagtgtgtatataactgaagggagacaggtggcccacgcggaggatgtggacccagn

SEQ ID NO: 90480 - protein, 67 aa, Zea mays
  misc_feature: Ceres CLONE 1578462
MAAKQPVVAAAASGHPKMGEEKLIIPPEKVRFIDVLSMLLLRRPFTSYAFVGGRRPEPPPTWGSTPR

SEQ ID NO: 90481 - DNA, 804 bp, Zea mays
  misc_feature: Ceres CLONE 1578464
  misc_feature: Encodes the peptide sequence at SEQ ID NO. 90482
tggagctccccgcggtggcggccgctctagaactagtggatcccccgggctgcaggaattcgtctcacccctagaaaaaactactcaagccgctcaaaactctagctagctagcagggggggaaatggctccacttctcgccgcagccatgaaccacgctgcccatccagtccttagaagccatctaggacccaacaatgagagtttctcacgacaccacctatcttcttcaccgcaaagcagtaagcgaaggtttaaccttagctttacgccacgatctgcaagagtaggcaatcaaaatggagtccaattgttgagcccctcggaaatccctcgaagggactggttcccctctgacttcatctttggtgccgccacttcagcgtaccaaattgaaggtgcatggaacgaagatggaaagggggaaagcaattgggatcacttctgccacaattttccggaaaggataatggacgggagcaatgcagacattggagcgaattcgtaccatatgtacaaaacggatgtcagattgctgaaggaaatgggcatggacgcatataggttctctatctcttggcctagaatactgcctaagggaacggtcgaaggaggtattaaccaggatggcatcgattactacaaaaggctcatcaacttgttgctagagaatggcatagagccatatgtaacaattttccactgggatgtccctcaagcactagaagagaagtacggcggattcttagataagactcataagaagattgtaaatgattacaaaacttcgctaaggtgtgcttc

SEQ ID NO: 90482 - protein, 218 aa, Zea mays
  misc_feature: Ceres CLONE 1578464
  misc_feature (63)..(216): Pfam Name: Glyco_hydro_1 Pfam Description: Glycosyl hydrolase family 1
  misc_feature: SWISSPROT Homolog: EC 3.2.1.21 Beta-glucosidase
MNHAAHPVLRSHLGPNNESFSRHHLSSSPQSSKRRFNLSFTPRSARVGNQNGVQLLSPSEIPRRDWFPSDFIFGAATSAYQIEGAWNEDGKGESNWDHFCHNFPERIMDGSNADIGANSYHMYKTDVRLLKEMGMDAYRFSISWPRILPKGTVEGGINQDGIDYYKRLINLLLENGIEPYVTIFHWDVPQALEEKYGGFLDKTHKKIVNDYKTSLRCA

SEQ ID NO: 90483 - DNA, 921 bp, Zea mays
  misc_feature: Ceres CLONE 1578466
  misc_feature: Encodes the peptide sequence at SEQ ID NO. 90484
  misc_feature (878)..(878): n is a, c, t, g, unknown, or other
  misc_feature (884)..(884): n is a, c, t, g, unknown, or other
gcggtggcggccgctctagaactagtggatcccccgggctgcaggaattcgtctcacccctagaatggagaagtgcaggtcggtgccgcacgagcactcgtcggcgtactacggctgcggaggcaggttccactaccaggacctccgtcgcgggcccggggatgtcggccattcgtacagcttcaatgggcctagcggccgggacgacccggaggctaatcggccgcgccgcgtggctgcgtacaacgttttccccacgcttgggcggagcaagacctccgtccgcagcagcgtcaagtgggtcaaatccaagttctccgacctccgctgcagaggcctctgaactaatctgatgagcctactgcatgcgagccaatactacttctacaacccccacaaataattgtgtttgcacgaaacatgagtgctaattctctaattatattatgcacggttcccggtatttcgcgtgccaaaaatcaaaaagcttggctgggtatttatttccccgcgcaaagttaaaactgactattgaagggtggggggggggcctgtttcagaggtttgaaaccggggtgttgttaggggcctcaaagccaatccgcaatttgccggggtggcctttcccaaaatcggaaaaaggggggttttccccgggttggattttggaaaacgaaaacaccttagtttgttggaccctaacctccacctcaacctttgagacacccagataacggagggggcttccgaaacgcctgtgcgttttccggggagaaaaaaccccccttttgaaattgtgggggggaaaacacccccgtgaaaagaaaccttgttttgtgctctgggggaaaagaataaaacttttttttttcggaagncccaanagaaaaacattttttttttttagagaaaaaagaggat

SEQ ID NO: 90484 - protein, 92 aa, Zea mays
  misc_feature: Ceres CLONE 1578466
MEKCRSVPHEHSSAYYGCGGRFHYQDLRRGPGDVGHSYSFNGPSGRDDPEANRPRRVAAYNVFPTLGRSKTSVRSSVKWVKSKFSDLRCRGL

SEQ ID NO: 90485 - DNA, 1140 bp, Zea mays
  misc_feature: Ceres CLONE 1578467
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (938)..(938): n is a, c, t, g, unknown, or other
ggggtgggggtccccccttcctttcctagtgcgatgagatggttgtgtgggttgtgnnnnnaaccccggcagcagggggggggattccccccggtggcggccgctctagaactagtggatcccccgggctgcaggaattcgtctcacccctagaaaaaaaccaaagctagctactttgttgctgtttttattcggttgacacatagacagtaggtggtccgaccgccggcaacaatgagcggccgtgtgttcctcctggccgctgccttcagcgtgctgcttcgtcgcagccgccgtgtcctcgaggcccgtcctgactccgctgggtactagccgccctgctgccggccacctgaccgtgtacttccacgcggactcctgcccgcagctggacacgatcgtgcggatcaccgtggacacgacgctccaacagaacgtcctgtctgaagggcggggtcttcatcccccttttggttttcaaggaactggattccccacaaggggtggggaacggcgttccattccctcccttggaacaacccgcggaaacacccgggcctttcccccccccgccaaaaatggggggggcctttctggtcaaaaagaaaggccccccggtggcgcccccttttgttgtgggaagggggaacattttctccccccggggggataaaggggtgggtgacaactcgcgcgcgggcgctcatgggtgtgcgggggggacactccccccacaccccgagtttgggatagtatttgagtgggggggcgggcgccccccagataaaatatattctttccgggtgggcgatgatggagttattatttgtgggttcttacaaactacctcttatgtatgggaagatactccctcaccctttctgtgaaaagcaatcccttatgctccacctcactcaaggatgatggaggagggcccncataatatgcctcctgtgttttccacggtgggtgggatgcccccccacttaatgattgggcgcggccgcgcttctgtggtgagtatacagtgggggcggggaacgctcctcctggagaggaatttcctctttctcatatacgtcaagcgggtgttttgttataatgcatgcggagccgccccccacgccaaagaaaaggggg

SEQ ID NO: 90486 - DNA, 869 bp, Zea mays
  misc_feature: Ceres CLONE 1578471
  misc_feature: Encodes the peptide sequence at SEQ ID NO. 90487
ctccccgcggtggcggccgctctagaactagtggatcccccgggctgcaggaattcgtctcacccctagaaaaaatacaaatgcctgcgcattagcgatcctcctcgctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacaacgtccgcgctgatgcagcagaacgcgccgctggcctcgtccaagccgtccgtgccggagacggagaccatccctccggaagagacgctggacgacggcgacggcgcggataccggcgatctgcgtgggacggagcccgggttgccggaggctgccgtcatgaggaacgacatgggcgggggggtccgacaagcccaggcttggccacccaggaaggacggcgggcggaaatgcggaggcccaagcccaccaacaagccatctggaggatggcaaagggggggcaaccaaggagggctagaatgaacctgcggcaaaaaacaaccaaggaaaaaaacggttccccggtaaaccccggccggaccatggtgggaaacctgtcccgggtgaacttggcgcgcggggacccccaaatcctaaaaggacggggggtccccgggggaaaccctttccagggggccggcgtggtaggtggagttttctcaacaaaatgcttaa

SEQ ID NO: 90487 - protein, 95 aa, Zea mays
  misc_feature: Ceres CLONE 1578471
MQQNAPLASSKPSVPETETIPPEETLDDGDGADTGDLRGTEPGLPEAAVMRNDMGGGVRQAQAWPPRKDGGRKCGGPSPPTSHLEDGKGGATKEG

SEQ ID NO: 90488 - DNA, 824 bp, Zea mays
  misc_feature: Ceres CLONE 1578474
  misc_feature: Translation starting site: 385
  misc_feature (811)..(811): n is a, c, t, g, unknown, or other
ctccccgcggtggcggccgctctagaactagtggatcccccgggctgcaggaattcgtctcacccctagaaaaaatacaaatgcctgcgcattagcgatcctcctcgctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcgccagcacggccaacaacgtccgcgctgatgcagcagaacgcgcctctggcctcgtccaagccgtccgtgccggagacggagaccatccctccggaagagacgctggacgacggcgacggcgcggataccggcgatctgcgtgggacggagcccggcttagcggaagctgccgtcatgaggaacgacatggcagcggggtccgacgagcccggcttgcccacccaggaagacggcggcgggaatgcggaagcctaacccacaaacaagccatctgaggatggcaacggcggccaacaaggaggcaagatgacgtgcgaccagaacagcgtggacgagcggttccccgtacccccggccgaaagtgtgtgagctgtccggcgacgtgcgcgtgagccccaagcagagggaggggttactggtggaacccatccggcggcggcgggcggggggttcnaccagaacgtcaa

SEQ ID NO: 90489 - DNA, 788 bp, Zea mays
  misc_feature: Ceres CLONE 1578475
  misc_feature: Encodes the peptide sequence at SEQ ID NO. 90490
  misc_feature (596)..(596): n is a, c, t, g, unknown, or other
  misc_feature (670)..(670): n is a, c, t, g, unknown, or other
ctccccgcggtggcggccgctctagaactagtggatcccccgggctgcaggaattcgtctcacccctagaaaaagcggagctcaatggagttatccactcccgttgggagctcccttgctagaacagcgaccatggccctcgttagccccagcttcaagataaccaatcaaatgcgtgccaggggtatgccacttgaatgccaatttcctcataggctaccatctgtagcttgttcaatgttgttaaacacacaaccttcacaacgaaccaaccataaagattgtggtttgcttcaggtgcaatctacagaaaaccttatgcagtcgccagtatctttcagtgacttctctgtttcagtgtgtgctcaagaggatggtctgataaagctacaggtaaatgtatctggcacaatgacagattttatctttgagaaagttttcacaaagaatgttgccgccgctcaaccccttcccggctttcgacgaatgaaaggagggaaaactccagacataccgaaagaagttgctctacacttaatcgggccatcaaaagtgaagaaagaaacaatcaagaaaattataaatagcacggttgnctgagtatgttcaaaaggaaggcctgattgtatcgaagaatataaaatgtcagcagagctatgaagagcttgangcagcatttgaacccagggaaagaattttgctttaacgcaacagttcatttacagtaagctgatgatgcataagtggtgccactaggattgataaccagccctctcagcttatgccta

SEQ ID NO: 90490 - protein, 154 aa, Zea mays
  misc_feature: Ceres CLONE 1578475
MALVSPSFKITNQMRARGMPLECQFPHRLPSVACSMLLNTQPSQRTNHKDCGLLQVQSTENLMQSPVSFSDFSVSVCAQEDGLIKLQVNVSGTMTDFIFEKVFTKNVAAAQPLPGFRRMKGGKTPDIPKEVALHLIGPSKVKKETIKKIINSTV

SEQ ID NO: 90491 - DNA, 813 bp, Zea mays
  misc_feature: Ceres CLONE 1578480
  misc_feature: Encodes the peptide sequence at SEQ ID NO. 90492
ctcaccgcggtggcggccgctctagaactagtggatcccccgggctgcaggaattcgtctcacccctagaaaaagattggcgattccatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgcccccgtgtggagcgccacgtcgcgctccctggccttatccggacgctcaagatgtgcggcacctacggggccaccttcgccaccatcggggggcctctacatcgggcgtcgagcagctcggtgcagagccagcgcaagaagcgcgacttcgtcaacggggccggtcggcgcgttcgtttgccggaaccttctgtctgcggctacagaggaaagaatattcagtcagcccctcatccggagggctcctgtccgggttttcacaatctcctggtgctggaaaattggcggcaataccaaaccgaagttgaacaacggaaaaaaatactttggcctaccccaactgaagaagaacccctgcaaaattggattcccaagtcttggcaccttttaaaaaaaaaaatctttggcacggcccattaaatctcaggggaaatttgaaaacttgaatggggcacaatttttaagggtttgtggttgggccggaagccccaattaaattt

SEQ ID NO: 90492 - protein, 122 aa, Zea mays
  misc_feature: Ceres CLONE 1578480
MCGTYGATFATIGGPLHRASSSSVQSQRKKRDFVNGAGRRVRLPEPSVCGYRGKNIQSAPHPEGSCPGFHNLLVLENWRQYQTEVEQRKKILWPTPTEEEPLQNWIPKSWHLLKKKIFGTAH

SEQ ID NO: 90493 - DNA, 1177 bp, Zea mays
  misc_feature: Ceres CLONE 1578481
  misc_feature: Encodes the peptide sequence at SEQ ID NO. 90494
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (869)..(869): n is a, c, t, g, unknown, or other
  misc_feature (902)..(902): n is a, c, t, g, unknown, or other
  misc_feature (907)..(907): n is a, c, t, g, unknown, or other
  misc_feature (1116)..(1116): n is a, c, t, g, unknown, or other
  misc_feature (1141)..(1141): n is a, c, t, g, unknown, or other
tttttttttctttgtttttattttattattatgaggagtgaggggggtggggttttggaatgttgagtntnnnccaaactgggctcaccgcggtggcggccgctctagaactagtggatcccccgggctgcatgtattcgtctcacccctagaaaaaagcacccataggccgtagaccagatctgtagaccgccatggcgaaccgcagcaggcagctcgttaccaccgcactgccgctcgcggcggcagcagaagcctcgctcgccgtcgtgctcctgatctgctccacgggatcatcggaagccgactgatacctcgggcgcgtgggtgcgccgtggggccgtaccctcacggtcctcccattcagccccgcggacctgctgcccctcctgccgcggggcgtcaccatggccgcgctccgggcgctccgcggcgtcctcgaacatctccccggtgttctcggccccgaagtgggccggcccccccaagctaggttgcctcgcacccgggggggaccgtgcaaatggaaagggaggccctggtttcctaaccaaaaaccaaggcatgccaaggggtttcccccaaggaataccccgggggccaaagttaggggggggggggaacccccagcctcttttcgagagaaaaccccctagagcggccaaacaggttggggcactttgccatctaaaacctcagaccaaggtatacttttcagaaaaaccctccctttgataaggaagtgttctaccctggggggagatattccgaaaacccattttgttttgggggggaggaatatctaagcgacaatccgctcctggggggagtcctccccaacgagaaataatggggggaaaaaaagcccnacagaacgcagtagacctcagtgaaagctgttnggtangaaaccgaaggcctgaatgggggggggggggtagacacccttgtatctacgcactagtgtggaacacacccgagagaaaacaaagtgggggacgacaacaatttaatgagatgaaacctccttaggaagtacaaggcatctcctccccgctgcggaggcgcgaaaaattaataactttggtcagtggggggggggaatcagccacgccngagcggtatcgcccacggtgaagcnccggacgaaaaagacaataatagtgtgtgcgcaccc

SEQ ID NO: 90494 - protein, 38 aa, Zea mays
  misc_feature: Ceres CLONE 1578481
MANRSRQLVTTALPLAAAAEASLAVVLLICSTGSSEAD

SEQ ID NO: 90495 - DNA, 837 bp, Zea mays
  misc_feature: Ceres CLONE 1578483
  misc_feature: Encodes the peptide sequence at SEQ ID NO. 90496
ctccccgcggtggcggccgctctagaactagtggatcccccgggctgcaggaattcgtctcacccctagaaaaagattggcgattcaatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggagtcaaacagctcgaggagagccagcgcaagaagcgcgacttcctaaaagggggccatcgggacctttcgtttgggggaccctctggtctgcgggctccgaaggaaaaaaagttttcaaatccagcccctcatcgggaaggacctctggtcttgggttttacaaattcttgctgggcctggaaaatttgcgcgggcaaaaaacgaaaccagaaggttgaccaccggccaaaaaaaggtactttggccccaaaccgggccttgaacaaaaaaggccccggaaaagtggggttccaaaggtctcgccccctctcttaggaaaaaaagtgtgtggccacgccctattaaactccgagggaaattttaaaagccgaaaaggcccacacctttgagggaaagaaaatttgcccaaaaaagaaaaaa

SEQ ID NO: 90496 - protein, 173 aa, Zea mays
  misc_feature: Ceres CLONE 1578483
MEDDSPLTKTMKGAVTGLAAGTIWGTVVATWYDVPRVERHVALPGLIRTLKMCGTYGATFATIGGLYIGVKQLEESQRKKRDFLKGGHRDLSFGGPSGLRAPKEKKFSNPAPHREGPLVLGFTNSCWAWKICAGKKRNQKVDHRPKKGTLAPNRALNKKGPGKVGFQRSRPLS

SEQ ID NO: 90497 - DNA, 830 bp, Zea mays
  misc_feature: Ceres CLONE 1578484
  misc_feature: Encodes the peptide sequence at SEQ ID NO. 90498
ggagctccccgcggtggcggccgctctagaactagtggatcccccgggctgcaggaattcgtctcacccctagaaaaagaaaactcagtaatgctagttaacctctccagtatctccttctcggatattgaatcacacacggcaacgccgcaacgcgcagcggactcgggtcctcgcactcgcaatcaagcatgggggccgccgttgggaagccagctttcggtgtcgccgtcgcgccgaagacgcaggcggaggagcggctcgccctcgcggagcacgccctgctccagtggactcgctcacccggcgccgactcgggcatctgggacgccggggcgagctacaccaacagaggcctcctggcggcggtcgacgaggtgctcctcctggcggcggagaaccctttcccgctcccggaggccgcctccgcgcgccgccgcctggacagcgccgtcggcgccgccgcgtcgcgcatggtggaggagttcttgcgcgtcagggtctggaacgcctccctgctgcgcggcgccgtccacaggctctcgctcgcctccactaaccaatcacgactgatcttccccagcgccggcaagaaggacagctcggcgggcactcggcggggtggtcgacgcgtccgactggagccggtcgatggcgagctcgagcgtgcctcacgaggtcgcggccctcttggacgccgaggtctggtacgacctcgatctcatctgccccgtcaggcgtgtccgtcgctcacgagatcggcgctacgggtcgttcgtgccgaatgcaccgaggtactcttgcgggcgttcgcaacgctccctgcgagg

SEQ ID NO: 90498 - protein, 213 aa, Zea mays
  misc_feature: Ceres CLONE 1578484
MGAAVGKPAFGVAVAPKTQAEERLALAEHALLQWTRSPGADSGIWDAGASYTNRGLLAAVDEVLLLAAENPFPLPEAASARRRLDSAVGAAASRMVEEFLRVRVWNASLLRGAVHRLSLASTNQSRLIFPSAGKKDSSAGTRRGGRRVRLEPVDGELERASRGRGPLGRRGLVRPRSHLPRQACPSLTRSALRVVRAECTEVLLRAFATLPAR

SEQ ID NO: 90499 - DNA, 1143 bp, Zea mays
  misc_feature: Ceres CLONE 1578485
  misc_feature: Encodes the peptide sequence at SEQ ID NO. 90500
  misc_feature (55)..(55): n is a, c, t, g, unknown, or other
  misc_feature (56)..(56): n is a, c, t, g, unknown, or other
ttgtggggggggggggggggtatttttctcaatcggggcgcgtgtggtgggtgannaatcgtctttttttgggagtggaactccccgcggtggcggccgctctagaatagtggatcccccgggctgcttgaattcgtctcacccctagaaaaatcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccggccgtccccggccgggtacctcttcaaccgcgctgccgcctacgcctcttccgccgcggcccaggcggcacctgccaccccgccgccggccaccgggaagaccgggggcggcaagatcaccgaagagttcaccggcgctggcaccattcgccaggtgtgccagggagaacggcggccttctttgacttgcggctttcgatgaaggggctaccggcccatccctcaagggggcttcaagggggcccggacaaacaacctccggccctcgggggctcgaagggggggcccccaaccaccctttgggccgaaaaaaaaatgggggggcgccaaaccactcccctttttgggtaacgggggcccccggagagggggggtctttgtaaaccccgccgggggccacagggggggcggttccctccccaaaaacaattgtgtgggggtgggccccccccccccatatttaaccccccgttgagagcccccgtttttttgtggcgaaaggagggcctttgttaccaccctttggggagaaacccccttttctcataaaaaaaatgtgtgttttatttggtgggggagaaaacaccctatctttttgaaattgaaaaaaaaaggggtggggacctctttttagaagagcacaaataacgggttctttctcccccgcctatattttcacctagccgtgggaaaaacacccccgcgcgcttttttgtgtgtgaaacaagggggccccactggggaggcagagccaaatattctccttgtttccccacggaaataaacaagggccccgggaggattttttactttacacccccgccccacaagagg

SEQ ID NO: 90500 - protein, 99 aa, Zea mays
  misc_feature: Ceres CLONE 1578485
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAQAAPATPPPATGKTGGGKITEEFTGAGTIRQVCQGERRPSLTCGFR

SEQ ID NO: 90501 - DNA, 864 bp, Zea mays
  misc_feature: Ceres CLONE 1578486
  misc_feature: Translation starting site: 149
  misc_feature (483)..(483): n is a, c, t, g, unknown, or other
ccccgcggtggcggccgctctagactagtggatcccccgggctgcaggaattcgtctcacccctagaaaaaggatgtgcgtggcaacgtccaaaatccagaccgctggtaggagtacgagtatctcgtagacattgaacaacggctgcatggcgaccgcctgcgccacctccatccccctcgtctcggcgccctctgcatgcccgtccaagaagaccaccgtcgccaggttccggcgccgtacggcgacgtgcagggccagcagcggcggtggcggtggccggggcggcgaaaatgatggcctcttgtggctaccccggcgggacgtgatgctcaacggcctgtccagtgtcgccgccgggctcgcctggtacccgggcgtcgcgtccggcgcggatgcggtgtgcaccagggccgacaaggtgaacgagaagaccgtgcagtgcacgggacccgggccgggcagcttccgtgcccctctggnggtcgccggacggaccccgtgggacttccaggccgggaaagcaaggtggacgccgcatcccgggaagccggggcatcttccttgagcccggggaggttccagggaaaaagttaccaagggaggcccgtcccccaaaaattgagagggggcctcccggggaaaaaaaacccccgctttaaacctttttcgggggcccaaggggggggcccattcccccccagaggggtttaagtgggggaaagagcccctatccttaccaaggggttccaacacccccggaggggggcccaagagggaaccccccgccccccttttcaaaagaggggggaacctccttttttcgggggggggaaaatatattttccgccccccgcgccgggg

SEQ ID NO: 90502 - DNA, 776 bp, Zea mays
  misc_feature: Ceres CLONE 1578487
  misc_feature: Encodes the peptide sequence at SEQ ID NO. 90503
ctggagctcaccgcggtggcggccgctctagaactagtggatcccccgggctgcaggaattcgtctcacccctagaaaaattcgccctcccctccatccccgcatccgaatcacgcacgcgacccttgacatggccacttacagcgacggcggcggcgaccagcggcgccttctcaccatccccaaggaaggcgagcgcatcatcgcgcccacgcgccgtcccgacggcacgctccgcaaggccatccgcatccgcgccggctatgtgccccaggaggaggtcgccatctaccagtccaagggcgccctaatgaggaagtcaggacccgacgtgccgccggggtacgatccggcgcaagtggccgatgccaaacccaagacgaaggcggccaagaggaacgagcgacggaaagagaaacggcagcaggccagttcgacaaataataaaggaaagagtatggacatagagggaactgatgctggagaaactgacaaggctctttcttccaaaacggttaagcagaaggatctcggtggaaagtgtaataaagcagataagtggcattgctatttccgagtcacatgcaacgccgtccacaaatactacaaacaattcacaaccggaatcatctgctccagacatagataagaaaattcgagcattgaaaaagaaaggttacccctgcccctcctctgtgtctgcacattttccatgaacaaaaagatgattgtgagtccagtcccgaactaacaggtttaaacaatttcccccttgc

SEQ ID NO: 90503 - protein, 172 aa, Zea mays
  misc_feature: Ceres CLONE 1578487
  misc_feature (21)..(47): Pfam Name: Mago-bind Pfam Description: Mago binding
MATYSDGGGDQRRLLTIPKEGERIIAPTRRPDGTLRKAIRIRAGYVPQEEVAIYQSKGALMRKSGPDVPPGYDPAQVADAKPKTKAAKRNERRKEKRQQASSTNNKGKSMDIEGTDAGETDKALSSKTVKQKDLGGKCNKADKWHCYFRVTCNAVHKYYKQFTTGIICSRHR

SEQ ID NO: 90504 - DNA, 898 bp, Zea mays
  misc_feature: Ceres CLONE 1578488
  misc_feature: Translation starting site: 288
  misc_feature (28)..(28): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
gtttgggggctttttcgccaggggtggnttgcaggccggagggggagactggagggggggagatttnnnntttatttnntnnatgctggggctccccgcggtggcggccgctctatactagtggatcccccgggctgcaggaattcgtctcacccctagaaaaacttcccgttccccaattcgaaatcgagtcgggtcggtcttgccgtgcgtgcgtggctgcgcgaaccagcccacgctcccactccccgcccgccaccgccgggtccctctagggttttgccgcgatgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtaatcagcacagggagtcgtgccccgattcattgagttccttacacgtgagggaccatccacaactccagtttgaggctgcatgggcgcctcaccaacattgcatcaggccacatcagaagaacactaagggtgggtggttgaagagtgggtgcctgttgcccatctttttgttaagcctccctcaaactcccaattagcggagggaatggttcgttgaaacagggcctgttatggggccttttagggtaaatggtttgcctgggtgaaacttccca

SEQ ID NO: 90505 - DNA, 892 bp, Zea mays
  misc_feature: Ceres CLONE 1578490
tccccgcggtggcggccgctctagaactagtggatcccccgggctgcaggtatattcgtctcacccctagaaaaagagagagagagagagaaagaaaaaaaaagcatcaggcaccagtgcatcgccaccgtaccggagggggcagcgcccaaaaaaggcaaacgaggagggtgggcgagcctgctcttcctgtctgggagagagaccgaagaagaggagagagaggcgcagcgcagcgcagcgcaggcgcgcatctcccccctccccttgccggctggcccctgctgcagctctgctccggtcggatctgcccccccgctctgctgactgctctgccgctgctgctgtcgcaggcgcgccaccatcccgccgatgcgcgcgtagcgtcgtaggttccatcatcatccatccccgcgactacccaccacccacccctgcagtttgcagcatccccttccccactcccggctggtctgctgcggccacccctgcgccgatccacctccgctgcttcctgcctcaatatattcgcccgcctcgtcgcgtccgacccccccacagaaagccttccaaaaaccctccgaaccctcggcttcggcccgctgcactctcatcctcctcccggggcgggcgaactccgaatgggccgtctttgaaaggctgcccgcctacgtaaccaagccggggtccgccggctccatggaaggaagggaaccgtggggggctgggccaccggggcggcttttgcgcccctacgcccttgagtaaactctgaaaaattgtcggtgataacttcgtgtagggaaaccttggctttcctccggatataatctcaaaccccccctatggttgccacctataaaaaagttttctctttccccgtcgctcacct

SEQ ID NO: 90506 - DNA, 827 bp, Zea mays
  misc_feature: Ceres CLONE 1578491
ctccccgcggtggcggccgctctagaactagtggatcccccgggctgcaggaattcgtctcacccctagaaaaacctccctaatttcctctcacaaaaagcgggtgcggcttcctgccactcacctcggtctcggggggcgcccgtgctgctggtttcgctccaggggagaaggggcagagggagtagagcaggttaggtccgtttgcgttttcttttgcgggtttgtaggtcaaaagctccgcgagcactttccgctccacctcctcacgctcggaatcaaatcgatgcccccctgatttggttcctggtatcggtgcatgagcttgctccaagagatctcccttttggttcggcgtcaggggttctgtgaggtcactcagcttcttcctcttggcgctcctcacatgtccgggcgcttcgatctctgcccactgcgcgagtgattctgctgctgcagcacctgttaggtgcgcgcaggccgttatggggtgaaccaaacgttcctcgcagggctgtgggtttattacgccccctgtttgcttccccgcaccttgtcctttgtgcccttacttcttttgctttttgcacgcccggaacccgggtcctcctggtactatccgaaagcttgggcagttgggcaagcaccaaactagccaactggcttaagggataaaggtttaaaacccagtggtctgggggcaaaaaccccaaaagggggtcccccaaatccgttgaaaggcattaaaaaaccggccttcctggggctgaaaataaaaggcctccttaaaatttcccccccctgttgaaatagggaggcaacccatt

SEQ ID NO: 90507 - DNA, 847 bp, Zea mays
  misc_feature: Ceres CLONE 1578492
  misc_feature: Encodes the peptide sequence at SEQ ID NO. 90508
ctccccgcggtggcggccgctctagaactagtggatcccccgggctgcaggaattcgtctcacccctagaaaaaaccgtttccagcacacagggtaaaggcaagcaaacgagcggcgggacggctagcccgcaatacaaaatccggaggaactcccaggaggcgaaaagcagatccgtctcccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaagctccttaaattggctgacgctgcgaagctcaaggagaagattgagaagatgtttaaaggtgaaaagataaatagcacggagaacaggtcagtgcttcatgtagctctgagggctccaagagatgcagtcataaacagtgatggggtgaatgtggtccctgaggtttggagtgttaaagataaaatcaagcagttttcagagacctttagaagtggatcctgggtttggagcaactggaaaaacgttgaacaatggtgtgtcagttgggataaggtggtagctttccttggccctcctatttgtggcatactgccatctccaaaacgcatccgaaagcagccaattgtggcaaaaggccgggcaaatcgagattcccttggcaaaagtttgaatcccaatttgaaggttgtccgcaaagacttttaaagatattgga

SEQ ID NO: 90508 - protein, 205 aa, Zea mays
  misc_feature: Ceres CLONE 1578492
  misc_feature: SWISSPROT Homolog: EC 5.3.1.9 Glucose-6-phosphate isomerase
MASAALICGTEQWKALQAHVGAIQKTHLRDLMADADRCKAMTAEYEGIFLDYSRQQATGETMEKLLKLADAAKLKEKIEKMFKGEKINSTENRSVLHVALRAPRDAVINSDGVNVVPEVWSVKDKIKQFSETFRSGSWVWSNWKNVEQWCVSWDKVVAFLGPPICGILPSPKRIRKQPIVAKGRANRDSLGKSLNPNLKVVRKDF

SEQ ID NO: 90509 - DNA, 778 bp, Zea mays
  misc_feature: Ceres CLONE 1578493
  misc_feature: Encodes the peptide sequence at SEQ ID NO. 90510
ctggagctccccgcggtggcggccgctctagaactagtggatcccccgggctgcaggaattcgtctcacccctagaaaaactcacttggccactcttcttcctcctcatcaatccgctctccagcacttgttcggaagaaaaagaagctagaacacgctaacaagacaacaaggatcatggggcgcgggcgcggccacctcctgctgccggcagcagccgcctgcctgtgggcgctgtcgtgcgcgctgctgctgcgcgcgtcccctcaccgcgctggcgccggcgccggcgggctgctgagggtcgggctcagcaggcgcggcggcgggctcgaccagcgcgcgctggcggcggccaaggccgcgaggcagcaggaggcaagccgtctcggggcctccggcggcggcgacgtccctctcgtcgactacctcaacacccagtactatggggtcgtcggcatcggcacaccgccgcagaacttcaccgtcatcttcgacaccggcagctcctacctctgggtcccctcctccagatgctacttctcgattgcctgctacctgcaccacagatacaagtcggccaagtctagcacgtacaaggcggacggcgagacctgcaagatcacctacggctcccggctcgatccgccgggtcttcagcgacgacgacgtggctggtcgggggacctgaccgtcaaaaacccagaagtttcatcgagacaaacgcgccgaaagcaagcgttaacgttcctaaatcgggaaagttccgaccggcatc

SEQ ID NO: 90510 - protein, 200 aa, Zea mays
  misc_feature: Ceres CLONE 1578493
  misc_feature (88)..(200): Pfam Name: Asp Pfam Description: Eukaryotic aspartyl protease
  misc_feature: SWISSPROT Homolog: EC 3.4.23.40 Phytepsin
MGRGRGHLLLPAAAACLWALSCALLLRASPHRAGAGAGGLLRVGLSRRGGGLDQRALAAAKAARQQEASRLGASGGGDVPLVDYLNTQYYGVVGIGTPPQNFTVIFDTGSSYLWVPSSRCYFSIACYLHHRYKSAKSSTYKADGETCKITYGSRLDPPGLQRRRRGWSGDLTVKNPEVSSRQTRRKQALTFLNRESSDRH

SEQ ID NO: 90511 - DNA, 804 bp, Zea mays
  misc_feature: Ceres CLONE 1578495
  misc_feature: Encodes the peptide sequence at SEQ ID NO. 90512
  misc_feature (385)..(385): n is a, c, t, g, unknown, or other
  misc_feature (567)..(567): n is a, c, t, g, unknown, or other
caaactggagctcaccgcggtggcggccgctctagaactagtggatcccccgggctgcaggaattcgtctcacccctagaaaaaaagagggaagccgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcngagaaagaagcgccagaagcagcacgacgagaacgtgcagaaagtcgtgaagcggctcaagcagaggaacccgaagaaggacggtcttgtttgcacggccaggaggccctggatcgctgggggcatgcgcaacgtggactaacagcgtgcgagggcatttcgagggtcgacctttcttcctncaggaacaatcctggagatcgacaaagaagaggatggttggccaagggccgaagccccttgtcaacatggggtcagaataacccgaagctccctggccccattgaaaccttggcccttggggggccgtccgcccgaagcttcaaacaaccctccccgggggggtgggggggggatcacaacgggttaaccggcattccaagggggaaccccctcccccctctttagggggccctttt

SEQ ID NO: 90512 - protein, 190 aa, Zea mays
  misc_feature: Ceres CLONE 1578495
  misc_feature (116)..(116): Xaa is any aa, unknown, or other
MADVHEPLVRRKRKKVLVDYLVKFRWILVIFVVLPISTLIYFNIFLGDMWSAMKSEKEAPEAARRERAESREAAQAEEPEEGRSCLHGQEALDRWGHAQRGLTACEGISRVDLSSXRNNPGDRQRRGWLAKGRSPLSTWGQNNPKLPGPIETLALGGPSARSFKQPSPGGWGGDHNGLTGIPRGNPLPPL

SEQ ID NO: 90513 - DNA, 813 bp, Zea mays
  misc_feature: Ceres CLONE 1578496
  misc_feature: Encodes the peptide sequence at SEQ ID NO. 90514
  misc_feature (798)..(798): n is a, c, t, g, unknown, or other
tggagctcaccgcggtggcggccgctctagaactagtggatcccccgggctgcaggaattcgtctcacccctagaaaaactctcgatccggaaacctctcaaccctactggcctcctgcgcttttcggacctcaggactctgcgccctggccagcgagacggagacctacccatttcgagctaacatcacaccaccgtgctctacacacatcatccacaccttctacctcctgcacggaaagccttccgtccacgagcttatctccaactcttccgatgcgctggacaagatcaggttcgagagtctcactgacaagagcaagctcgatgcacagcctgagcttttcatccaccttgtcccatactaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtctgtttctactctgcctacctcgtcgccgatagagttgtcgtgaccacctagcacaacgatgacgagcagtacgtgtgggagtcccaagcgggcgggtcgttcactgttactcgtgacacgtcaggggagcagcttggcaggcgcactaacatcacactgttccttaacgacgatcagctggagtaccttgaggagcgtcgcctcaaggatctggtcaagaagcactctgagttcatcatctacccccatctccgtgtggactgaacagacacangagcaaggaaatttc

SEQ ID NO: 90514 - protein, 55 aa, Zea mays
  misc_feature: Ceres CLONE 1578496
MTKSDLVNNLGTIARSGTKEFMEALAAGADVSMIGQFGVCFYSAYLVADRVVVTT

SEQ ID NO: 90515 - DNA, 845 bp, Zea mays
  misc_feature: Ceres CLONE 1578497
  misc_feature: Encodes the peptide sequence at SEQ ID NO. 90516
ggagctccccgcggtggcggccgctctagaactagtggatcccccgggctgcaggaattcgtctcacccctagaaaaaacttgcgccgcctgtccccgcgccctcgaaacctttttctcccaaaacagatttcgtcccggcgctctcctgcaaagggcggctagctgtcgccggtggatacgtttcacctctgtctcactgcttgggggggttctgcttcttcctgctttcccaagagagggccagcagcagacgaagcgagcaaagcgcgcaggaaccgctcggtctggtgattttaaggggcgaggtcgtgttcttgggaggcggagagacacgagctctctctcttcctgtcctctttcccgcggcttctctcttgtcttgctccaagagggcaaaaccccctccgggtagggaaatggcggaggtgaagccggaggagataagccatccgcccatggagcagctccagggggtttcgagtactgcatcgactccaaccctccctggggcgaggcgatcatactgggcttccagcactacatactggcgctgggcacggcggtgatgatccccacggtgttggttcccatgatgggcggcgaccatggggacagggtcaggggggggcaaaccctgctgttcgtgacggggaaaaaacaccttcttgaatcccctcttcgggaacccggtggcgaaagttcattggggggttccctacgccgttcctccatccccgataaaggggcttcattccgggaacccctgcccttttctgggaaatcccgcaagggggcattaaaagaggttccctccagaaccactgaaagggccctttaaggggg

SEQ ID NO: 90516 - protein, 90 aa, Zea mays
  misc_feature: Ceres CLONE 1578497
MIPTVLVPMMGGDHGDRVRGGQTLLFVTGKKHLLESPLREPGGESSLGGSLRRSSIPDKGASFREPLPFSGKSRKGALKEVPSRTTERAL

SEQ ID NO: 90517 - DNA, 777 bp, Zea mays
  misc_feature: Ceres CLONE 1578498
  misc_feature: SWISSPROT Homolog: EC 1.1.1.34 Hydroxymethylglutaryl-CoA reductase (NADPH)
  misc_feature (243)..(243): n is a, c, t, g, unknown, or other
  misc_feature (341)..(341): n is a, c, t, g, unknown, or other
  misc_feature (497)..(497): n is a, c, t, g, unknown, or other
  misc_feature (540)..(540): n is a, c, t, g, unknown, or other
  misc_feature (777)..(777): n is a, c, t, g, unknown, or other
ctggagctcaccgcggtggcggccgctctagaactagtggatcccccgggctgcaggaattcgtctcacccctagaaaaactcccaaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgntaccggcggcgaggggcagcgggtgcgtgtgcaggcgggggacgcgctgccgctgccgatccggcacacgaacctcatcttctcggcgctgttcgccngcggtcgctgggtgttacctgaatgcggccggttggcggggaaaaaaaaattccgggttttccttcccacgcccgggtttcccaaaggggggggggtccctccccccccccgtgggggggggcgggggaaaaaaaaaaaaaaaatttttttctttngggtcccccaaaaattttttgggggggggggggggcgcccccnctcccatcttatgggggggggggggggggggggaggagaggaaaccccccgtgccctctcattataaaaaaagggggaagagaagggggacaggctcccactaggggggattccgggaactcgaagcgtcccagccggatgtttcgcccacccgggaggggcaggtcgccgcgtgggggggcggcgaccgactggtagtgggtgccaccgcgagttcgcgcacaatacagattgtan

SEQ ID NO: 90518 - DNA, 851 bp, Zea mays
  misc_feature: Ceres CLONE 1578499
  misc_feature: Encodes the peptide sequence at SEQ ID NO. 90519
  misc_feature (511)..(511): n is a, c, t, g, unknown, or other
ctcaccgcggtggcggccgctctagaactagtggatcccccgggctgcaggaattcgtctcacccctagaaaaagcggggcgatgccaaaatcgaaacacgcctccccctcctcgtctggctccccccccgtgacctatctcgtaatctcatccgcacccgcctggccgccttgcctagcctagcgccctagccttgcctgctctcctcatgccctggccgccgcctataaaagagcgaggcggagaggcaggcgccggccgttcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcccctcgctacacgccgccggggctgcctgcgcggctgtcctcgcctgcttcgtgctctccgccgcggactcgccggcatctgcggcacgcaacgatggcgcnggcgcctccgctgtcctcgggctcaccggggcgtttggccccgacctcgcgtttcaactgggcgggtggtggtccgccacccgtcctcgggggttcctccgttcccccttttggaaccgttcgggcggcttcgggggaaggggggaaactttcgtggccaatggccaaaccctgggtggtggggttgaaaaacaaaatcccgcccgccgcgcctcccaaaagggaataaacagggggggcccccgcccttcccccggtttggggacaaacctccaagggtgccccccccccaaaaaaagggggcgcccctttataaaaaaaaaaagcgcgggttgtgctt

SEQ ID NO: 90519 - protein, 169 aa, Zea mays
  misc_feature: Ceres CLONE 1578499
MVMEGRTGSLYGRLNKSSTRGFPSLHAAGAACAAVLACFVLSAADSPASAARNDGAGASAVLGLTGAFGPDLAFQLGGWWSATRPRGFLRSPFWNRSGGFGGRGETFVANGQTLGGGVEKQNPARRASQKGINRGGPRPSPGLGTNLQGCPPPKKRGRPFIKKKSAGCA

SEQ ID NO: 90520 - DNA, 752 bp, Zea mays
  misc_feature: Ceres CLONE 1578500
  misc_feature: Encodes the peptide sequence at SEQ ID NO. 90521
ctcaccgcggtggcggccgctctagaactagtggatcccccgggctgcaggaattcgtctctcccccccccgaaaaaaagctcaggcaagcggcagcaaggcgttggcaatcccagtccagtcgtcggagcactcgcaatttcccgtcacagctggccaccgccccaccctcacggcctcacctcctcccgctacacgcacgcgcccacctacccaaaacgaccgcgcgcggcgccctcctcccgcggtgccaccaccaccaccacctcgtcggaccatcaccacaccgatcggcagctaagcagctcccgcctccagcaccgcgagcggcgatggcaatggacgcggccgtggccgtgaagagcggcggtggcggcgccggatcgaccggggtcaccgcggcggcctcgcagtccccgcatgcggcgactaacggcggcgagcggcggtcccggttccagcgcatctgcgtgtactgcggcagcgccaaaggccggaagcctagctaccaggacgccgccgtcaagctgggcaaagagctggtgggagagggcatagacctggtctacggggggggttccatcggcctcatggggctggtctcgcatgcagttcatgacggaaggcgccatgtgattggggtcatccccaagatcttgatgcccagagaggtcactggttgagcctgttggggaaaataagggccgtctccggcatgcactatatgaagggccaaaatggcccgccttccc

SEQ ID NO: 90521 - protein, 116 aa, Zea mays
  misc_feature: Ceres CLONE 1578500
MAMDAAVAVKSGGGGAGSTGVTAAASQSPHAATNGGERRSRFQRICVYCGSAKGRKPSYQDAAVKLGKELVGEGIDLVYGGGSIGLMGLVSHAVHDGRRHVIGVIPKILMPREVTG

SEQ ID NO: 90522 - DNA, 809 bp, Zea mays
  misc_feature: Ceres CLONE 1578501
  misc_feature: Encodes the peptide sequence at SEQ ID NO. 90523
  misc_feature (294)..(294): n is a, c, t, g, unknown, or other
ctccccgcggtggcggccgctctagaactagtggatcccccgggctgcaggaattcgtctcacccctagaaaaaacctcgtcctcctctccactctctcttctccctccaataattttctcctctctgcttgctccagttccaagcaccaccgaatcagggcgagtgggagcagagggaatcccatgtctccgcccctcgctggagtagatcctcggggagccggcgtggagctgccgcggtagaaagccagctgagcctgcgagcgcctgatccagcccgatcgggatcgatngggtggggaggcgccggagccgcggcggctgacccgcgctctgagcatcggtggcggtggcggcggctgggttcccgatgagatgctgcaactggtgttggggtttgttgaggacccgcgcgaccgggaggccttgtcgctggtgtgtcgccggtggcaccgcatcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactgggggcgcctacgcccggccctggggtcaccgagctcgcccggccattcgagtgcctcaaggcgctccacctggcaacgcatggtcgtcacagacaacgacctcgccgagctcatccgtgccagggggcacatgctgcaggagctgaacctcgacaagtgaccggcttctccacgggatggactcccgcctcgtcgcccgcttc

SEQ ID NO: 90523 - protein, 129 aa, Zea mays
  misc_feature: Ceres CLONE 1578501
MLQLVLGFVEDPRDREALSLVCRRWHRIDALSRKHVTVPFCYAVSPARLLARFPRLESLAVKGKPRAAMYGLIPDDWGRLRPALGSPSSPGHSSASRRSTWQRMVVTDNDLAELIRARGHMLQELNLDK

SEQ ID NO: 90524 - DNA, 879 bp, Zea mays
  misc_feature: Ceres CLONE 1578503
  misc_feature: Encodes the peptide sequence at SEQ ID NO. 90525
ctggagctccccgcggtggcggccgctctagaactagtggatcccccgggctgcaggaattcgtctcacccctagaaaaaacttcataaacaggacgcgggctcgacgacacaccgatcaggcgcgccgaagcggcggccgcagccgacggtcatctcccggcgccggtcgcggccatgtagaagaagaagggggtcacgacgatgacgctcaaagacttccacggaggctccatcccctccgagctcccgctcccctccgcccccggcgtcaccccgcgccccgcggatcgcactgtcgcctccgcatcccccgtcacagccgcggtcgcacggccactcgtaccggtcgcttcgcctgccgccgctgcggcggcaaccacaatgccttccttcctcacaaacccgtcccgaatcggccgtcacttcgacgaggacgagcgcacccccttcgagcccaccacgccacgccgtctcgcgccgtccccaacgtcgttcgcacccgctcccgtggtggcgcccaacagatcaggtccggggaacgcatggtgcccgaagtagggaggctcttcagcgccttcccctgtgggtcaggctcctgcctccgccagcgaacagatttgggtcgccaaaggaattccccaattcgaggcgcattgaaaaaggttatctccgggaaaatggggcccccccgaagccccacgttttcccccggccgccgggggtaatttcccgggggttgggagaactcccggtgggcccggacccgaaaaattaagaaggccctgaggccccctttgtggggggaaggaaaaagctgtgtctatttgtggggtgggaaaaaagggggtctcccctctccccacctgggaaaagacct

SEQ ID NO: 90525 - protein, 60 aa, Zea mays
  misc_feature: Ceres CLONE 1578503
MVPEVGRLFSAFPCGSGSCLRQRTDLGRQRNSPIRGALKKVISGKMGPPRSPTFSPGRRG

SEQ ID NO: 90526 - DNA, 825 bp, Zea mays
  misc_feature: Ceres CLONE 1578505
  misc_feature: Encodes the peptide sequence at SEQ ID NO. 90527
aagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtaccccgcgaaagaccttccttccaagacgtcgggccctcggcggggttcgggctaaaaaggtcaccccgctttacttcttatgcccacccgggaaagaacctcaaagttccccccaaatttggggaattaaaagggggccggcaaaggcccaaaaattgggggaacaagtcccgg

SEQ ID NO: 90527 - protein, 149 aa, Zea mays
  misc_feature: Ceres CLONE 1578505
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKDLPSKTSGPRRGSG

SEQ ID NO: 90528 - DNA, 807 bp, Zea mays
  misc_feature: Ceres CLONE 1578507
  misc_feature: Encodes the peptide sequence at SEQ ID NO. 90529
  misc_feature (572)..(572): n is a, c, t, g, unknown, or other
  misc_feature (626)..(626): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (659)..(659): n is a, c, t, g, unknown, or other
ctccccgcggtggcggccgctctagaactagtggatcccccgggctgcaggaattcgtctcacccctagaaaaaatctgcctctctcttcccctccctctctggaaccagggtggttgtcaagcggtgttggagttgggagtccttgccattggtacaagagcaagaagcaaggacagggaggggcgagaggaggaagaaagcgagggacactagaaaggtgcttgctttgtttccagttgcttcttctctctccctgggcgggagagaaagaagcaggagagatatgggcgagatggtcgtggccgggtatggcatggacaaggctctgcgggccagcgtcagcttcgacacgccatgcggcgcgctgctgcgcgagcttgagcaaatatggacagagattggggaacgtgaacaagataaagatcgcatgttccttggactggaaacagagtgcatgcgtgtgtacgctagaaagggtgatagtgccaatgctgagaaaacccagctccgtcagtcactgatggcccaaaaagcaaagcttaaagctctagttgctttctatcgggaaanatggcccaccatttttcgggggtgaaaaagccccatccgttaaaagatctactntgctgcagtggcgcctcctttnnnnnatcttanagtaaagaaacaagacagagtccaacaaatctcaaatgtgcaatgtcaaatcgagaagataaaagcacaaatttctgattacaattatcaggacagtgattgtttccatcaaacaacttaacgatgaccatgacttatcgaccagaaa

SEQ ID NO: 90529 - protein, 103 aa, Zea mays
  misc_feature: Ceres CLONE 1578507
  misc_feature (96)..(96): Xaa is any aa, unknown, or other
MGEMVVAGYGMDKALRASVSFDTPCGALLRELEQIWTEIGEREQDKDRMFLGLETECMRVYARKGDSANAEKTQLRQSLMAQKAKLKALVAFYREXWPTIFRG

SEQ ID NO: 90530 - DNA, 926 bp, Zea mays
  misc_feature: Ceres CLONE 1578509
  misc_feature: Encodes the peptide sequence at SEQ ID NO. 90531
  misc_feature (405)..(405): n is a, c, t, g, unknown, or other
ctggagctccccgcggtggcggccgctctagaactagtggatcccccgggctgcaggaattcgtctcacccctagaaaaaacacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgaggccgacgcgcccaancgcaggaagggcccgctgtaacagctcaaggcggcgatccaggccctcgcgggatcccgctccgcccgcccccaagtgtacggggggagagtaacagtacccgcgccgccttccagaaagggggaggagaaattcttcccgggtggctacccggctagggcgaaaatgttttcccctatgattaaacaagcggggttgtaaccttgggggtgggattcccagcttttcggggggaaaaccgccaaaaggaacaaaccaaatttggaaaaaaccggggcttgtggggggggggaattatccggcccaaaggaatggggggaaaaacgggtgcctcaagaagaaaacccggcaaaagggggggaccccccaaatggtgccccttttttgggggaaaacacaaaggggggggaaagaaaaaagccctcggcctcccgagaatttttcctctttttggggaaacaccgggtttgtttatttctctctccccagagagggaggattttttctagaaaaactttttt

SEQ ID NO: 90531 - protein, 73 aa, Zea mays
  misc_feature: Ceres CLONE 1578509
  misc_feature (67)..(67): Xaa is any aa, unknown, or other
MAAAAAAAVAHLSIHGRLRRSPEHRPSITTTTTSSSSPSAHRPSLLRCRAFKQEASDGDPAEADAPXRRKGPL

SEQ ID NO: 90532 - DNA, 1056 bp, Zea mays
  misc_feature: Ceres CLONE 1578510
  misc_feature: Encodes the peptide sequence at SEQ ID NO. 90533
  misc_feature (1)..(1): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
naatttggccgggggggggggggaatataaattatggtgggtgggggtagaaaagaagttnnnnntggtataatttaaaacttggactccccgcggtggcggccgctctagaatagtggatcccccgggctgcaggaattcgtctcacccctagaaaaaacacacaccctatacgcgccgtcatggccctctctatcatcccgagtacaagcagcggggagcacgctgcggcgtcagcatcggccacggccacgaccacgacgaagctgggtcagctgaacgcggcggtggagaggtcatgggtggggcgacggttccgcctcgcagcgcgcgggactacgttcaccacggagctgcgtgccggcacggccacgttcctcaccatggcttacatcctcgccgtcaacgcatccatcctctccgactccggcgccacgtgcacggtggacgactgcgacgtgccgtcccccaggggtgcaagttcccccccgtgagacccggggtacgcccgctttgcgtgggcgcgcgtccgcccgggaacctgatcgtgggccacccgcgggcgtccttccggggatccggggtcctttccatcatgggggcgccctttcgccaaaaccttcccccattcggggccttaggcaacccgggggaatgggggaacccaaacggccctaaactttcgccccttaacaccgaggttttttttcggggctttttcccaagggggctttcccggggagaaaggctcttcccccctataacccgaaaaggggggggctcttcaggggggggggggcctctttcccccgccaaagggggcccccaaaacttttcccaccctttttaaaccccccccacccctgggggggtttttgtcagataccaaaagcttccggcccgaaattttatatcccacacaacccccggggggggggaaatttgggggggtcccgcgggggggaacgggggctttttcccccgggggcttctaggggcggaacaaaaaaaaacaaaggggcgggggggccccgggggggtcacccccccccacaa

SEQ ID NO: 90533 - protein, 103 aa, Zea mays
  misc_feature: Ceres CLONE 1578510
MALSIIPSTSSGEHAAASASATATTTTKLGQLNAAVERSWVGRRFRLAARGTTFTTELRAGTATFLTMAYILAVNASILSDSGATCTVDDCDVPSPRGASSPP

SEQ ID NO: 90534 - DNA, 748 bp, Zea mays
  misc_feature: Ceres CLONE 1578513
  misc_feature: Encodes the peptide sequence at SEQ ID NO. 90535
ctccccgcggtggcggccgctctagaactagtggatcccccgggctgcaggaattcgtctcacccctagaaaaaacagcagcatcctattcctcctacctcactggctcactctcgtcttggtttacaaagcctccgccgccgcaagtccactccacccgttgtccaggttagttggttggtttcaatttcgagttcgccgagcgacagcttgcgcctgccatttctcggctccgcgtgccggagctcgttcatctccagcttctccggccgttactcgctctgaaccgacgacagtaccgataaagccccgactcgccatcctccggcgacgatgccttcccgatcggattccgactccctgctggtgcgcgccgagggcatgcgcgacgcggcgttggactaccgcggccaccccgccgaccgcggcgccaccggcggctggaggtcggcgctcttcatcatagcggtggagatcgcggagcgcttcacgttctacggcgtgtcggcgaacctgatcaactacctgactggcccgctcggggagggcaccgcggcggcggcggcggccatcaacgcctggaacggggtggcgcagctgctgccgctgctgggcggggcccttgcggacaagtggctcggccgctaccgcaccatcgtcatcgcctcgctcctctacatcctcgggtctgggtatgttggccttttctaccttcctctcctccggcagcggccaccagtgcaccgcg

SEQ ID NO: 90535 - protein, 138 aa, Zea mays
  misc_feature: Ceres CLONE 1578513
MPSRSDSDSLLVRAEGMRDAALDYRGHPADRGATGGWRSALFIIAVEIAERFTFYGVSANLINYLTGPLGEGTAAAAAAINAWNGVAQLLPLLGGALADKWLGRYRTIVIASLLYILGSGYVGLFYLPLLRQRPPVHR

SEQ ID NO: 90536 - DNA, 676 bp, Zea mays
  misc_feature: Ceres CLONE 1578520
  misc_feature: Encodes the peptide sequence at SEQ ID NO. 90537
  misc_feature (647)..(647): n is a, c, t, g, unknown, or other
agctccccgcggtggcggccgctctagaatagtggatcccccgggctgcaggaattcgtctcacccctagaaaaagccgcacccctttcctccttccgccctccgccgcgcctggctttctcccttcccgagaggccacgctccatccccgcccgcgctgcctcccctggcgatcggcggcgaccgcggcccaacgaaagcgtcgtggtcggccgctgtcacgcttcttgcagacgctgggcggactgggaaacagcgccaatggggggaatcgcgggtgggtgggcttctacacaacccatggccgggggggggtttaacaaacccaattccccggggattccatttcggggcccctttcgggcccgaaaattttttccggaaggggaataaaaaagggcgccccccccccccaaatatttttgggggggggcccaaaaaaccccccccggggaaaaaactttgcggaggggggggggcccccccaaaggggaaatcccccccagaaggttttaaaagagggcgggggcaaaaagggggggggggttgttttgtggccccccccgggggggtgttttttttttttttttaacaccgccccgcgggggtttttctctacaaaaggggggggggggaaaaacacaaancccccccccccttctgtggggggagggaa

SEQ ID NO: 90537 - protein, 43 aa, Zea mays
  misc_feature: Ceres CLONE 1578520
MGGIAGGWASTQPMAGGGFNKPNSPGIPFRGPFRARKFFPEGE

SEQ ID NO: 90538 - DNA, 1056 bp, Zea mays
  misc_feature: Ceres CLONE 1578525
  misc_feature: Encodes the peptide sequence at SEQ ID NO. 90539
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (78)..(78): n is a, c, t, g, unknown, or other
  misc_feature (79)..(79): n is a, c, t, g, unknown, or other
ttttttatttnnnnnnnntatttttttcctaaattacaaaagtcaataaggaaccgatgagataaatgggtgtggttnntaaaaactggaactcaccgcggtggcggccgctctagaactagtggatcccccgggctgcaggaattcgtctcacccctagaaaaaggggagcaacgcaagcactccacactgttgtgcagaacgagagccacaccatcagtagttagagcgaccaatagatgagttcctccccgtcctttggtctcctggctgtagcagcattactcctagcactgagcttagcacaacatggctccctcaccgcaaccgtcggccccaaggtcatcgtcgtcggcgccggcatgtctgggatctcggcggctaagaggctgtcggaggccgggataaccgacctgctgattctggaagcaacggaccacatcggcgggagggatgcacaagacgaacttcgccgggcatcaacgctcgagttagggcgccaacctgggttgggagggcgatcgaaccggccagcaaagaatggaaacccccaatcctgggcccaattccgtccaactgccaacccctccaaagcattcccgcaaacctttcccgacttcccgaaacctttccggaaacttagcctttcggaccttcaagaaaacgggtctcttaaccaaaggggcgaatggaaaccgcggtggggaccggttcccctaccgccaacttgatataaaaaaaattgcgaccgggttcgcccacggccaaagcaagcgaaaattttggaaaaaccttgggggccgcgggaaacacgcccgcttaggggaaaagaaaagagattgggggcgggaaagtaaaaagctttcctccgtgggcccgaactcttttgggcaacacgccccatgttggggacaaccaaagaacggcaacaatggaggcctcatttcccccttgggcccaattggacaagggcggcccctccaaaccgaaaaaaaaggcagaggctccaaaaaacgggggccccgggcaagaaacccccgggagggaaacaagggg

SEQ ID NO: 90539 - protein, 163 aa, Zea mays
  misc_feature: Ceres CLONE 1578525
  misc_feature: SWISSPROT Homolog: EC 1.5.3.11 Polyamine oxidase
MSSSPSFGLLAVAALLLALSLAQHGSLTATVGPKVIVVGAGMSGISAAKRLSEAGITDLLILEATDHIGGRDAQDELRRASTLELGRQPGLGGRSNRPAKNGNPQSWAQFRPTANPSKAFPQTFPDFPKPFRKLSLSDLQENGSLNQRGEWKPRWGPVPLPPT

SEQ ID NO: 90540 - DNA, 784 bp, Zea mays
  misc_feature: Ceres CLONE 1578529
  misc_feature: Encodes the peptide sequence at SEQ ID NO. 90541
ggagctccccgcggtggcggccgctctagaactagtggatcccccgggctgcaggaattcgtctcacccctagaaaaatccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtctccagagcctacttcgtggcttacgtagcagggcagcgctcgtgcctcctcaagagatcaggccgcacgttctcgtcggcgatctgttactacggtggcccgtggggaacaagttcggctcctgtcacgcgacctgctgctgctgccggcgacggcgaggatcctggggtcgcggcatggcgagcgagagatctcgacgaggccatctcgtcgctgttcctgttcccactggcaacgctaccgaagagagctggagacg

SEQ ID NO: 90541 - protein, 204 aa, Zea mays
  misc_feature: Ceres CLONE 1578529
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGTSSAPVTRPAAAAGDGEDPGVAAWRARDLDEAISSLFLFPLATLPKRAGD

SEQ ID NO: 90542 - DNA, 859 bp, Zea mays
  misc_feature: Ceres CLONE 1578531
  misc_feature: Encodes the peptide sequence at SEQ ID NO. 90543
  misc_feature (651)..(651): n is a, c, t, g, unknown, or other
  misc_feature (859)..(859): n is a, c, t, g, unknown, or other
tggagctcaccgcggtggcggccgctctagaactagtggatcccccgggctgcaggaattcgtctcacccctagaaaaagtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagcctcggccagtacaagtacgtgctgctggggcctctggtgtggaaggtgctgcaagaatggcgggagcaggcgggcctgccgctcggctcctggtggctgcacctgctgctgctgttcgcggcgcgcggcctcacctaccagttctggttcagctacggcaacatgctcttcttcacccgccgccgccgcgtcgtcgccgacggcgtcgacttccgccagatcgacgccgagtgggactgggacaactttctcgtgctgcaaacgctgattggggccacggtggtcaacagcccactgctcccgggcctgcggcagctctgcctgtgggacccgcgcgggtgggccgtcgccctgctgctgcatgtgggcttctcaaagacggtcttctacctggcccaccgggccctccacagggncccgctcttcgcccgctaccacgccgcggcacacttcttggaggtcacccaacccctgaacaaccgggttctgggaccccccctggaaggtcctgcttgctgactctggggaagggaggccccccctggcagggggcctttccttggggggggggcgggctcccttaggcccttggctaaagtgcaacgccctccccctttgaactan

SEQ ID NO: 90543 - protein, 185 aa, Zea mays
  misc_feature: Ceres CLONE 1578531
  misc_feature (152)..(152): Xaa is any aa, unknown, or other
MAPPPLSSWPWASLGQYKYVLLGPLVWKVLQEWREQAGLPLGSWWLHLLLLFAARGLTYQFWFSYGNMLFFTRRRRVVADGVDFRQIDAEWDWDNFLVLQTLIGATVVNSPLLPGLRQLCLWDPRGWAVALLLHVGFSKTVFYLAHRALHRXPLFARYHAAAHFLEVTQPLNNRVLGPPLEGPAC

SEQ ID NO: 90544 - DNA, 851 bp, Zea mays
  misc_feature: Ceres CLONE 1578533
  misc_feature: Encodes the peptide sequence at SEQ ID NO. 90545
  misc_feature (696)..(696): n is a, c, t, g, unknown, or other
acccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaagctgcggtgtccgcgtccgcgtcgtccacgctggcgggcgccttcttcgcgggggtggcgtcgtcacccgacgctgcgctggcggacgtcccggcggcgggggaccccgggtgaaacagccgcagccagcttctgctcgtcgtgggggcgccccgccacagggggggtgttttaaaaaatctcgctacccggcgcttaaaccaagctgaaacagatatgcggcaataaaccaaagcccatgggccgcctgggacaggagggactagggagggccgccgcacaggcgggggttaggaggggcccccccacccaatagtgcgctcaaaccaccgcgggggagggagagagaaagcccgcgagaaaaatcggcgcggcgggccagaatcccaccnttggaaacaaccggcgaagcaccgcccggcccggctactgacatcatgacggcccacccaccccgtgagcggggaggcacacgacaccgaaccggcacacgcgcaccggcccagagaaacagagctccccacccaaggcggtaggcacaattaaa

SEQ ID NO: 90545 - protein, 78 aa, Zea mays
  misc_feature: Ceres CLONE 1578533
MATIATMALLKPAAKAAARSAPSTSSGSVSLRVRTGQAAKKAAVSASASSTLAGAFFAGVASSPDAALADVPAAGDPG

SEQ ID NO: 90546 - DNA, 861 bp, Zea mays
  misc_feature: Ceres CLONE 1578539
  misc_feature: Encodes the peptide sequence at SEQ ID NO. 90547
  misc_feature (861)..(861): n is a, c, t, g, unknown, or other
ctccccgcggtggcggccgctctataactagtggatcccccgggctgcatgaattcgtctcacccctagaaaaagagctccgtgctgtctccgtcgtgttcggaacgagcgagagagcgggagacgagtcgcggcgcctctgctgtgctgtcttcgtctccccctctgctctgcttcggctcctcacgcggcctcagggagacccgcagaacagggggttcagacttcttggtgagagcgatatgagtgtcccaggtcaatgctcatcccggccacaatttatcaccagcgttgggaggagtaaccgctcctatggccccggcactcctcttctcgaaagcatagatgttgatcaaattgttcttccagagaaaaactgttggaagaacttattctcatacccacggcctggattgctcggcgcaactgcatatattgatcctggaagctctgagacggatctacaggctggagcacagtccacatatgagcctccttggatactgcttgttgcatcacgtgctgctcttattactcaatcacttgccagccaggctaggggttgtgacctgggaaacttcttgcggagcagttgagggctgtagtttcccaggggcaacaaattgtgcctttagggattgcttgcggaaacttgccccctggttgccttcgtgaccgtccctgaagtaattgggaacctgccttttgcggctaaaacggtgctggttccgaaaacccccccccaggggccggggtgggggaagacccatacccgggacccctccccccctctataaggacccctaggtttgccttgcccccaagatagatgcggaggtccccctaacttctttagaaagn

SEQ ID NO: 90547 - protein, 117 aa, Zea mays
  misc_feature: Ceres CLONE 1578539
MSVPGQCSSRPQFITSVGRSNRSYGPGTPLLESIDVDQIVLPEKNCWKNLFSYPRPGLLGATAYIDPGSSETDLQAGAQSTYEPPWILLVASRAALITQSLASQARGCDLGNFLRSS

SEQ ID NO: 90548 - DNA, 789 bp, Zea mays
  misc_feature: Ceres CLONE 1578540
  misc_feature (615)..(615): n is a, c, t, g, unknown, or other
ctccccgcggtggcggccgctctagaactagtggatcccccgggctgcaggaattcgtctcacccctagaaaaaatagaacggggttgcgaggtagcccaattctacagcactagtctttttcgtctcggtcgccatgtgccttcagcgatgacgaaccgatcatcccttctccaaactcaggttcattcgtgaacacgaataaaaattgaaccaaatcatttttgctttgaatcgatttagtttgcgttgcattgctgatatatatcgatggagaagcaagaagagaatgcgtttacatccatatatgcggctgaaatattaacaatggagatgggaatggtgagatgcagggccgaagccgacgccgatcgtgcccgggagggtgcagctggtgagccaagacaacaacatggctccactggaggaagataccccagagggtgctgctttgagctgaaccggcgggcaactccaccagcggacccggccgggggcttggacctgggtggcccgttgctggacgttaagccggacaccattgcggggccaaaaaaaatccaaaaaaaatgaaaaacccgccctgaaaattctcggggggaaaaaaaaactaaanttccattggaacccgcctttcccattgtaacctttcccggggaaacccccccaaaaggatttctgccccccccttcggggaggggggaaccaaaaaaactccccaaccccaaaagggggttaaaaaatttattaaaaagcccccccctcccccccgggggggaaaaaaacaaac

SEQ ID NO: 90549 - DNA, 788 bp, Zea mays
  misc_feature: Ceres CLONE 1578542
  misc_feature: Translation starting site: 180
  misc_feature: SWISSPROT Homolog: EC 2.3.1.119 Icosanoyl-CoA synthase
  misc_feature (487)..(487): n is a, c, t, g, unknown, or other
  misc_feature (695)..(695): n is a, c, t, g, unknown, or other
ctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtgggggggaggccacctacgacctcgccaccgtgctcngcttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaggtccggcaagttcgacgatgacagcctgggcgttccagtcgcgtctgctgggcaagtccggcatcnggcgacaagtccgacatgcccgcgctgcgtgttcgagcccaacggcagctgcgcaaccatgaagggagggccgcgcccatgcggtccccggcc

SEQ ID NO: 90550 - DNA, 1112 bp, Zea mays
  misc_feature: Ceres CLONE 1578546
  misc_feature (1)..(1): n is a, c, t, g, unknown, or other
  misc_feature (8)..(8): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (72)..(72): n is a, c, t, g, unknown, or other
  misc_feature (73)..(73): n is a, c, t, g, unknown, or other
  misc_feature (673)..(673): n is a, c, t, g, unknown, or other
  misc_feature (810)..(810): n is a, c, t, g, unknown, or other
  misc_feature (966)..(966): n is a, c, t, g, unknown, or other
  misc_feature (1006)..(1006): n is a, c, t, g, unknown, or other
  misc_feature (1112)..(1112): n is a, c, t, g, unknown, or other
ngaggggntaggggnnntgagggaaagggtgggtataggagaggaagagtgacatataaaaaaccaaaaatnnaaaaaataaatccaccacgtggcggccgctctataatagtggatcccccgggctgcaggaattcgtctcacccctagaaaaatcccaaatcaaatccccaaaccccgggccactgctccgctcctcctccttgccgccgtgcggttgagcgccgacgagcaagcccgacgccaccctatggctatggaggtccgccgcagggttccgccgccgcacaggagcgccccacggcgccagcaagcgaccggcggcgaggggcaacgggtgcgtgtgcaagcgggggacgcgctgccgctgccgatccggcacaagaacctcatctttctcggcgctgttcgccgcgtccctggtgttcctgattccgcggtaggccggaagaaaaatccgttcctccacgccgctccacgtggaactcccctccgcccgaaaattttccccattctgcggccactccaggggcataccctcaaaaaaaccgccctaagctttctttcgcggaatcccccccctcccgccaagtcccggtttgttctcccaaaccagcccacaggaaccaaaggaaagggaaccttcccactccattcccaaacctccccgggnccaaaccagaaaaaattgccctatacgcgggtcgcccctgagaaagcaccacaccccctccgggggtacccggggacggggggagcccccccagatggacagaaacaggtctttttcctcttgttggggagaaaaancccccccccaccccacctctaaggcgtaatacggggagaaaaaaaaataatttccccccgcgaggagggaagggcgacccccaacggaagaaactcactgggggagcgccccccaggctctacagcaggggcagggggagaaaaaaaataacaccncctctccaatacaaaagtggctctagagaaaaaaaataangggcccctgtgcgaagaaaaattgcccccccccagcgggccccacccacggaagaaaatataaggcagagaaaagatgccatctttcccaaacaaaaaaaaaacan

SEQ ID NO: 90551 - DNA, 804 bp, Zea mays
  misc_feature: Ceres CLONE 1578547
  misc_feature: Encodes the peptide sequence at SEQ ID NO. 90552
ctggagctcaccgcggtggcggccgctctagaactagtggatcccccgggctgcaggaattcgtctcacccctagaaaaagacgccgcgcgccacgacgcagcacgcccaagaaaccccgtgtcctcacaaaaaccctgcctgccggagatggccagcggcgaccttctcctccgcgcccacgccggcgccccggtcctagcgagggccttctcctgccgcctcctagtcccggcgaggcgccgcagcggactaatctcacctctggccgcttccaaggtcggcatcgccgacgtcgttgggcgggtcaggtcgggcggcgccgaccagaagaggcgacgcagggatgcgaaggagggatttgggttctccggggtggccacgaggagagaacttatcgacgacgagaaggtggagcaggacgaggaagatgaagctctcaagttgggagtggagaagaatggtggcgagacgggaggtgtggatggctcgtacctcagtgagacacggtttgatcaatgtgctatttcccctttatcgatgaaaagccgtcaaagatgctggatatgaaaaagatgactgaggtgcaggaggcaactctgcccataatttcttcaggccaaggatgttcttgcaaaggcaaagacagggaactgggaaaaccagttgcctttttgcttccaagcgattgaggttctctccactctacctcatcaagcggggtcagttacggccccctataaaattggcgggtgatgggccctaactagggagcttggcaaaccaaggggttggtgaaggccac

SEQ ID NO: 90552 - protein, 139 aa, Zea mays
  misc_feature: Ceres CLONE 1578547
MASGDLLLRAHAGAPVLARAFSCRLLVPARRRSGLISPLAASKVGIADVVGRVRSGGADQKRRRRDAKEGFGFSGVATRRELIDDEKVEQDEEDEALKLGVEKNGGETGGVDGSYLSETRFDQCAISPLSMKSRQRCWI

SEQ ID NO: 90553 - DNA, 768 bp, Zea mays
  misc_feature: Ceres CLONE 1578548
  misc_feature: Translation starting site: 584
  misc_feature: SWISSPROT Homolog: EC 4.2.1.1 Carbonate dehydratase
  misc_feature (490)..(490): n is a, c, t, g, unknown, or other
  misc_feature (491)..(491): n is a, c, t, g, unknown, or other
  misc_feature (504)..(504): n is a, c, t, g, unknown, or other
  misc_feature (514)..(514): n is a, c, t, g, unknown, or other
  misc_feature (535)..(535): n is a, c, t, g, unknown, or other
ctccccgcggtggcggccgctctagaactagtggatcccccgggctgcaggaattcgtctcacccctagaaaaagataagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcgggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaaccnntcacctcctcccntcaaggcttnctccaaagggcatggaccccnacgtcgagcgcttgaagagcggggtccagaaggtcaagacccgagtctatgacaagaagccggaagctgtcgagcctctcaagtccgggcaagagccccaagtacatggtgttcgcctgctccgactcccgcgtgtgcccgtcggtgaccctgggccctgcgcccggggagcctttaacgtccgaaaatcgcctccatggtccacacctacgacagatcaatacgccggcccg

SEQ ID NO: 90554 - DNA, 2423 bp, Zea mays
  misc_feature: Ceres CLONE 1578549
  misc_feature: Encodes the peptide sequence at SEQ ID NO. 90555
aaaacggcacagtacatcaatcccagtcccagtcccagtcccagcttacgaacgagacgaccttgtggacacctgattggaagtcaacaccccctatgagcagtcccagtttgctcatcctctgcggccgaacgcccatcacgccacgcgccccttccccaatccccatggagatctccgccggcgtcaccactgtcaccgccgtgtcgatcctcatcctcctgttgctgccgcaacccgcggcgccgttctccttcacatacaacttcacctcgccctcggacacgccgccgcccgggattgccttccagggggacgccttctacaacaaggccatccgcctcacccgcgacgagcgcctcggccccatcaccagcagcaccggccgcgccttctactcccgcgccgtcccgctcgccgaccccgtctcccgccgcccggcctccttcgtcaccgccttcgccttctccatcgccgcccccgacccggcctccgcctcgggcgacgggcttgccttcttcctctccccgttcccatccgtcctccccgaatcctcggcggggggactactcggcctcttcaattcctcctcggtccgcgccggcacgctcgtcgccgtcgagttcgatacccacaaggacgagtgggaccccagcggcgaccacgtcggcgtcgatctcggggggatcgtctcctccgccaccgccgactggcctaccagcatgaaggacggccgcacggcccacgcgcgcgtcgagtacgacggcgtcgccaagaacctcaccgtctcgctctcgtacggctccgcgcgcccgaacaccacgggtgacgtccttctctggtatgccgtcgatctgagggaccacctgccggactccgtcgccgtaggcttctccgcagccacgggcgaggccgcggagctgcaccaggtgctctactgggagttcacctccaccgtcgaccctaaggaggagacggtggtcctgtgggtggtgctagggctgtgcgctttgcttctcgtactcgtcggcgcgggcatcgtctggttcgtcaggcaatggaggaaggccggacaattcgacgacggtgacatcgaggtcgacgacgtcatgggtggcgagtacgacgagctcgcggacgagttcgttgtccagtgcggcccgagaaggttcaggtacgccgaattggcggcggccacgaagaatttcgcggaggagcggaagctcgggcaaggcgggttcggcgccgtgtaccggggcttcctgaaggaactcggctttgaggttgccatcaagagggtgtccaagggctcgacgcaggggcgcaaggagtacgccgccgaggtgcgcatcatcagccagctgcgccaccggcacctcgtccgcctcgtcggttggtgccacgagcaccggggcgacttcctgctcgtgtacgagctgatgcccaacggcagcgtcgaccaccacctctacggcaagggcctgctcctcacctggccgatgcggtacgacatatcgctgggcctcgcgtcggcgatgctctacctccacgaggagtgtccacagtgcatcgtccacagggatgtcaagcccagcaatgtcatgctggacgccgccttcaacgcgaagctcggagactttggcctcgccaagctcgtggaacatggtagccagccgtacaccactgtcctggccggcaccctgggctacttggcgccggagtgcgtgatgacaggcaaggcgagccgggagtcggacgtgtacagcttcggtgtcgttgcactggagatcgcgtgcggccgacggcccgcagagctcaacaacgagccaagcaaggcgagactggtgccttgggtgtgggaactgtatggcaagaacgccctccttgaagcagcagactggaggctgaaggggcagttcgatgagaagcagatggagcgcctgatgattgtgggtttgtggtgtgctcaccctgactatgcgcataggccaagcatcaggcaggccctgaacgtgcttacgtttgaggcgccattgccggtgctgccggagaagatgccggtgccgacgtatttccccttgcctgatctcgttgcttcgatttctgttgggggaacctcgagcgccgaggatccagatccaggtgttagtgattatgggtcctcgggtaaagtttcatcagtcagggataggctgctggagccatgagccgatgacggagttttctgtgttttactgcaaacacgaggagtgaatctacggttttcagattcaggtgtatagcatcgaaatgtattgattgttaattcataggtaagggtggcaaaataagttgtgctgttttatttttttcacatacaagtttgctatcataatatgcagttttgattttgttaaaaaaaaaaaaaaaaaaaaaaaaaaaaa

SEQ ID NO: 90555 - protein, 703 aa, Zea mays
  misc_feature: Ceres CLONE 1578549
  misc_feature (50)..(285): Pfam Name: Lectin_legB Pfam Description: Legume lectin domain
  misc_feature (371)..(641): Pfam Name: Pkinase Pfam Description: Protein kinase domain
  misc_feature: SWISSPROT Homolog: EC 2.7.11.1 Non-specific serine/threonine protein kinase
MSSPSLLILCGRTPITPRAPSPIPMEISAGVTTVTAVSILILLLLPQPAAPFSFTYNFTSPSDTPPPGIAFQGDAFYNKAIRLTRDERLGPITSSTGRAFYSRAVPLADPVSRRPASFVTAFAFSIAAPDPASASGDGLAFFLSPFPSVLPESSAGGLLGLFNSSSVRAGTLVAVEFDTHKDEWDPSGDHVGVDLGGIVSSATADWPTSMKDGRTAHARVEYDGVAKNLTVSLSYGSARPNTTGDVLLWYAVDLRDHLPDSVAVGFSAATGEAAELHQVLYWEFTSTVDPKEETVVLWVVLGLCALLLVLVGAGIVWFVRQWRKAGQFDDGDIEVDDVMGGEYDELADEFVVQCGPRRFRYAELAAATKNFAEERKLGQGGFGAVYRGFLKELGFEVAIKRVSKGSTQGRKEYAAEVRIISQLRHRHLVRLVGWCHEHRGDFLLVYELMPNGSVDHHLYGKGLLLTWPMRYDISLGLASAMLYLHEECPQCIVHRDVKPSNVMLDAAFNAKLGDFGLAKLVEHGSQPYTTVLAGTLGYLAPECVMTGKASRESDVYSFGVVALEIACGRRPAELNNEPSKARLVPWVWELYGKNALLEAADWRLKGQFDEKQMERLMIVGLWCAHPDYAHRPSIRQALNVLTFEAPLPVLPEKMPVPTYFPLPDLVASISVGGTSSAEDPDPGVSDYGSSGKVSSVRDRLLEP

SEQ ID NO: 90556 - DNA, 843 bp, Zea mays
  misc_feature: Ceres CLONE 1578552
  misc_feature (770)..(770): n is a, c, t, g, unknown, or other
ctggagctcaccgcggtggcggccgctctagaactagtggatcccccgggctgcaggaattcgtctcacccctagaaaaaaaaatcgccgcgacgaggtgctggattttgacttgctaccagaaaccggagctaaccaaatctgccgcaaaacccctcgcctgcggcttcgcgttggccggcaaacgccgctgttgccgacacttcaacgcgtacctcgcgcccccgcgctgctgatgcgatcagcgacgcaccgccgatccgagcttctgtaggaacttcaggcgtccccgtccatgggggaatgcctcctcaagaaaggcaccttcaccctccctccgattaagtggaagggccggtttccttggaccgaacccctggaactcaataaaccgggcggagaaatccccgggggagagggggggggggcacccaaaaaaaaatggggggggataccccaaggagggccccccttcttcccgggggggggagggaaaaccccttttttgcgcccccccccccaaaaaaggcgggtggtgtggggggggtttttttgggcaagggcccgggggcgaaaatccccaagaagggttcccccttaacggggcccttgggataacctcccctgggggggggggggggggcccccctcttggaaaatatagtgggggggggggaccccggaaaaatttatttttattttcccccccccccaccccaggtttggttttccaaaaaaaaattttgtgtgggaaaaaaaagggtttgtgnacccacccaaaaaaaaacttttttttttttttataaaaaaaagagagatttgggggaggaacaccctgtgggg

SEQ ID NO: 90557 - DNA, 756 bp, Zea mays
  misc_feature: Ceres CLONE 1578553
  misc_feature: SWISSPROT Homolog: EC 3.1.3.36 Phosphoinositide 5-phosphatase
ctcaccgcggtggcggccgctctagaactagtggatcccccgggctgcaggaattcgtctcacccctagaaaaattgataaatatagttgtatctaacagcttcctgaagttcactgtcccttatttccttacatgttttatacagggatgctaagactagggagcttttaaaggtatttgacatcgatggccaagtcgacttagctcgtcctgaggccccagtaatgccggaacaattcatagaggaagagattaaagcaaaacccacaaaaaaggagaaactgcaaggttctttaagtttctttcggaaatctaggaatgccttgatgggcgcagctgatgctgtacgcagggttgcaacaaaagggacatttgtggaagataatcggcgaaccgaagcggtggctcaagcaatgaatgggactatttggtctggttgtacagatggttcaattattgtgtgggatggaaatgggaatagactgcaagaatttcattaccatagctcttctgttcaatgcatagaggcactcggagagaggatctgggtgggctatgcaagtggtactattcaagttatggatgttgaaggtaaccccttcagcagatggattggtcatagctgcccagtcataagcatggcagtcggcgattcttacattttttctttggcacatcatggtggcattcgaggagggtctctaagtccccctagccctcttgatgaatatctacgctatgaattggctagcagc

SEQ ID NO: 90558 - DNA, 774 bp, Zea mays
  misc_feature: Ceres CLONE 1578554
ctccccgcggtggcggccgctctagaactagtggatcccccgggctgcaggaattcgtctcacccctagaaaaaatatacagctaatatccggaatgagcccgctcggccaaatcgaccggacctgagtgctctcgttctctctactccgctctctctcacgcgaggcagtgcatccttaatccagtgcatctttgagccgccgccgccgtgaggagctccgcccatccgtcgtcatccgtcaaatcaggtgaatctgccaccacctcttctccttccaagccccctcttctcttccccaactggcccctttcctcctccactatttgtgcttcagccaccgccaccttcctccacgcgcgtcagcggatctgctctgttttctcctcccttcaccagatctgctgggtgcagggagtttcacagtgattcctccgccgcaccgcccgacccatcaagtaatggaaaacactaataattctcctccctccacgcgcgtcagcagatctgctctattttctcctcccttcacagtgattctcttcccttcaccagatccacgcgcgtcaccagccaaagaagtattttcatgtcaggaaaatcaaataagaatcgaataatggtaggtatgcccgaagttttgaggtcctgtgttatttagcagctgagggagtggttatttgtgtgtgcttgtagttgtagcttgtggcgatgaagtcttctaggaaatcaaataagatcgaaattttgagagttcttgttgttcatgttggct

SEQ ID NO: 90559 - DNA, 894 bp, Zea mays
  misc_feature: Ceres CLONE 1578555
  misc_feature (304)..(304): n is a, c, t, g, unknown, or other
  misc_feature (305)..(305): n is a, c, t, g, unknown, or other
  misc_feature (462)..(462): n is a, c, t, g, unknown, or other
  misc_feature (472)..(472): n is a, c, t, g, unknown, or other
ctggagctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaatgaanntgtctatggagtccaaggtggcaagaagaagtctagcagtagtcgttcctccctgatgtacgaagctcccctggcctacagcatcgaagatatccgccccctgcaggcggcatccagaaagtctccgctggttactcgaacttggcgaagaaaccantccgatatcntctgtcgtcatccccatccctagtagcggagaaaaccccctggccttttcatttttgatctcccctaaacccctcccgggtaggtgggttttccggggacccaaaagatatttaaaagaacacattttcccgtttttccttcccggggggtggtggttggcatctgggggcctgaaaaacaaaggggaggcccctcccaaattggttgcttggtggccccctctcccccgttttcctttggaattggggggtcaagggggagttttaaaaaaaccgccctttggaataaacctttttcttgaaggaacccctgtttttggggggtaaacccccccgggaaagaggggaaatgcggttggcgccctctcccgggggcccccaaaaaaaaaaccctggttcttttgaacccttggtcccggggg

SEQ ID NO: 90560 - DNA, 835 bp, Zea mays
  misc_feature: Ceres CLONE 1578561
  misc_feature: Encodes the peptide sequence at SEQ ID NO. 90561
  misc_feature (444)..(444): n is a, c, t, g, unknown, or other
  misc_feature (570)..(570): n is a, c, t, g, unknown, or other
ctccccgcggtggcggccgctctagaactagtggatcccccgggctgcaggaattcgtctcacccctagaaaaaactttttgctcagcgtcacccggccgccgccacagctgttgcccagccgcttgagcaggcaaccagaccggccgccgccacagctgctgcccagccgcgagcaggcaagcaggccgtccagctccgaccagccgcacgagcagcaagcaggccgcccagctccggccagccgcacgagcagccagccgcacgactagtgcacagcagacagcaccggcaagcagccgagcagctgcttctcatccggcgccaggtccagtgcgcgcgcgccttatctgctgcagctgcttgccgtcctcgtccgtcgtccctcggcaccggcaggtccagactgacgctgcgctcagtttgaagctcctccatggtgtcngactgggacagcgacagcgactgtgaagtacgcatgattgattatcctcgcgagcgtcgtgctggtgctgctactcaggcagagaaagggaaggctatggtcgatgccggtacatcttcaagtgtngctggtgtgatgggtgatggatcgatatgggaaaccagtgaagttaaatgggaccatttgatgtgacttgggaagcatggtgagaccatatccctgggccctcatgggggctgggctttaaaggtggttttaattggtttggaccacccaaaaaagggggggggggggggggcttccaattaaaaaaaacccacccttgagggccatataattcctggggaaagggtgggaaaagccctctccctcttaaagaggggcgcaaaaa

SEQ ID NO: 90561 - protein, 66 aa, Zea mays
  misc_feature: Ceres CLONE 1578561
MVSDWDSDSDCEVRMIDYPRERRAGAATQAEKGKAMVDAGTSSSVAGVMGDGSIWETSEVKWDHLM

SEQ ID NO: 90562 - DNA, 808 bp, Zea mays
  misc_feature: Ceres CLONE 1578562
  misc_feature: Translation starting site: 202
  misc_feature: SWISSPROT Homolog: EC 5.4.2.2 Phosphoglucomutase
ctggagctcaccgcggtggcggccgctctagaactagtggatcccccgggctgcaggaattcgtctcacccctagaaaaaaccaccactccttccctgccctctcactcccgatccctcctccaccaccgcttcctccgcgtcacccctctcgtcgtcgcctcacagaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagtggtgcagatggatcagaggctactgggtgcctcatcgtgacagcgagccataaccaggtgggcctaaggaggacttcgggatcaaatacaacatgggaaatgctgcgcctgcctctgaatctggtgaccgaacagattttctctaatacaccgacaatctctgaaatactcatctccgaagaacctacaagatgttgaaaattcccggtgggcggggtccaccagcttcaatgggacccgaaggccccctttgaaggggaatgttttttaaccccaagggggaa

SEQ ID NO: 90563 - DNA, 828 bp, Zea mays
  misc_feature: Ceres CLONE 1578563
  misc_feature: Encodes the peptide sequence at SEQ ID NO. 90564
  misc_feature (356)..(356): n is a, c, t, g, unknown, or other
  misc_feature (359)..(359): n is a, c, t, g, unknown, or other
ccccgcggtggcggccgctctagaactagtggatcccccgggctgcaggaattcgtctcacccctagaaaaactcgccagggcgtcggatcggagcgagctcattctcaactcgactcaagagctctgcctcctccatcttcccttctctttctggacgttgagggcctccggggccacgctgagagatgtaggcgaatccgaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcancantcaagtatgccgacaaccggatgctcggatggcgtccgttcaaagatggagtgccagggccctacttgtggaaatcattacaggagatctacgacgaggtgctgcaagcaaggctctgcgttgcaaaaactggaagtgcagccagggtccccgggtgggggatctacggagcggacctgtccttcgtgggataggggcaattgcagcttggcaagggctaatagttcaaatccggtgtccccccgttaccaaacttttaggggggggggaagctggccaataacctccttcatttttgggccaagaacgcagtttttctttcctacccgggcaaggaaaaattaaaaaaaaattggtctccccaaattgcaatttttcccaaaaaaacgaaaaacatttgggtgggggttctccttttggggaaaaactggaaacaaaaaaaaaagcggggtttaaaatggggggataa

SEQ ID NO: 90564 - protein, 76 aa, Zea mays
  misc_feature: Ceres CLONE 1578563
  misc_feature (12)..(12): Xaa is any aa, unknown, or other
  misc_feature (13)..(13): Xaa is any aa, unknown, or other
MKTSWDVFRVAXXKYADNRMLGWRPFKDGVPGPYLWKSLQEIYDEVLQARLCVAKTGSAARVPGWGIYGADLSFVG

SEQ ID NO: 90565 - DNA, 788 bp, Zea mays
  misc_feature: Ceres CLONE 1578564
  misc_feature: Encodes the peptide sequence at SEQ ID NO. 90566
  misc_feature (788)..(788): n is a, c, t, g, unknown, or other
aagctggagctccccgcggtggcggccgctctagaactagtggatcccccgggctgcaagaattcgtctcacccctagaaaaaactgatttccttcactgtggtctcactgccgatccgtcttgctccagcggtttctgcgcgttatcactttcgtcgtgcacctctggaggggacaagagcgcggagggtccgcggtgctaccaggaggctcttcgcggtgacgaagaaggctccacgcgcttggacggccataatccaggcagctggggactccgcaagaaggttactgtgtccacagcagacgcattatttgcggaacttgctgctctcatccttcactgcccctactgtcgatcgcgggacaggtgcatcattgttccctctggtgagggccgagctctcccatcagacgctgtttaaatcgtatccaacatggcctgctgccgacggactgagacttgtcggggagcggactaaacatggatttgccttctactgcggtatccgctggcatcccagaaagagttgctgcagagggatcataggctcctggtgacgccatcgcgacagagatccacatcgaggtggccctaaggaggacttagggcatcaattccgacatgggcaaatggaggggccggcttcctgaaagtgtgtagcgaatggggcttttcgctgatgaccccgccgaatctctggaaaccgtacatcccctgaaggagcccccccggacggggtgaaactttcccgggtggccggggggtcgccaaaatatttgaattgggn

SEQ ID NO: 90566 - protein, 139 aa, Zea mays
  misc_feature: Ceres CLONE 1578564
AGAPRGGGRSRTSGSPGLQEFVSPLEKTDFLHCGLTADPSCSSGFCALSLSSCTSGGDKSAEGPRCYQEALRGDEEGSTRLDGHNPGSWGLRKKVTVSTADALFAELAALILHCPYCRSRDRCIIVPSGEGRALPSDAV

SEQ ID NO: 90567 - DNA, 1008 bp, Zea mays
  misc_feature: Ceres CLONE 1578566
  misc_feature: Encodes the peptide sequence at SEQ ID NO. 90568
  misc_feature (28)..(28): n is a, c, t, g, unknown, or other
  misc_feature (34)..(34): n is a, c, t, g, unknown, or other
  misc_feature (75)..(75): n is a, c, t, g, unknown, or other
gtggtggttggggggggggtggtgggtnaaaatnaatatattaaagaatagggtaatagaaaaaggggtgggtgntttaaagctggagctccccgcggtggcggccgctctagaatagtggatcccccgggctgcaggaattcgtctcacccctagaaaaaatccgattttgccaatgcgaccgtgaagtcccgaaactacctccgtcctctctcaccgaggaccctcgctccaagaactgagcgggaagagaggtagagaggcaagcgcacgaaagtttctgctcctagtgtcgtctcgacccgcctccgtctcctttccctctctggatctctctctgcgattctcgtcgcattggttccgttccctcacgaaaggcggtaactttctgtcgtccctgatctatctagataatggcgaccactacttcagcgaccaccgccacagcagcggccgccaccaccgccaagccgcgggggtcgtcacccgccctctgccagaaggtggccggcggcggcatgctgcgctccggggtggtgccgtcgccacacctgctgcgtggaggccccatggcgcaagccgtgggcaaagggcggacggagaacgcccgccactcgaagcaatatcaaagataatccgcccgtaccggggtgcatggaaaggaaaagggaagtaaccatcagcgctgtggaactagggcccctccaattgtggtacacctccaggcaaaccaaaggggggtaaaaattggcccctgaagaaaaaacctgggcctggtttgcgcccaaaaggaaaaactggttgggccccctccctgggcgttatttcaaaagaaaccgccaaattaagcccgtggaaacccatatttttggtaagaagggccatgtccttattccctttaaattaccccggttttatgaggattagggcaaaatcttattggtggggggggccccctatttcattgtgaaaaccgcggggggttttcctaaaaagaaaaaaccgcgg

SEQ ID NO: 90568 - protein, 73 aa, Zea mays
  misc_feature: Ceres CLONE 1578566
MATTTSATTATAAAATTAKPRGSSPALCQKVAGGGMLRSGVVPSPHLLRGGPMAQAVGKGRTENARHSKQYQR

SEQ ID NO: 90569 - DNA, 783 bp, Zea mays
  misc_feature: Ceres CLONE 1578568
ctccccgcggtggcggccgctctagaactagtggatcccccgggctgcaggaattcgtctcacccctagaaaaaatcgccccgaccaaagcttccccagacggcaggagacagcagcaggccggacgccggactcctcctccctcccccgtacgcatccactgactgagatccttcctgtgcgaaggaaatctccagttcttcggccccggccaggttttcaagtgttgcttgccccgccggagttttcctctaacccgcagtccaattggctaagaagttgatgggatcggggggactctggaaggctgtgtgagatcgcgaaagggaccgtgaattccttgcagggctgcagctattcggctgcgctgctgtatgaactgtctcgtgaacctaggactcaactcgaactctaaacaatacgtcgcgctgcctcctcatcttcctgctgcatttctcccctcagttgttaaatacatcccatttctaattctactggtaattgcggatgagaacaacagagctgctcagatggcgaaacaacgctcatatggtgaataatgctaggagaaagccactcccacctgctgctattggtaattggtggcgggttttgctggtcttggcagctcgccgaaggctcgccagaaatggcttcccttccagggttttttcatacgggggatccacccaggaaaaaaaaatggcctgggcaagaaacctcccccaccttgaactacccccgctttttgaggtttttcccggaggttcgaattcgtggggg

SEQ ID NO: 90570 - DNA, 785 bp, Zea mays
  misc_feature: Ceres CLONE 1578570
  misc_feature: Encodes the peptide sequence at SEQ ID NO. 90571
ctcaccgcggtggcggccgctctagaactagtggatcccccgggctgcaggaattcgtctcacccctagaaaaaacctcgtgttcgttcggagcgcactcacgcgcaaacagatctcccccaaatccacccgtcggcacctccgcttcaagatgcagatctttgtgaaaaccctgaccgggaagactatcaccctcgaggtggagtcgtctgacaccattgacaacgttaaggccaagatccacgacaaggagggcatccccccagaccagcagcgggtcatcttcgctggcaaacagcttgaggacgggcgcacgcttgctgactacaacatgcagaaggagagcaccctccaccttgtgctccgcctcacgagaggcatgcagatctttgtgaaaaccctgaccggcaagactatcaccctcgacgtggagtcgtctgacaccattgacgacgtcgaggactacatccctggacatgacggcatcccctcagacctgcagcggctcatctttactgggagcagcttgacggcgggcgcacccttgccgacttacacctccagaaaagagagccccctccacttggtgctaggacttcggggaaaggcttcccgatcttctttgaaaaaccctggcccgaaaaaaacatgaccccttccagggcggagtttttccaaaaacaataaaccaaacttaaagggcccacgatccacggaccaagggaggggttttccccccaaaaacaaaaaagggggttaatttctttgtttgggaaaaaaaccct

SEQ ID NO: 90571 - protein, 166 aa, Zea mays
  misc_feature: Ceres CLONE 1578570
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIHDKEGIPPDQQRVIFAGKQLEDGRTLADYNMQKESTLHLVLRLTRGMQIFVKTLTGKTITLDVESSDTIDDVEDYIPGHDGIPSDLQRLIFTGSSLTAGAPLPTYTSRKESPLHLVLGLRGKASRSSLKNPGPKKT

SEQ ID NO: 90572 - DNA, 753 bp, Zea mays
  misc_feature: Ceres CLONE 1578572
  misc_feature: Encodes the peptide sequence at SEQ ID NO. 90573
  misc_feature (718)..(718): n is a, c, t, g, unknown, or other
tggagctcaccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccgggaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatcctggacaaggagggcatccctccagaccagcagcggctcatctttgctgggaagcagcttgaggacgggcgcacgcttgccgactacaacatccagaaggagagcaccctccacttggtgctgcgcctcagggaaggcatgcagatcttcgtgaagaccctgaccggaaaaactatcaccctcgaagtgggagtcttccggacaccatcaacaacgtcaaaggccaagatcccagaacaaggnaaggggattccccaccaaaccagcaagcgggctct

SEQ ID NO: 90573 - protein, 198 aa, Zea mays
  misc_feature: Ceres CLONE 1578572
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKILDKEGIPPDQQRLIFAGKQLEDGRTLADYNIQKESTLHLVLRLREGMQIFVKTLTGKTITLEVGVFRTPSTTSKAKIPEQGKGIPHQTSKRA

SEQ ID NO: 90574 - DNA, 821 bp, Zea mays
  misc_feature: Ceres CLONE 1578574
  misc_feature: Encodes the peptide sequence at SEQ ID NO. 90575
  misc_feature (366)..(366): n is a, c, t, g, unknown, or other
ctccccgcggtggcggccgctctagaactagtggatcccccgggctgcaggaattcgtctcacccctagaaaaagcggccaaagtcgctgccctgccgagtcccgactctccacctcagccctcagggccgccggctccttcctcccctctcctccgcctcgacaagcgtcggcgagatggtgaagaggagcaagaagagcaagagcaagcgagtcacgctgcggcagaagcacaaggtgcagcgcaaggtgaaggagcaccaccgcaagaagcgcaaggaggcctagaaggccggcaaggccggccagcggatgaaggtcgagaaggaccccgggatccccaacgagtggcccttcaaggagcangagctcaaggcgctcgaagcccgacgccgcgccagcgcctcaagagctcgagctcaagaagcaagcgcgcaaagagaagggctcaaatgaagaaggcaagattgccttgaggaccaagacatttgctagtttgggcatcctgcagcttccgcacaaggggaatggaattttgcagcaaaaggaaaatgcgtcccttatttagggggcaaggatccaacgatcctttccgaaaaggtcctttccacaaaggagcttggttaaagtaaattgaggcctccgaatgtgattattggaaggttcctgaatcccaggggaacccccttgggccaccccgtttgccttgacatggaaaaaaatggggttaggaagggctaatcccaagtaaaacggaatggtactacttcctcaaccaagaaagaatctttggtccccagggaggcggggtaaaaaaatgg

SEQ ID NO: 90575 - protein, 36 aa, Zea mays
  misc_feature: Ceres CLONE 1578574
MVKRSKKSKSKRVTLRQKHKVQRKVKEHHRKKRKEA

SEQ ID NO: 90576 - DNA, 782 bp, Zea mays
  misc_feature: Ceres CLONE 1578577
  misc_feature: Translation starting site: 154
ctcaccgcggtggcggccgctctagaactagtggatcccccgggctgcaggaattcgtctcacccctagaaaaacttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccgcctgtcctcgcgctcaccgcgcgtctggcccgacctcgcgttcaactggcgggtggtggtcgccaccgtcgtcgggttcctcggttccgcgtttggcaccgtcggcggcgtcggcggaggcgggatcttcgtgcccatgctcaacctcgtcgtcggcttcgacaccaaatccgccgccgcgctctcccaatgcatgatcatgggggcctcggcgtcatcggtttggtacacctccaggtgtcgcacccgaccaagggagcgcccgtcatcgactacaagctcgcgttgctcttccagcccatgcttatgctcggcataaccatcggcgtagagctcagcgtcatcttcccatactggctaatcactgtcctcattataatccctctcgtaggcacctcgtcgagatccttctacaagggaattctgatgtggaagggaggagaaccggattca

SEQ ID NO: 90577 - DNA, 771 bp, Zea mays
  misc_feature: Ceres CLONE 1578578
  misc_feature: Encodes the peptide sequence at SEQ ID NO. 90578
  misc_feature (400)..(400): n is a, c, t, g, unknown, or other
ctcaccgcggtggcggccgctctagaactagtggatcccccgggctgcaggaattcgtctcacccctagaaaaactgccagtgccatcccattcccatccgagctgcagcgctcgacgacggggagaatagcgtggcgtgggcggcgccatgaagtacagcaaggaagataagcccgagagggcgggcggcgccggcgcagggtccagggcggtgccggtggcgctcgtcgtcgtcgtgctctgcgccttctccttctacctgggcggcatctacagcacgggacggagcctgctggactccatccagccggcgccgacggctctcctcgccctcggcgccgccacgacgacccgccgtccctccgacaacgccaggctcgggcggcactggcgtccacngcccgccgtggcgttcccccgagtgccccgccgaactacaaggactacccccccctggaccgaccccaaggggcttggggaaggtacgggaaactcccgccttaactttcttgggaggggaattgccccccccgcccccccaaacgggaaaaattggccttggtgccccccccccccaagggggttcaaaaccccccccctttccgggggggccccaaaaagaaagggaaccattgtgggggaccccaaaaacaccccccccctccaaggggggtgttcaaccccccccaaaaagttccccacccccccctttgtgggtttttctaaaaagggagagggacaacccctttcttttgggtttcccccccggg

SEQ ID NO: 90578 - protein, 207 aa, Zea mays
  misc_feature: Ceres CLONE 1578578
  misc_feature (84)..(84): Xaa is any aa, unknown, or other
MKYSKEDKPERAGGAGAGSRAVPVALVVVVLCAFSFYLGGIYSTGRSLLDSIQPAPTALLALGAATTTRRPSDNARLGRHWRPXPAVAFPRVPRRTTRTTPPWTDPKGLGEGTGNSRLNFLGRGIAPPAPPNGKNWPWCPPPPRGFKTPPLSGGAPKRKGTIVGDPKNTPPLQGGCSTPPKKFPTPPFVGFSKKGEGQPLSFGFPPR

SEQ ID NO: 90579 - DNA, 770 bp, Zea mays
  misc_feature: Ceres CLONE 1578579
  misc_feature: Encodes the peptide sequence at SEQ ID NO. 90580
  misc_feature (713)..(713): n is a, c, t, g, unknown, or other
ctccccgcggtggcggccgctctagaactagtggatcccccgggctgcaggaattcgtctcacccctagaaaaaactcccctcacctctcactaccatccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccagccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtgtggggggaggcctactacgacctcgccaccgtgctcgccttcctcagcgtcctcgccttcaccatctccgtctacatcatgtccaggcccaggcccgtgtacctcatcgacttcgcatgctacaagccggccgacgagctctaggagtccaagggcgtagtcatcgacctggcgcgctagttcagcaagttcgacgatgacagcctggcgttccagtcgcgtctgctgggcaatccggcatcggcgacaagtcntcatgccgcgctgcgtgttcaacccaaacgcagctgcgccaccatgaaagagggccc

SEQ ID NO: 90580 - protein, 137 aa, Zea mays
  misc_feature: Ceres CLONE 1578579
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGEAYYDLATVLAFLSVLAFTISVYIMSRPRPVYLIDFACYKPADEL

SEQ ID NO: 90581 - DNA, 870 bp, Zea mays
  misc_feature: Ceres CLONE 1578584
  misc_feature: Encodes the peptide sequence at SEQ ID NO. 90582
  misc_feature (541)..(541): n is a, c, t, g, unknown, or other
ctggagctcaccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggccctccgcccatcctcacggcgctcgaagtgctcgacaacgacatccgcctcgtgctcgaggtggcgcagcaccttggncgagacatgttgcgccacatccctatggacggcacggaggggctcgtccgcggccaaggcgtctcaaaactgggtcccccattaccgggccttgttggcagggctaccccttggaagtttcataaatgttatccggggacccaattgtgaaaaagggtaaataaaagaaaaaccatttcctccctattcaaatggaaaaacccctgtcttttctttggacggggcccttgaaacaaaaaatttcttgttatgggaaaaaaagggggggggatatttctttgccccccccccaaaaaggggggagaaaaatggtgcctttccgggggggg

SEQ ID NO: 90582 - protein, 175 aa, Zea mays
  misc_feature: Ceres CLONE 1578584
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGPPPILTALEVLDNDIRLVLEVAQHLGRDMLRHIPMDGTEGLVRGQGVSKLGPPLPGLVGRATPWKFHKCYPGTQL

SEQ ID NO: 90583 - DNA, 1022 bp, Zea mays
  misc_feature: Ceres CLONE 1578585
  misc_feature: Encodes the peptide sequence at SEQ ID NO. 90584
  misc_feature (13)..(13): n is a, c, t, g, unknown, or other
  misc_feature (76)..(76): n is a, c, t, g, unknown, or other
  misc_feature (77)..(77): n is a, c, t, g, unknown, or other
  misc_feature (496)..(496): n is a, c, t, g, unknown, or other
gtgggttgggttntttttttgtggtaggtggggggtaaaacaaggacgagccaagagaggtagagtggggttattnngggaagctggggctcaccccggtggcggccgctctagaacagtggatcccccgggctgcaggaattcgtctcacccctagaaaaaaccagacgccagtccaccaccgcttcccgtgcagcgccctccctctacgttcccccatttcctgtgttggcggcgatggcgcggcacttcgtgctcaacaccggcgccaagatcccctccgtggggctcggcacctggcagtctgaccccggcgtcgttggcaacgctgtctacgccgccgtcaaggcgggttaccgacatatcgattgtgccagagtttacggcaacgaaaaggagattggtttggcgctgaagaagctatttgaagagggtgtagtgaagcgagaagatctgtttatcacctctaagctatggaatgatcaccatgctcctngaagatgtgcctgaggcactaaatgacagccgtgaatgaatttgcagcattgagtaccggggatcgtttatctttatgccatttgggccagtgttggaggtcggaggaaggggaaacaaaatgacccaagcgcgctgcaaaaatgtgtggggggacggccctggtactttccccttggagcaagattggggggggggcaaattagggaaaaaaagttcgtattcgaaggctggtgggcgaaagcgagagtgggaacaaccacgttgtgagatggggtgggatggaagccatgagtcgcactgtgagaggaaaacatagggaggggggaacagaagacgcggatggcgatagaaatgtacaaacgcgatatagctatcgcaacaggcagggggggtgggagtataggggggaggagaaaaggggatactgcaggagggaggggggaggcgagacgcctagagcatgggagagcacaacgtatactgggtgagtgtaccacctcgttgagaaatccgggagtagcccc

SEQ ID NO: 90584 - protein, 90 aa, Zea mays
  misc_feature: Ceres CLONE 1578585
  misc_feature: SWISSPROT Homolog: EC 1.1.1.21 Aldehyde reductase
  misc_feature (87)..(87): Xaa is any aa, unknown, or other
MARHFVLNTGAKIPSVGLGTWQSDPGVVGNAVYAAVKAGYRHIDCARVYGNEKEIGLALKKLFEEGVVKREDLFITSKLWNDHHAPXRCA

SEQ ID NO: 90585 - DNA, 842 bp, Zea mays
  misc_feature: Ceres CLONE 1578586
  misc_feature: Translation starting site: 156
  misc_feature (381)..(381): n is a, c, t, g, unknown, or other
ctccccgcggtggcggccgctctagaactagtggatcccccgggctgcaggaattcgtctcacccctagaaaaagcgctgcttcgctggctttcggcaacgccctttaccacatctgaatctcacccacccacccacccccgcgtcccccacctcatggcgccggcgatggggctgaagcggcctgcggcgggagcaggggcggcagcagcgcagaccgtcacgctgtccgcgcctgccgtgcgggacgcggtgcgcaccgccgtaagggaggccgaggccacggcgaaggctaccgccccggccgccagggtcccggcgacggcggcagtgccggcggagatcgctagggatggggtgctgtgcctggaggaggtcgacnggaggcggtggagctatgtggtcgacgccgccggcgcccgcgtcaaggccaagggaagggaggtccgtcgcggcgcctttcatggcgtcccgctccagtccccgatgccgcccggtcgagaaaatcatgtcctttataagatcatatgttgtgccccgagggcttcccgaatagtgtcacaccttcatatggtccatacatgaactgggaaagattgaacccttttctttggtggaggcaatgggggggtttacaaaaaggaccttgcccaaacccggttggagctccccaaaccggggcgccctcggggcgcgggggcttaaaacgggattcccaaaaaatgggggcgggggttttttaaaaaaattttttttccccccccggggaaaaaattttttttttaacccggaaagcgccccccttttccgggggatctcctggaggaatttggagaaccggga

SEQ ID NO: 90586 - DNA, 793 bp, Zea mays
  misc_feature: Ceres CLONE 1578588
  misc_feature: Encodes the peptide sequence at SEQ ID NO. 90587
  misc_feature (598)..(598): n is a, c, t, g, unknown, or other
  misc_feature (601)..(601): n is a, c, t, g, unknown, or other
  misc_feature (661)..(661): n is a, c, t, g, unknown, or other
ctccccgcggtggcggccgctctagaactagtggatcccccgggctgcaggaattcgtctcacccctagaaaaaactcgcctattcatccgttcgcctctgtgcctctctgagctcgcactcgctcgtgaacgctccccgacctccgtccgtctccgtgtggtccggctcactttagcagttcagcctgctaggactctctgcgagtagcatagcagcagcttcttgcgaggcagaggcagagccttgtgttgcgttgcgtcttccttcctgcttgagcttattagttggctcgcgatggccgggcggcgtggtggtgagctccggcgggggcaaggactaccccggcaagctcaccatgttcgtgctcttcgcctgcatcgtcgccgccaccggcggcctcatctttggatacgacatcggcatctctggtggcgtgacgtcgatgaacccgttcctgatgaagttcttcccgtcggtgtaccgcaaggagcaggaggcggagcggatccagagcaaccagtactgcaagttcgacagccagctgctcaccatgttcacctcctcgctctacctggcggcgctcgtggccctcttcnttncgcgcaccgtcacccgcgtggccggccgcaagtggtccatgttcggcggcggcgtcacgnttcctggtcggcgccgcgctcaacggcgcccgcaaaggacgtgggcatgctcatcctcgggcgcgtcctccctcggggtcggcgtcggcttcgcccaccagtccggtgccgtctacctctccggaaatggcc

SEQ ID NO: 90587 - protein, 145 aa, Zea mays
  misc_feature: Ceres CLONE 1578588
  misc_feature (81)..(81): Xaa is any aa, unknown, or other
  misc_feature (82)..(82): Xaa is any aa, unknown, or other
  misc_feature (102)..(102): Xaa is any aa, unknown, or other
MFVLFACIVAATGGLIFGYDIGISGGVTSMNPFLMKFFPSVYRKEQEAERIQSNQYCKFDSQLLTMFTSSLYLAALVALFXXRTVTRVAGRKWSMFGGGVTXPGRRRAQRRPQRTWACSSSGASSLGVGVGFAHQSGAVYLSGNG

SEQ ID NO: 90588 - DNA, 829 bp, Zea mays
  misc_feature: Ceres CLONE 1578589
  misc_feature: Encodes the peptide sequence at SEQ ID NO. 90589
tggagctcaccgcggtggcggccgctctagaactagtggatcccccgggctgcaggaattcgtctcacccctagaaaaatactcccgtgtcttcccggccttcttcggatggccagacccctccttctccaaaaatcccagaataccttgggctcccgagcaggagagagcaatgcaacgagccatccggatagccgcggctgcgacaaggcgagcgctgtcgtcgtcggcggcgagggcatcaccccctcctccccgcggacccctggctcctggctggggcgccactaggtggctctgcagcgggcgggaggcgctgagctacgacgtggtgatcgtgggcgcagggcccgcggggctcgccgcggcgatccggctgaagcagctctgccgcgctgctgacaccgacctctccgtatgcgtcctggagaagggctccgaagtcggtgctcatgtgctgtcggggaatgtgtttgagccccgagccttggacgagctcattccccagtggaagcaagaggattctccaatccagagttcctgtttcatctgacaagttctggctgttaacgaaagaaccaagcttggacactaccatcctcatttggaaacaaaggaaactacgtgatcaggcttgagcaaattgttgcgttggatggccacaaaagctgaaggatttgggtgttgaaatgtatccaggtttttgctggctagggagatactttttgaagaaaaatcaaataggttccggggagtcccaacccaatggatgttgggtttggcctaaggatggggccccaaaaggggaacctttttcaccccggggggg

SEQ ID NO: 90589 - protein, 126 aa, Zea mays
  misc_feature: Ceres CLONE 1578589
  misc_feature: SWISSPROT Homolog: EC 1.5.5.1 Electron-transferring-flavoprotein dehydrogenase
MQRAIRIAAAATRRALSSSAARASPPPPRGPLAPGWGATRWLCSGREALSYDVVIVGAGPAGLAAAIRLKQLCRAADTDLSVCVLEKGSEVGAHVLSGNVFEPRALDELIPQWKQEDSPIQSSCFI

SEQ ID NO: 90590 - DNA, 795 bp, Zea mays
  misc_feature: Ceres CLONE 1578593
  misc_feature: Encodes the peptide sequence at SEQ ID NO. 90591
cggccgctctagaactagtggatcccccgggctgcaggaattcgtctcacccctagaaaaagtcggtccttctttcctctacgaaaaaaccatttttcagtataaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgatgtggtcgaggtgtctccggcaaccgccgcggctgcagggtgggcctccggccaccacaagaggaagcggagccaggttgtaccgcaagaagtgattgaaatcgatgatgatgatcctgatggagtcatacttattagtgataaagcacaggtggaaaagaataagcaaactgctgtatgtcccatggattgctcaaagcatgccaagagtggttgggttcaggacatccctggtccaagcacatatgcttcaaaatatacaggttctggggttgacctgaaagtgtttcaagacgaggcagtttacaactattctgatggctaccccttggatggatttgaaggagactatgcctatgatgaagatgagtttgaggaagagggttatgacactcccctctttgaaagggagtatcaatttgggttggcctggcaagttttaataacttcaatgttccacatggggcctggagggcttt

SEQ ID NO: 90591 - protein, 180 aa, Zea mays
  misc_feature: Ceres CLONE 1578593
MATRASKNCLCAGSSSFDDPDVVEVSPATAAAAGWASGHHKRKRSQVVPQEVIEIDDDDPDGVILISDKAQVEKNKQTAVCPMDCSKHAKSGWVQDIPGPSTYASKYTGSGVDLKVFQDEAVYNYSDGYPLDGFEGDYAYDEDEFEEEGYDTPLFEREYQFGLAWQVLITSMFHMGPGGL

SEQ ID NO: 90592 - DNA, 752 bp, Zea mays
  misc_feature: Ceres CLONE 1578594
  misc_feature: Encodes the peptide sequence at SEQ ID NO. 90593
ctggagctccccgcggtggcggccgctctagaactagtggatcccccgggctgcaggaattcgtctcacccctagaaaaaacagcagcatcctattcctcctacctcactggctcactctcgtcttggtttacaaagcctccgccgccgcaagtccactccacccgttgtccaggttagttggttggtttcaatttcgagttcgccgagcgacagcttgcgcctgccatttctcggctccgcgtgccggagctcgttcatctccagcttctccggccgttactcgctctgaaccgacgacagtaccgataaagccccgactcgccatcctccggcgacgatgccttcccgatcggattccgactccctgctggtgcgcgccgagggcatgcgcgacgcggcgttggactaccgcggccaccccgccgaccgcggcgccaccggcggctggaggtcggcgctcttcatcatagcggtggagatcgcggagcgcttcacgttctacggcgtgtcggcgaacctgatcaactacctgactggcccgctcggggagggcaccgcggcggcggctgcggccatcaacgcctggaacggggtggcgcatctgctgccgctgctgggcggggcccttgcggaaaagtggctcggccgctaccgcaccatcgtcatcgcctcgctcctctacatcctcgggtctggggtatgttggcccttttctaactttcctcctcctccgcagggggccaccagtgg

SEQ ID NO: 90593 - protein, 137 aa, Zea mays
  misc_feature: Ceres CLONE 1578594
MPSRSDSDSLLVRAEGMRDAALDYRGHPADRGATGGWRSALFIIAVEIAERFTFYGVSANLINYLTGPLGEGTAAAAAAINAWNGVAHLLPLLGGALAEKWLGRYRTIVIASLLYILGSGVCWPFSNFPPPPQGATS

SEQ ID NO: 90594 - DNA, 827 bp, Zea mays
  misc_feature: Ceres CLONE 1578595
  misc_feature: Encodes the peptide sequence at SEQ ID NO. 90595
  misc_feature (696)..(696): n is a, c, t, g, unknown, or other
ctccccgcggtggcggccgctctagaactagtggatcccccgggctgcaggaattcgtctcacccctagaaaaaccctttttccttctctcttcgtcgttgtggctcctgccttcctgcctcggcgcatcgactcgcggagagggacagcacagcgcctcctccccatcctttctccattcccagatcgaaggtccataaaaaaccatccttttgcatctgattgagcactgtctttgtgcaagagaacaatttagttgtacatacaaacaaaaagaagtgggagtatttttcagagtttattagaagagactgtttcgaggacccaggtcagagaaaggcgagaagctttagcagcggcaatggtctggtcaatggacccgcaggtgaccgtccacggcgactgggtgtcagccgtggtgccgctgatgaagctgctgtgcctggcggtgatcggcctgctcctcgccaacccgcgggtccaggtcgtgcccagggccaccttcaagctcctgagcaagctcgtcttcgcgctcttcctcccctgcctcatcttcgtccacctcggcaagtcggtcaccatagacaacgtcctgcactgggtggtcatccccgtcaacgtgctcatcagcactgccatcgggtgcgcccttgggtacatcgtggggcctgatctgcgcccgcggcgcacctgttncggtttacggtgatcatgaccggggtcggtaacacgggaaacctcccatcgcgatcatcggggcagtctgccacacaaacgacaccccttcggcgtgggtgcgacaccatgggcatcggctatgtctcgtt

SEQ ID NO: 90595 - protein, 115 aa, Zea mays
  misc_feature: Ceres CLONE 1578595
  misc_feature (112)..(112): Xaa is any aa, unknown, or other
MVWSMDPQVTVHGDWVSAVVPLMKLLCLAVIGLLLANPRVQVVPRATFKLLSKLVFALFLPCLIFVHLGKSVTIDNVLHWVVIPVNVLISTAIGCALGYIVGPDLRPRRTCXGLR

SEQ ID NO: 90596 - DNA, 816 bp, Zea mays
  misc_feature: Ceres CLONE 1578596
  misc_feature: Encodes the peptide sequence at SEQ ID NO. 90597
ctggagctcaccgcggtggcggccgctctagaactagtggatcccccgggctgcaggaattcgtctcacccctagaaaaaggggccacgcgcccacgcctctccgcatgacgcaagagccgacgtcactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggagctgcgtgcgtgctcaatgctctgtgctatgctgaactggcgtctcggttccctgctgggggttgggggagcatacttggacacggaccgcagcggttcaatgaaatcaccgcccttctggggccttcccccgggtgaatggggggaatacccatatcgggcgccaccaagcattggctccccagctttaagcaagcctacctttaaccgaggttccttggaagcctaaatcccgcgttccttggaagggggccacaatttccccaaagcctgggggtaaggcccaaggggggaaaggagagttttttttttgggggggggggggtgtgttaaaa

SEQ ID NO: 90597 - protein, 136 aa, Zea mays
  misc_feature: Ceres CLONE 1578596
MEEARDHRLSSTAGRPFLSGFCAAALRRKPLGARASAAAAATGEGLVRQLGVLDLVLLGIGASIGAGIFVVTGTVARDAGPGVTISFVLAGAACVLNALCYAELASRFPAGGWGSILGHGPQRFNEITALLGPSPG

SEQ ID NO: 90598 - DNA, 805 bp, Zea mays
  misc_feature: Ceres CLONE 1578597
  misc_feature: Encodes the peptide sequence at SEQ ID NO. 90599
tccccgcggtggcggccgctctagaactagtggatcccccgggctgcaggaattcgtctcacccctagaaaaaggggccacgcgcccacgcctctccgcatgacgcaagagccgacgtcactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggacttgtgcggcagctcggcgtcctcgacctcgtgctgctcgggatcggtgcgtccatcggcgccggcatattcgtcgtcactggcaccgtcgcccgcgacgccggtccaagtgtcacgatcagttttgctcttgctggagctgcgtgcgtgctcaatgctctgtggcatgctgaactggcgtctcggttccctgctgtggttgggggagcatacttgtacacgtacgcagcgttcaatgagatcaccgccttcttggccttcactccagttgatgggggggattaccatatcggggccaacaaggctttggctcccaaacttagccaagctaactttatttagagttcctgggaagcctaatccccggttcttggaaagggggccaattttccacacctggggttagggccacagggggagggaaattttttttgggggggggggttgggatccaaaattaaacctctct

SEQ ID NO: 90599 - protein, 158 aa, Zea mays
  misc_feature: Ceres CLONE 1578597
MEEARDHRLSSTAGRPFLSGFCAAALRRKPLGARASAAAAATGEGLVRQLGVLDLVLLGIGASIGAGIFVVTGTVARDAGPSVTISFALAGAACVLNALWHAELASRFPAVVGGAYLYTYAAFNEITAFLAFTPVDGGDYHIGANKALAPKLSQANFI

SEQ ID NO: 90600 - DNA, 851 bp, Zea mays
  misc_feature: Ceres CLONE 1578598
  misc_feature: Encodes the peptide sequence at SEQ ID NO. 90601
  misc_feature (382)..(382): n is a, c, t, g, unknown, or other
gctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcngccttgcccccgggggggaccccttcgtggcgtgcaacgagtgcgccttccccgtctgccgggactgctacgaatacgaagcgccggggagggcacgcaaaactgcccccagtgcaagactcgatacaagcgcctccagggctgccagcgtgtgaccgggtgacaaggaggaggacggcgtccattacctgggacaacaagttcaactgggacgggccatgactcgcagtcggggggccgagtccattgctctaccgcccacatgaggctacgggcggtggaagggggacccttatgtgggggcgccccaaaggttttccaggcttaaacccccaagggtttccccttcctccacccaacgggggcgaatggggggggataaacatccccccccgcggagcaacacccgcccccgggggggcccctcccttttccatgtggggggggggggggggaggaaaaaagagga

SEQ ID NO: 90601 - protein, 97 aa, Zea mays
  misc_feature: Ceres CLONE 1578598
  misc_feature: SWISSPROT Homolog: EC 2.4.1.12 Cellulose synthase (UDP-forming)
  misc_feature (47)..(47): Xaa is any aa, unknown, or other
MEASAGLVAGSHNRNELVVIRRDGDPGPKPPREQNGQVCQICGDDVXLAPGGDPFVACNECAFPVCRDCYEYEAPGRARKTAPSARLDTSASRAASV

SEQ ID NO: 90602 - DNA, 828 bp, Zea mays
  misc_feature: Ceres CLONE 1578599
  misc_feature: Encodes the peptide sequence at SEQ ID NO. 90603
ctccccgcggtggcggccgctctagaactagtggatcccccgggctgcaggaattcgtctcacccctagaaaattctgatccctcaggtcagctgggacgtgttgttggtgttgcaatgtttgttgacttggagacaagctcaggtgacataattaaagatgtaaacagcaagaagctatcaagagtgagatcttttgtttccggtgactgcgttgttatggggccatggattggacgagtgataagagcatttgatcttgtcacacttttattcagtgatggagcaaagtgtgaaatcctgttaagggattcggatgtactgaagcccattcctcctgttctttttgaagatgcaccttacttttattatcctggccaacgtgtgaggatagtcgatccgtcagtttccaagtcagcaacatggttatgtggatcatggaggcccagtagagatgatggtattgtctctcatgtcgatgtagggctggtgcatgtgaactggatcacatctgtaaccatggttgggggagataatcatccagtcctccaaacttcaggacccaaagaggctcactttgctggtatgtttcccttaccctaattggcaaactaggtgattggggtggctcttatgactgaccacaatgggatgcccctgggatggatttctgggaaagtccttggtttccttaatgaaaaaccaaaaaggtgaccccccctggccaccattgtatttttgaaacagtttaggggtcacaaattgtttccccaaaaaattttggttggttgccaaaaaacaaaaaaaccactggttgaatttccttttg

SEQ ID NO: 90603 - protein, 199 aa, Zea mays
  misc_feature: Ceres CLONE 1578599
  misc_feature: SWISSPROT Homolog: EC 6.3.2.19 Ubiquitin--protein ligase
PRGGGRSRTSGSPGLQEFVSPLENSDPSGQLGRVVGVAMFVDLETSSGDIIKDVNSKKLSRVRSFVSGDCVVMGPWIGRVIRAFDLVTLLFSDGAKCEILLRDSDVLKPIPPVLFEDAPYFYYPGQRVRIVDPSVSKSATWLCGSWRPSRDDGIVSHVDVGLVHVNWITSVTMVGGDNHPVLQTSGPKEAHFAGMFPLP

SEQ ID NO: 90604 - DNA, 807 bp, Zea mays
  misc_feature: Ceres CLONE 1578601
  misc_feature: Translation starting site: 394
  misc_feature (646)..(646): n is a, c, t, g, unknown, or other
  misc_feature (730)..(730): n is a, c, t, g, unknown, or other
  misc_feature (747)..(747): n is a, c, t, g, unknown, or other
ctccccgcggtggcggccgctctagaactagtggatcccccgggctgcaggaattcgtctcacccctagaaaaagactctctatgcgcgtccatgtgcttctgcttcctgggttcttccgggcggttctgagtactgctgatcctttaaggctcgaacaccacgccccccgccggccccccacttcaaaatccgactgtgagttgagacttagagataatccaccaccaccgggcgagcttgctggtgcaccagcacaaaaagggcgaggcagcggcagaggatgcgctgccagctgaagagtcatgcggcagcatgatgaaggagctccggggccgcttggcacactacgcctgtcaacaccgaaagaactggcacgatcgcgctgctccatatgcttgcatgcttcgcgctcgtatcctgcctcctgctgctgcttactggcacccccgtctccgccaccatggacgagctgctgctcctagggaggagggcgcgtcacgactacggcgcaccggcaccgcggtgcgccgacgtggacaacgacaccgtctgcgtggacagctcgctgctcgcacgacgtctgcgtgatggtccgtgacatccagcacccagcccgcctcacaatgactcgtcctgctcctgcntcccaactagtactagaccgtcgacgacaagcccatccactcatacacgctctaggtgggagtccagcatcatgagcagcatcnaatagttgctcctccgntcggacccagaggtgacgaccagccgctcctacgtcggccaaaaataccccgccattggt

SEQ ID NO: 90605 - DNA, 904 bp, Zea mays
  misc_feature: Ceres CLONE 1578602
  misc_feature: Encodes the peptide sequence at SEQ ID NO. 90606
gagctccccgcggtggcggccgctctagaactagtggatcccccgggctgcaggaattcgtctcacccctagaaaaaacccccctttcccgttcgttcccaggacgagtcacagcagccggccagccgcacagagtggtggagcctaggaacagaggaggcgccgagccatctccgcagcctgcgaccggggaacgggcgggaacggacttctaacttagagagagcgcgggcgagagaggtcaaccgcagccggaggcgatggaggtggtggcgctggtgagcggcggcaaggacagctgcttcgccatgatgcgatgcatggactacggccacaaagttgtcgctttggctaatcttatccccctcgacgacaccgtcgatgagctcgacagctacatgtaccaaactgtgggggcaccagatgggggtgagctaccccaaaatggatggggcttgccctctttttcgggaaggcccatttcccgggatccccacaggggtaacagggggcctccaggtaccagggtcccccgcccggggggattaagggtaaaaaaaaaaattgttttggccccctgtgtgggacggaggggggttaaaacaggcggaaaatccccctccccccttaatggggcggggggtcctcccgaggggggcaaatccccccctccccgtttttcaacaaaagagcccccccggggtttaaaaaaaatttttttctcccaaaaagaggtggggcccccggcccccccccgggggggggttttttttgtgggaaggagggggagaaaaaaaacttttttccccaccataaaaaaaaaataaataaaaggaggggggctttttgtgcacaaaaattattgggagagatggttctcccccgccggggggaaaaaaaaccc

SEQ ID NO: 90606 - protein, 188 aa, Zea mays
  misc_feature: Ceres CLONE 1578602
MEVVALVSGGKDSCFAMMRCMDYGHKVVALANLIPLDDTVDELDSYMYQTVGAPDGGELPQNGWGLPSFSGRPISRDPHRGNRGPPGTRVPRPGGLRVKKKIVLAPCVGRRGVKTGGKSPSPLNGAGGPPEGGKSPPPRFSTKEPPRGLKKIFFSQKEVGPPAPPRGGVFFVGRRGRKKTFFPTIKKK

SEQ ID NO: 90607 - DNA, 786 bp, Zea mays
  misc_feature: Ceres CLONE 1578604
  misc_feature: Translation starting site: 163
  misc_feature: Pfam Name: WLM Pfam Description: WLM domain
  misc_feature (683)..(683): n is a, c, t, g, unknown, or other
ctccccgcggtggcggccgctctagaactagtggatcccccgggctgcaggaattcgtctcaccccctagaaaaagacgccgacgcggacgcggtcacgcctttttttttcagccggctggttcacgtgctcgacgacggcgagcgtctgtctaggagcaagatggaagggaacaggatagctcggttttcggtcacctggaggggcagccaacttgatgtggatgcggatccaagttgtaccgtcaaagagtttgggcaactgttgcaggacttgactagtgttaagccagagacgttgaagctcattgttccacaatctacaaacaaaggctccaagctgatcatgccattttcggatgcacattcgagattgacactgaatggagtgggtattagcgagggaaaacctatccgaatgatgggagtttatgatgatgaaatcgaggaggtatccgacaatggcaaaagacctgaccaacgcattattggatttgatgaagaagaacagcggcttaggcaaagatcattaggcaggccacagatttcactcaaacttccccagggacaatacatccttctgcgattttcagacgcttcacttacctgggattgagctgaatccctcacccttcggaagctctgaaacgaatgcacatgcttgcatgcgacccctggtggtanttgcgatcatgaaaaagctaaatgggagagtccgaatcatgactgagtatgctcctggttggaattgtaagcatcagtccaaaatggatttttaggtttcaaa

SEQ ID NO: 90608 - DNA, 764 bp, Zea mays
  misc_feature: Ceres CLONE 1578605
  misc_feature: Translation starting site: 316
  misc_feature: SWISSPROT Homolog: EC 1.2.1.70 Glutamyl-tRNA reductase
  misc_feature (673)..(673): n is a, c, t, g, unknown, or other
ctcaccgcggtggcggccgctctagaactagtggatcccccgggctgcaggaattcgtctcacccctagaaaaagatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcataggctgccagcgtcgccgcccctcgagcagttcaagatatccgccgaccggtacatgaaggaaaggagtaccatagctgtgataggcctcagtgtacacacagcaccagtggagatgcgtgaaaaacttgctgttgcagaggaactgtggcccccgtgctatcaagaactcactagctgaaccatnatgaaagagctgcgctgtctagtacctgtaatagaatggaaatttatgtggtggcgctatcatgggaacgtgggtatcagagaagtagggg

SEQ ID NO: 90609 - DNA, 1108 bp, Zea mays
  misc_feature: Ceres CLONE 1578610
  misc_feature: Encodes the peptide sequence at SEQ ID NO. 90610
  misc_feature (779)..(779): n is a, c, t, g, unknown, or other
  misc_feature (1108)..(1108): n is a, c, t, g, unknown, or other
gttgttgttgtggtgtgttggcaggggcacctttaaaagtaagattgtcgaggtccgtttttgttaattgttttaaaactggagctcaccgcggtggcggccgctctagaactagtggatcccccgggctgcaggaattcgtctcacccctagaaaaaatcaccatagacccagttgatccccaaaggcccatggttttctccgacgccgcgtcgcctctcgtagccaccgccgctgactctgcttcctcctgcgtcgaccacctcccctgctgctgtcgcgttacttgttgccgttgttgttgaagacgcgtagctccctagggttcgtgatttctcgccgatcggttcgggaactggtaagctatggatctctcacgagccgcatcgtcagacctctcgctcgggctgcactctaatgcccagccccacgctcgcatgaatgcgggagccgctcccatgcgcctgttcgaggacccgaagacggaacgccctcgtggcccgcggaggggctaacgcggcatagggaaccaacggcggaccggttggcgacccaaagctttctcccccctcttaaggggaacttgacccctcgccgtcaaaacggccccaaaaccccgtccccccgttcaaaaagaccggctccggcgcccccgaagcggagtggggtaataacaacaccctccataaccaagggccttgcggtcaccccccggaggacacctatagggtataacattccgagcgcataaacaccgggttcataggagaaagaaactntggacacgttaaagaaatatgaggcgggaacgcccccggatatccctgtgggaaaaaaaggaaatacccttcccatccacaccgcgagatacacttatatccacaggtgggcggctaagcaccaaaggtctcccctggagggagggaacgggcccggaacccccccaattagtatacactcccccacgcaggtattaggtgagcccaggaaagagttctaatccctttccatggcgatgctggtcggacattgaatggctctcccaccccaggacacgcgataaaaccttccctaggaaacaaccgccccgtggtcgtccgaataggcn

SEQ ID NO: 90610 - protein, 49 aa, Zea mays
  misc_feature: Ceres CLONE 1578610
MDLSRAASSDLSLGLHSNAQPHARMNAGAAPMRLFEDPKTERPRGPRRG

SEQ ID NO: 90611 - DNA, 797 bp, Zea mays
  misc_feature: Ceres CLONE 1578612
  misc_feature: Encodes the peptide sequence at SEQ ID NO. 90612
ctggagctcaccgcggtggcggccgctctagaactagtggatcccccgggctgcaggaattcgtctcacccctagaaaaaaccagctctcactcttatccgcctgcgcgcccaccgcgccgcccacccgcgcccaccccagcgccccaaataccgctccaaccctagcctcccgccacgcctttcgatctcgggcggccatgggcaactgctgccgctcgccgaccaccatcgcgtgggaggacgtcagctcctcgcacttccccgcatccaacgcaaagaagaagccgcaccaagcgcggaacggcggcggcggcgacgggcagaagcggctctcggttctggccgggcgacgaggggtgcgaggtcatcgggatcgatgacaagtacgtcctggacagggagctcgaccgcggggagttcggggtgacatacctgtgtatggatcgggacaccaaggagctgctcgcctgcaagtccatctccaagcgcaagctgcggacggccatcgacgtggaggacgtgcgccggggagtggccatcatgcgccacctgccaagagcccgagcgtcatgtccctgcgggaagcgtgccgggaacaagggcaccgtcccccctcgccatggtagctcttccaaggggcggcgagctcttgggaaccgcatcgtccccgcaaggggcaccttacacccaaagggcgcccgccccccaatggtcacccccgacccattcgttcggggggtcggtcccagatctttgggccttgggggaatgggaaattcttttccaccgggggaa

SEQ ID NO: 90612 - protein, 119 aa, Zea mays
  misc_feature: Ceres CLONE 1578612
  misc_feature: SWISSPROT Homolog: EC 2.7.11.1 Non-specific serine/threonine protein kinase
MDRDTKELLACKSISKRKLRTAIDVEDVRRGVAIMRHLPRARASCPCGKRAGNKGTVPPRHGSSSKGRRALGNRIVPARGTLHPKGARPPMVTPDPFVRGVGPRSLGLGGMGNSFPPGE

SEQ ID NO: 90613 - DNA, 796 bp, Zea mays
  misc_feature: Ceres CLONE 1578613
ctccccgcggtggcggccgctctagaactagtggatcccccgggctgcaggaattcgtctcacccctagaaaaaaccagctctcactcttatccgcctgctcgcccatcgagccgtccacccgcgcgcacgccagcgccttaaataccgctccaaccctagcctaccgccacgcctttcgatctagggcagccataggaaactgctgcccctctcccactaccatcgagtgggaggacgtcagctccgcgcacttacccgcactccaacgcaaagaagaagccgcaccaagcgcggaacggcggccacggcaacgagcacaagcagctctcggttctggccgagagacggacggtgtgcgaagtcatcgctatcgatgacaaatacctcctgcacagggagctccaccgagctcagttctggagagacatacctgcgtatagatcgctcacaataggagctgctcacctcgcgatccatatcacagcgctagctggggacggccatctacgtggaagacatgcgactgtgaggcggccaacaaacgccacctgcccaagagccagagcgtcgtgtccctgcagaaggcgtgctgctacgagcgcaccatctacctcgacatgcagatctgcatagtggagctatctcatggaccgcatcatctggaaagggcactacatcgagtgcgacacctgctaatgtaaacctgaccctggtcatgggcttgcacttcttccaacagaaataaatcatcctccccggaactccggaaagaaaaccccctcgttcacgaagaa

SEQ ID NO: 90614 - DNA, 793 bp, Zea mays
  misc_feature: Ceres CLONE 1578614
  misc_feature: Encodes the peptide sequence at SEQ ID NO. 90615
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (43)..(43): n is a, c, t, g, unknown, or other
  misc_feature (44)..(44): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
nnnnnnnnnnnnnnggggggggggggnnnnnnnnnnnnggggnngggggnnnnngnnnnnnnnnnnnntnnnnnnnnnggttnnnnnnncaaagctggaactccccgacggtggcggccgctctagaactagtggatcccccgggctgcaggaattcgtctcacccctagaaaaaccgcaagcgttggatctcggtgcccaagatgccgcctgacgagtgcttcatgtgctcggacaaggagtctttggctgtgggcaccgaactacttgtgtttgggatggcacatattgtcttcagatacagtatactgacaaactcttggtcacgaggtgaggtgatgaactctcctcggtgtttatttggggtcggcaagcgtttgggtgaagaaggcattatgttggctgggtgggccactggatttctccttggggcaagggatcccttttaggcttccagccagaaagcctatttcccaaacctcctggaagaaccaccaattaccctttggggaaccacccccttccttttcccctttaggccaattgggaaaattaaaaaggggccaacccgggaaaaaaaaaaattttggccttcccttggggggggttttgggtttccccattgggggaaatgtgggggccaaaaagggttttttttaaatggggaaaaaaattttgtggggcccccggtttttttttttaaaacccaaaaaacccaaaacccccaaccccccgtttggggggttatatttttgggaaaaccccctggtggccgcgggggggggaaaaaaaa

SEQ ID NO: 90615 - protein, 81 aa, Zea mays
  misc_feature: Ceres CLONE 1578614
MPPDECFMCSDKESLAVGTELLVFGMAHIVFRYSILTNSWSRGEVMNSPRCLFGVGKRLGEEGIMLAGWATGFLLGARDPF

SEQ ID NO: 90616 - DNA, 786 bp, Zea mays
  misc_feature: Ceres CLONE 1578615
  misc_feature: Encodes the peptide sequence at SEQ ID NO. 90617
ctggagctccccgcggtggcggccgctctagaactagtggatcccccgggctgcaggaattcgtctcacccctagaaaaaaccaccctcacacttcgccctcctcccggcgaggtcgcctctgcttccgactgcgcccgaccccagtctcgcctgcgtccaccggcatggcctcacccacggtcgcctccccgacccgggcgagccccgccgacatccccaccgccgcaccctcgtcggccccccggccgcggcgcctcgcgtcggcgccgcccgcagtctacgcgtctgcgtcctcctccccggcctccgcctactccggggaccagctctccgcccccgacgcctcgagcccgctgctcgcgagcaggagcgaagagtacaggcttctgttccggctgccgcccgacgaagttctcgtgcaagattttaactgcgctctccaaagaaatatcccttcctcaagttgtcgtcttgctgggttgcctcggaagtctcgcctcccctggattggcccgcggaaaagttgggtcgggcattccccccttttcgggttgccccggtaaggaagggtggggtcgggaaaccccccccgtgggtgggggttgccccaaaaaaaaagggtggttttaaaaaaccccccccccttttttggggtttccccccccggggatttttttttttccctataaaagccgggcgtggggcccagtttttttgggggggcgcccccccccccccgggggggggcccctcttttataaaaaacacacccctccctcccccc

SEQ ID NO: 90617 - protein, 132 aa, Zea mays
  misc_feature: Ceres CLONE 1578615
MASPTVASPTRASPADIPTAAPSSAPRPRRLASAPPAVYASASSSPASAYSGDQLSAPDASSPLLASRSEEYRLLFRLPPDEVLVQDFNCALQRNIPSSSCRLAGLPRKSRLPWIGPRKSWVGHSPLFGLPR

SEQ ID NO: 90618 - DNA, 790 bp, Zea mays
  misc_feature: Ceres CLONE 1578617
  misc_feature: Encodes the peptide sequence at SEQ ID NO. 90619
  misc_feature (476)..(476): n is a, c, t, g, unknown, or other
ctggagctcaccgcggtggcggccgctctagaactagtggatcccccgggctgcaggaattcgtctcacccctagaaaaagatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccagaaggtggccggcggcggcaggcggcgctccggggtggtgcggtgcgacgccgccggcgtggaggccanggcgcaggccgtggcataggctgccagcgtcgccgccctcgagcaggtcaagatatccgccgaacggtacatgaaagaaaggagtaccatagctgtgataggccctcgtgtacccacagcacccaggggagatgcgtgaaaaaacttgctgttgccagaggatctgggggccccctggctattcaaagatctccctagccctgaaccatattgaaagaggctggctggttccttagaaccgggtaaaaaaaatgggaaatttttggtgggggggcgcttttctagggaacccgggggtaaccaaaaaaagtagg

SEQ ID NO: 90619 - protein, 57 aa, Zea mays
  misc_feature: Ceres CLONE 1578617
  misc_feature (52)..(52): Xaa is any aa, unknown, or other
MATTTSATTAAAAAATTAKPRGSSSALCQKVAGGGRRRSGVVRCDAAGVEAXAQAVA

SEQ ID NO: 90620 - DNA, 801 bp, Zea mays
  misc_feature: Ceres CLONE 1578622
  misc_feature (610)..(610): n is a, c, t, g, unknown, or other
ctccccgcggtggcggccgctctagaactagtggatcccccgggctgcaggaattcgtctcacccctagaaaaaattccacgctgccctctgcgctgcgcatggcccctggacctaactcaccactccccatctctccgcctgctggtggagtctggctggatcagacactctcctctgtgtccccctacccccctgtcccgaatcttattacctgctaattagaacttgccacctgcggctccacatgcttgtggaacgtcattgactgcgccctcacttgctacgactaccacttcttccgcgctgcgcatgtagaggacatcctggacctgaaagagctcgtagacactgaccaatggattgcctagcgcgccactctgtgttaccgcctctccgcgctccacatcgccgccgcgaatggcctgcctcaaggcgctgacagtggtcttgaatcaccggacgacccccgacatcgtaaatcgccacgtgaaatactctgctgatgctgacggcgatgcacagccagaccatctgcatgactgatgctcctgcagaccggcgcccatgatcacatgatgcgactccttccacgcgcggacctgcgtganccacgaggtgctacctggggcacatgcggctgcgtgatagtgatccatcatgtcacgccggagctcgcctgacggctgactcatggcggtatgactacgttccaccaccctgagtcacgatcagagcgcctcgacgatgcgcctcaggggcccagcagagtccggcccggtatgggttgatggggatcctt

SEQ ID NO: 90621 - DNA, 791 bp, Zea mays
  misc_feature: Ceres CLONE 1578623
  misc_feature: Translation starting site: 447
  misc_feature: SWISSPROT Homolog: EC 2.6.1.1 Aspartate transaminase
ggagctcaccgcggtggcggccgctctagaactagtggatcccccgggctgcaggaattcgtctcacccctagaaaaaatatcccatcctgatctctcctcccttcttcagtgcagcagcaggcagcagcacgccacccgccccactcctgcctccgatccgctgcttactcgccacccggagatggccaccgccgccgccttctccgtctcctcgccggcggcctccgccgtcgccgcgcgatccaaggcagagctccgcgccgtcccctgccgtcattcagttcctcctgcccattcgcgcttggtttcagtggactggggggtctgaacgtcacatgttctggctttgtttgatggctgcaggtgtttggaggaggagttaaccaggcgagaactagaactggctgccgcgtcggcatcacgcggaagaactttggccgtgtcatgatggcccttgcagtggatgtttctcgttttgaaggagtgccaatggctcctccagacccatttctgggggtttctgaagcctttaaagcagataaaagcgagctgaagctcaatcgtgggtgttggtgcctataggacagaagagctgcagccatacgtgctccatggagtcaagaaggctgaaaatcttatgttggagaaaaggagaaaaacaagagtatctttcccattggaaagttttaccccgcgttttaacaaagcaacagccaaagctttttgccttggaacctgataaaccctggttattaatccaagggacggggtttggctacccctccaagt

SEQ ID NO: 90622 - DNA, 912 bp, Zea mays
  misc_feature: Ceres CLONE 1578626
  misc_feature: Encodes the peptide sequence at SEQ ID NO. 90623
  misc_feature (315)..(315): n is a, c, t, g, unknown, or other
ctggagctcaccgcggtggcggccgctctagaactagtggatcccccgggctgcaggaattcgtctcacccctagaaaaacccctcacctctcactaccaccaccactgccccggatccataccagctgcagcagcagcgcgcgcgagttagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcntgcagtcggtgaaccctcagtacgtgcgcctcgggtaccactacctcatcagccacggcgtgtacctggccaccatccccgtcatcctgctggtgtgcgggcccctaactgggcagcctcagcccgcaactacctgtgggcgcaaggtggggggggggagggccactacaaacttgccccccgtggtttgcctttcctcggccgtccttgccttttacaatttcccgggttaaaatatggcccaggcccccaggccccggggtaacccaaatggaaatttcgcaaggtataaaagcccgggccaaaaagacctcaagggggtccaaagggggggaggttcctttcccccttgggggccaaaattcgcgggaaatttcaaaaaagaaaaaccccggggggttttccccaccccgcgtggggggggaaaaaatccgcggttggggaagaaaaaattttttattgccccgccgggggtggtgttgaaaaaccaaaaaggggggtggccccccaaaaaaagggggggcgcccccccaaagatctccccccccttttttttcgggcgggggagaaaacaatttcttaaaaaagagggggccc

SEQ ID NO: 90623 - protein, 118 aa, Zea mays
  misc_feature: Ceres CLONE 1578626
  misc_feature: SWISSPROT Homolog: EC 2.3.1.119 Icosanoyl-CoA synthase
  misc_feature (42)..(42): Xaa is any aa, unknown, or other
MAREEQALLSTEIVNRGVEPSGPDAGSPAFSVRVRRRLPDFXQSVNPQYVRLGYHYLISHGVYLATIPVILLVCGPLTGQPQPATTCGRKVGGGRATTNLPPVVCLSSAVLAFYNFPG

SEQ ID NO: 90624 - DNA, 875 bp, Zea mays
  misc_feature: Ceres CLONE 1578630
  misc_feature: Encodes the peptide sequence at SEQ ID NO. 90625
ctcaccgcggtggcggccgctctagaactagtggatcccccgggctgcaggaattcgtctcacccctagaaaaaatggcgccactgccagcaccaccgaccgcggcctccgcctccgcattcctcttctccccgccgcgaagtccgagccgctacctgcaccccaagcccaagcccaccgccaccatcctctgctcttccacctctgccgccaccgccgccggctcagcatcgccctccctctcccagcagttggagccgctctcccgcacgctcctccacgacaagcccactccgatcgcggaccgccccaccccggagcccacctgggtgaaccccaccaagcctaagcccagcgtgctctcgctccgtcgccaccggcgccgttcccctcccgcgaacacttcctccacgcccgctgcagccgctgctgcgcgccctccgcgcactacccgaaggatgcccgacctcggcgggcaccccttggacgcccttcctttcctgaagaaagcaaggggcaagggttgccgggggccgttcccccctcccgaaagggcttcccttcctgcctaaaaattagcctcccacccccgttccgtggggcgcaaaggtccggcttgtccccctccctccccccctggggttgtgcccgccgccttccccaggccggggcggcccttttcccggctgtggaaaacccatactttttctttaaaacggggcccccccttaaaaggtgtgtttcccggggcttgggggaaggcccaatggggccgcccaaccccccgaaaagcccccccccggccctgggaaaaaatggcttcgcaaaagcggggggggcgggtgccccctttgtaaaaaaaaaatagtgacctc

SEQ ID NO: 90625 - protein, 165 aa, Zea mays
  misc_feature: Ceres CLONE 1578630
MAPLPAPPTAASASAFLFSPPRSPSRYLHPKPKPTATILCSSTSAATAAGSASPSLSQQLEPLSRTLLHDKPTPIADRPTPEPTWVNPTKPKPSVLSLRRHRRRSPPANTSSTPAAAAAARPPRTTRRMPDLGGHPLDALPFLKKARGKGCRGPFPPPERASLPA

SEQ ID NO: 90626 - DNA, 797 bp, Zea mays
  misc_feature: Ceres CLONE 1578631
  misc_feature: Encodes the peptide sequence at SEQ ID NO. 90627
aaactggagctcaccgcggtggcggccgctctagaactagtggatcccccgggctgcaggaattcgtctcacccctagaaaaaatggcgccagtgccagcaccaccgacggcgacctccgcctccgcatgcctcttctccccgccgcgaagtccgagccgatacgtggaccccaagcccaagcccaccgccaccatcctctgcgcttccacttctgcagccaccgccgccagcttagcatcgccgtcccgctgccagcagatggagacgctctcccgcacgctcctccaggacaagcccactccgatcgcggaccgccccaccccggagccctcctgggtgaactccaccaaggctaagcccagcgtgctctcgctccgtcgccaccgccggcagtcacctcccgcgaacactatctccacgccgactaagacgcgggtgggcgccctcctccgactacccgaagatgccgacctccgcggcaccctggaaaccttccctctggagcaggagggggaggggggggggcaggtcaccctgcgaagggctcctgctgcagaaacaccccccccccatccgggaccaaggggaaaaacgcccccgcaccttgggggggcgggctccaaggggggggcgtttcccccttggaacctttcttcctttaaagggcgcccccaaaaatgctgaggggccgcgccaccaatggggcccccaccccaaaaagaccccccccctgggggaaagtacaacaaacggggggggggtaccccctgaaaaaaaaaggggcgctatttcttg

SEQ ID NO: 90627 - protein, 200 aa, Zea mays
  misc_feature: Ceres CLONE 1578631
MAPVPAPPTATSASACLFSPPRSPSRYVDPKPKPTATILCASTSAATAASLASPSRCQQMETLSRTLLQDKPTPIADRPTPEPSWVNSTKAKPSVLSLRRHRRQSPPANTISTPTKTRVGALLRLPEDADLRGTLETFPLEQEGEGGGQVTLRRAPAAETPPPHPGPRGKTPPHLGGAGSKGGAFPPWNLSSFKGRPQKC

SEQ ID NO: 90628 - DNA, 831 bp, Zea mays
  misc_feature: Ceres CLONE 1578632
ctccccgcggtggcggccgctctagaactagtggatcccccgggctgcaggaattcgtctcacccctagaaaaatcgcccacgtacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcagagatgttttgcgagtagtcactatacaagctttgcccgtgaaaaaacttgcctcgagggaataaaggaaagagatcacaccggtaaacatccctgccctggcagggttgtctggcaaggattttcccaagacttccccctagaaagccccaataaaactattttgggaagcctggaacagctctccttcatttttttaaaaaaacaacgaacccccccattaaacccctttccaaggcctggggttcctgggggcagaatttggctgggccttatcacaacccaaaatttctcgggacaaaggcgtgggccaaaaaacaccattttttggttggaaggaaaaaaaaatttttttgggggggaaaaagagaaccccccttgggaaaggataaaaaaaaaggaaaatatgggcacaaaaaaaggggggcttcaatatcttttttgtggggaggttttccccccacataagaaaataattttttttggggaaaaattaaaa

SEQ ID NO: 90629 - DNA, 815 bp, Zea mays
  misc_feature: Ceres CLONE 1578635
  misc_feature: Encodes the peptide sequence at SEQ ID NO. 90630
ctggagctccccgcggtggcggccgctctagaactagtggatcccccgggctgcaggaattcgtctcacccctagaaaaatctcgtctgcgccctactccccaccacttccctcccttccccgcctacaagcaagccgccccagccattcatggccatcaccaccaccatgtgtcgccgccactccacctccacctcccacccactcctctcaccgcaccactaaaaccgcctccctcactcctcacccgctccctgtccgtccatccatctcctcgccgccactctgctgccgtttgctccagctgctgccgaccggggccatgacgggcatcgacctcacccccgcggacgaggaggacaacgaggaggcggaggcgctgcctttgcccggaccccgcggccgtggcgccgtgtgcctggagctgaggcacgcgtgcgcgggccccgtcccgccactgccgcggaagggcagcaccgtcctgtacctgccgcaaggccacgtcgagcacatctgccgcgactcgccacgaaaaagcaccaccttcggcggtgccgccgcaagtgatctgccgccttgtccaacgtcaccctccaagccggacgggcccaacaaaacaaggtgtacgccgcagagtgtacgctgccctgcccccaagaaccaaaggaccccagaagaaacgggaggccccaggcggcaaggacgccgggcgtcccaggcaaggaaaaaaaggaacccgccccgcgaaccggaccaagagaaacggcgcgggtatccccattggaaagggcccccgctcctcccaaacggagaac

SEQ ID NO: 90630 - protein, 164 aa, Zea mays
  misc_feature: Ceres CLONE 1578635
MTGIDLTPADEEDNEEAEALPLPGPRGRGAVCLELRHACAGPVPPLPRKGSTVLYLPQGHVEHICRDSPRKSTTFGGAAASDLPPCPTSPSKPDGPNKTRCTPQSVRCPAPKNQRTPEETGGPRRQGRRASQARKKRNPPREPDQEKRRGYPHWKGPPLLPNGE

SEQ ID NO: 90631 - DNA, 1002 bp, Zea mays
  misc_feature: Ceres CLONE 1578636
  misc_feature: Encodes the peptide sequence at SEQ ID NO. 90632
  misc_feature (42)..(42): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttggtttgttttttttcgtagggcaagcgggggggggggnggtgggggtggggggnnnnnngctcaaggnnnaaaagctggagctccccgcggtggcggccgctctagaatagtggatcccccgggctgcaggaattcgtctcacccctagaaaaaaccattcgaaagatccctccaggaaagatttttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccagggaccccagcgtctttcttcggcttccaacagaagaagtacgggcgaagatcttcaaagacgcacctttctggggctgcccgttgccgtgatgcttgggcgagccccggaaggcggccccggtttcctggcctggtggacgcaaggcgcccccctggttcaaggcccgaaccttaccccgcgggaaggcaagggaggcgcaattgaattcggggcccggtcggggctcctcctttcctttcccacccaggggggggaaattaaccaacccttcccgcgccttccggaaaagagcctccgttccaaggggggcggcgcctttgtgggcccccccaaaaacccgccttgtggccggccgccttccggtttcccctgtgaaaagggggggaaagaggcccccccccgtgtggcgggggtcccaacaattcctctggcgctttttctcctggggggaaaaaacccccgggggccccacacggtgtttataaaaaaaaaaaaaccaccc

SEQ ID NO: 90632 - protein, 230 aa, Zea mays
  misc_feature: Ceres CLONE 1578636
  misc_feature: SWISSPROT Homolog: EC 1.14.13.93 (+)-abscisic acid 8'-hydroxylase
MAFFLALVCILVLLAIASYVQYTRWQKGKGRFGGHGRSAPLKLPPGSMGWPYLGETLQLYSQGPQRLSSASNRRSTGEDLQRRTFLGLPVAVMLGRAPEGGPGFLAWWTQGAPLVQGPNLTPREGKGGAIEFGARSGLLLSFPTQGGEINQPFPRLPEKSLRSKGGGAFVGPPKNPPCGRPPSGFPCEKGGKEAPPRVAGVPTIPLALFLLGGKNPRGPHTVFIKKKKPP

SEQ ID NO: 90633 - DNA, 745 bp, Zea mays
  misc_feature: Ceres CLONE 1578637
  misc_feature: Encodes the peptide sequence at SEQ ID NO. 90634
ctggagctcaccgcggtggcggccgctctagaactagtggatcccccgggctgcaggaattcgtctcacccctagaaaaactccgccaaatcataaccaaacgggacggtcgccggaggaagcatacccgaaactcccctcccctctccttacaataccgcgaggcggcggctgacgtcgcttagccgctttcccacaccttcgccgccgcctatactcctgcagaaatagcccgagggagggcggttgctgctgcatcgtgttcggtgttccttccctcgccgcacgcgggatccatttgacggacggaccgaccgagcggactcacccgtccaccgagagccatggggcagaggcagagccacagcaagcgggacgggagcagccacgggcggcggtcgcgctcctttcagcagcagccatcggcgcagtggggcgccggacgaggagggtactaccagcaggacccaagcaccggctactacggcgcgccggtgccacaacagggaggagggtactaccaacaggacccatgcaccggctactacggcgcgccggtgccacaacatagcaggagggtacgccgcgccgtaccgggacaagcccgccgctgtcgccgttgctgctccagcgccgcacgctgcgaagccgcggcagctggatcgccggtactcgcggatctgcgacgagtatcactcgagtggaccaggttactgatgctctagctcaagccggacttgaatca

SEQ ID NO: 90634 - protein, 126 aa, Zea mays
  misc_feature: Ceres CLONE 1578637
MGQRQSHSKRDGSSHGRRSRSFQQQPSAQWGAGRGGYYQQDPSTGYYGAPVPQQGGGYYQQDPCTGYYGAPVPQHSRRVRRAVPGQARRCRRCCSSAARCEAAAAGSPVLADLRRVSLEWTRLLML

SEQ ID NO: 90635 - DNA, 762 bp, Zea mays
  misc_feature: Ceres CLONE 1578639
  misc_feature: Encodes the peptide sequence at SEQ ID NO. 90636
ctcaccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccatgcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgtagtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttgacagggctacccttggacgcatcataaatgttattgggtgaccccattggttgagaaagggtgacctaaagacaaacccccttcctcccctattcatccgtgaaagccccctgcttttggttgaccaaggccactgaagccaccaaattccttg

SEQ ID NO: 90636 - protein, 171 aa, Zea mays
  misc_feature: Ceres CLONE 1578639
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPSPAGYLFNRAAAYASSAAAHAAPATPPPATGKTGGGKITDEFTGAGAIGQVCQVIGAVVDVRFDEGLPPILTALVVLDNNIRLVLEVAQHLGENMVRTIAMDGTEGLVRGQRVLNTGSPITVPVDRATLGRIINVIG

SEQ ID NO: 90637 - DNA, 810 bp, Zea mays
  misc_feature: Ceres CLONE 1578643
  misc_feature: Translation starting site: 193
  misc_feature: SWISSPROT Homolog: EC 3.6.1.1 Inorganic diphosphatase
  misc_feature (542)..(542): n is a, c, t, g, unknown, or other
gagctccccgcggtggcggccgctctagaactagtggatcccccgggctgcaggaattcgtctcacccctagaaaaatctccgctctgctccctccgccgtgcgctcgaacgaactccacacgaaattatccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggagacggctccgccgggaagagcggcgccggcgccggcgccagcgagtacctcatcgaggaggaggaggggctcaacgagcacaaacgtcgtcgtcaagtgcgccgagatccagaacgccatctccgaaagagcaacttcctttccttttcactgaaatacaagtatgtgggactattcatgggcatttttgctggtcctgatcttcctcctcntgggttctggttgaagaacttccagtaaccaaagagtcaaccatgccaccttccgcaggggcaaagaaggtgcaaagcctgccccttgccaatggctatctttcaagcaccatttgcccttttgtgccttggggggcaaatcaccctcctcttggttttccgggggtttcccttgggaaatcaaaagattggccccccctatggcaaaattgccccggggaacaaccctcttttggagaggcctaggaaaaagggggggttttggaaa

SEQ ID NO: 90638 - DNA, 871 bp, Zea mays
  misc_feature: Ceres CLONE 1578644
  misc_feature: Encodes the peptide sequence at SEQ ID NO. 90639
ctccccgcggtggcggccgctctagaactagtggatcccccgggctgcaggaattcgtctcacccctagaaaaaatccccggaccccgggccagtctcacctccttccctcgatcgcacgccactcccgtaggaatcccgaatccccccacccaaattcccgtctagccgtctacccgatcgccgtccttctcgctgcccgtaaaccctagcccagccctctacccccgccgtcgttgcccgtgcgctgtcgtgctcgggctgcccccgcggcgccgcgagccaaaccctagctgcctcctccagatcccgattccgcagggaagccggagaggtgagggccgccccgccgcagatggagcccgcgggggcgcgcatggagtggggcgcccgtcccgactcctcgctccgctccaatgcgcccaaggatcccgcggagcatggaaagctggggcagtcggaaggaacgagctatctacaagtagggggccggtggactgggcgaacttctgtcccatcccttttgatggggagcggaggggttaacagaggaaatcctggaaaaacgccctggaaagggtcccccggcaaccgggagggaactcccccaaacccaaaaaccaaattgggggggcccgggccttttgacccccccccaaaatttttggggggggcaaaaaaatttctccgggtttttccccaaagaaaacatccccccacctgtgggaaaaaataaaagggggaaaattttgtggggggggggggaacaaaactttcgtataaatttaaaaaaaaaaccccccggcggccggggagagaaaaaaataaaaagccgccgcgagaaagtgttccctccccagcggggggggggg

SEQ ID NO: 90639 - protein, 126 aa, Zea mays
  misc_feature: Ceres CLONE 1578644
MEPAGARMEWGARPDSSLRSNAPKDPAEHGKLGQSEGTSYLQVGGRWTGRTSVPSLLMGSGGVNRGNPGKTPWKGSPGNREGTPPNPKTKLGGPGPFDPPPKFLGGAKKFLRVFPQRKHPPTCGKK

SEQ ID NO: 90640 - DNA, 871 bp, Zea mays
  misc_feature: Ceres CLONE 1578645
ctcaccgcggtggcggccgctctagaactagtggatcccccgggctgcaggaattcgtctcacccctagaaaaatacgacagactcggccttccagggcagcaactacgaaagccttctgcgcggggtgctttcctcgcaactaatattcctgccttttgcattcaggctttgcaagtaccttgctttgggcatatatattgtgaggcctctatatatataggtggctcgaggtgatcggcagaaccacacagggaaagatggtgagcgtgcacaacgccaccacacttgttctcatgttctgcctactagcactccggagagcagactacctcgagtacggcgaccctaaccaacacgtagctcgtcgcagcaaggacgtactggggtcgggatgaccctcgccttaaaaaatccgccaaatgaccccaaaatcgacagggaaaactgccaaagcccgaaggcacttggccaaaaaactttccttaagttaccactgactgaacccggtggaaaacaagccttaaccttccttcccccaagggcgttttgccctagggggttgggggccccgcccctgggggaaaaccaaatattttcaaaaaaagggcccctctttttatatagccccctcgtggggattttccccgaaaacccctttccggggatttcccaaaaaaaaaagacatttggggcgacaaacaaaacccttttagaaaaaaaaacccctcaattttttccccccccccaaaaaaaccaaaggggttttggaaagctccccccgggagaaacaccagaaaaccctccggtttgagagaaaaagtggaaaaaaaaacacccccccgcccccctcttaaaaaataagaagaaac

SEQ ID NO: 90641 - DNA, 778 bp, Zea mays
  misc_feature: Ceres CLONE 1578647
  misc_feature: Encodes the peptide sequence at SEQ ID NO. 90642
ctcaccgcggtggcggccgctctagaactagtggatcccccgggctgcaggaattcgtctcacccctagaaaaactgctgcaacccaaccaaacccgcacgacacgacaccaagtcgaggagctcgagggcaccaatcatggccggcgtgaactccagcgtcgtcgggctcaagcccgccgcggcagtgccgcaggccgccgccgcctcatctccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggcgccaactttgcgcgcgcctacaccgtggagttcggcagctgccagttcccctacaacttcactgggtgccaggacctcgccaagcagaagaaagtccccttcatcagcgacgacctcgagattgagtgcgaggggaaggaaaattcaagtgcggctcccacgtttttctggaagtggtgaagcacctagcagcagcgtctgatgggaaatggaggagatcctccacctgtcttgtcgacccctagatatggcccaacctggcaagaaaaataaaacctcacgggggaatttggcctcattccggtttccaatcaacccccaacatcccaatcaatgaaacctcctttgaatttattaaaccggggctccaatccgtcttcca

SEQ ID NO: 90642 - protein, 145 aa, Zea mays
  misc_feature: Ceres CLONE 1578647
  misc_feature (8)..(145): Pfam Name: PsaN Pfam Description: Photosystem I reaction centre subunit N (PSAN or PSI-N)
MAGVNSSVVGLKPAAAVPQAAAASSPAKRVQLAAPEGRRAALLGLAAVFAVTATTGSAKATIFDEYLEKSKANKELNDKKRLATSGANFARAYTVEFGSCQFPYNFTGCQDLAKQKKVPFISDDLEIECEGKENSSAAPTFFWKW

SEQ ID NO: 90643 - DNA, 793 bp, Zea mays
  misc_feature: Ceres CLONE 1578649
  misc_feature: Encodes the peptide sequence at SEQ ID NO. 90644
  misc_feature (604)..(604): n is a, c, t, g, unknown, or other
  misc_feature (646)..(646): n is a, c, t, g, unknown, or other
  misc_feature (652)..(652): n is a, c, t, g, unknown, or other
  misc_feature (658)..(658): n is a, c, t, g, unknown, or other
  misc_feature (703)..(703): n is a, c, t, g, unknown, or other
  misc_feature (704)..(704): n is a, c, t, g, unknown, or other
  misc_feature (715)..(715): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (762)..(762): n is a, c, t, g, unknown, or other
  misc_feature (768)..(768): n is a, c, t, g, unknown, or other
  misc_feature (769)..(769): n is a, c, t, g, unknown, or other
  misc_feature (771)..(771): n is a, c, t, g, unknown, or other
  misc_feature (787)..(787): n is a, c, t, g, unknown, or other
ctggagctccccgcggtggcggccgctctagaactagtggatcccccgggctgcaggaattcgtctcacccctagaaaaagtcgcgctgtctacctctctctctctctctcatcacagcacagctccagctctaggctgtagagggtggaagaagcgaggtcgagtcacagaggcctgcagcaaccgtctgcgctgagcatcgaggccgcgctctgcagtctgctgtctgctctccctcgataagccgggttccaagctagctctgcagagtgtgagctctgactgaacacgaagtgattggcggcttctcatcgatcgatggttgtgttgtgctggccatctgagcgatgaaccagttcgtccctgattggagcaacatgggagacacctccaggccgctcggcgaagaagacgacctcatcgagctgctctggtgcaacggccatgtcgtcatgcagagccagagccaccggaaggtgccgccgaggccggagaaggcggcggcagtggcggctccaccagcccccgcgtccgtgccgcaagaagacgagggcggcctgtggttcccccttcgcgctggccgactcgctggacaaggacatnctctcggagttcttctgcgaggcaccgacgccggcaccggcngcggcngatgcngcgcccgcggcctggtgggtggtggaaccggcaccgaagccggcnngcagtcgtgcnggcggggacgtcccagtcccagcagaagacaacaggcnnncgcggcngcgggnncntgccccggtgtcgccnggggaa

SEQ ID NO: 90644 - protein, 148 aa, Zea mays
  misc_feature: Ceres CLONE 1578649
  misc_feature (86)..(86): Xaa is any aa, unknown, or other
  misc_feature (100)..(100): Xaa is any aa, unknown, or other
  misc_feature (102)..(102): Xaa is any aa, unknown, or other
  misc_feature (104)..(104): Xaa is any aa, unknown, or other
  misc_feature (119)..(119): Xaa is any aa, unknown, or other
  misc_feature (123)..(123): Xaa is any aa, unknown, or other
  misc_feature (136)..(136): Xaa is any aa, unknown, or other
  misc_feature (141)..(141): Xaa is any aa, unknown, or other
  misc_feature (147)..(147): Xaa is any aa, unknown, or other
MNQFVPDWSNMGDTSRPLGEEDDLIELLWCNGHVVMQSQSHRKVPPRPEKAAAVAAPPAPASVPQEDEGGLWFPLRAGRLAGQGHXLGVLLRGTDAGTGXGXCXARGLVGGGTGTEAGXQSCXRGRPSPSRRQQAXAAAGXCPGVAXG

SEQ ID NO: 90645 - DNA, 821 bp, Zea mays
  misc_feature: Ceres CLONE 1578650
  misc_feature: Encodes the peptide sequence at SEQ ID NO. 90646
  misc_feature (651)..(651): n is a, c, t, g, unknown, or other
  misc_feature (700)..(700): n is a, c, t, g, unknown, or other
  misc_feature (701)..(701): n is a, c, t, g, unknown, or other
ctggagctccccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggcggcgaaaggagaggccgccgcgcagggcgcgccatcgacgccgagggcgcaccagcagcaccgccaccccgccgcccccgccatcgccgtcagcgacagctccctcaagttcactcatgtgctcaacaacctctcgcctgctgagctgtacgagcaggccatncagtacgaagaaggggtcgttcatcacgtccaccggcgcgctggcgacnnctgtcttggtgccaagaccggggcggtctcccagggactagcgcgtcgtccaaggacgaggtcaccgcgcaggaactgtgtgtgggggcaaggggctcgcccaacatcgagaatggacga

SEQ ID NO: 90646 - protein, 217 aa, Zea mays
  misc_feature: Ceres CLONE 1578650
  misc_feature: SWISSPROT Homolog: EC 4.1.1.49 Phosphoenolpyruvate carboxykinase (ATP)
  misc_feature (161)..(161): Xaa is any aa, unknown, or other
  misc_feature (178)..(178): Xaa is any aa, unknown, or other
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAXQYEEGVVHHVHRRAGDXCLGAKTGAVSQGLARRPRTRSPRRNCVWGQGARPTSRMD

SEQ ID NO: 90647 - DNA, 798 bp, Zea mays
  misc_feature: Ceres CLONE 1578653
  misc_feature: Encodes the peptide sequence at SEQ ID NO. 90648
  misc_feature (359)..(359): n is a, c, t, g, unknown, or other
  misc_feature (489)..(489): n is a, c, t, g, unknown, or other
  misc_feature (518)..(518): n is a, c, t, g, unknown, or other
  misc_feature (543)..(543): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (598)..(598): n is a, c, t, g, unknown, or other
  misc_feature (599)..(599): n is a, c, t, g, unknown, or other
  misc_feature (609)..(609): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (626)..(626): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (674)..(674): n is a, c, t, g, unknown, or other
  misc_feature (676)..(676): n is a, c, t, g, unknown, or other
  misc_feature (691)..(691): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (772)..(772): n is a, c, t, g, unknown, or other
  misc_feature (774)..(774): n is a, c, t, g, unknown, or other
  misc_feature (778)..(778): n is a, c, t, g, unknown, or other
ctggagctccccgcggtggcggccgctctagaactagtggatcccccgggctgcaggaattcgtctcacccctagaaaaagtgctcctctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaatacctgtctcgtactatagatcagaggtccttgnatcaccaatcttggcccccaattggcccttccgggggcgggccctttggttttcccccccccccccccgggaaaaaaaaaaaaaaaacccggggggggccccccccttttattataaaaaaacaaccccntctcctttctccccccaaaaaaaaaaaanaaaatttgttttgtggggggggggnaggggggggnnnggggaaagaaaacacacaacnnnncaccccccaccnnnatagnnttcccggggnngnntgggggggnnngntgtggggaggnnnntgaggtaaggggnnnnnnnnnggaggagaggagntntggaaaaggagagantcnnnntacaaaaaaannnnnncctaaagaggggaggaggagaggnnnnnnnaaggagnnncagggaggaaggaggagggncntctnagaagagagggaggggttgt

SEQ ID NO: 90648 - protein, 65 aa, Zea mays
  misc_feature: Ceres CLONE 1578653
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTCLVL

SEQ ID NO: 90649 - DNA, 809 bp, Zea mays
  misc_feature: Ceres CLONE 1578655
ctggagctcaccgcggtggcggccgctctagaactagtggatcccccgggctgcaggaattcgtctcacccctagaaaaagaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccaaatcgcggggctggtgcttggcccctctcctgtcggcgcatgggccttcctcgggctcacagccgccgtcgccactcgcacgctcccctttcacgccgcctttctcgccttcaccaacgaagtcatctggctcatcgtcattttccttcctctttcgcgcggcggtttcgtccaagacggggcctcgggcgaccgaaatcgccacctacttccgtcaaagtggctcggggaacagcaccgctaaggccttttcctaacgggctttacccttcagcggagggctggcatcgccgcccgggccatgccccagcaaccacgg

SEQ ID NO: 90650 - DNA, 817 bp, Zea mays
  misc_feature: Ceres CLONE 1578656
  misc_feature (523)..(523): n is a, c, t, g, unknown, or other
  misc_feature (526)..(526): n is a, c, t, g, unknown, or other
  misc_feature (529)..(529): n is a, c, t, g, unknown, or other
  misc_feature (532)..(532): n is a, c, t, g, unknown, or other
  misc_feature (651)..(651): n is a, c, t, g, unknown, or other
ctccccgcggtggcggccgctctagaactagtggatcccccgggctgcaggaattcgtctcacccctagaaaaaacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtgaggctcgctccctgatcccacgcggttacttcgacttttcctttcctgattccgcgcctgatcatgctagttacttgaggatcaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcggaatgccccgtggaaggaggggaaaataaggtagggcncangcncanctgagctgagctgagcccgcgaggtttcgcggtctgcggtgcggcggcagaggtctcgccagcgcgatgggcagcggcggctccctcaggtacagctcgtacaaggcgccggggctgcnccgcgcgctgcttgaggcggcgcacgtgtcctgcctccaaggaccggtacgcgctgggccccccgctggggtgggggccagtttcggcgtgatcccggtcctggctccgacctggtcccccggggagggcccttggccttgcaattccattcgccaagggcccggg

SEQ ID NO: 90651 - DNA, 801 bp, Zea mays
  misc_feature: Ceres CLONE 1578657
  misc_feature: Translation starting site: 159
  misc_feature: SWISSPROT Homolog: EC 1.4.1.2 Glutamate dehydrogenase
ctcaccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatgggtcttatcaagatgcgtgagattgctgaagcttaccttggtagcacgatcaagaatgctgtggtcacagtccctgcccctactcatgactcacagaggcaggccacaaaagatgctgggggtgattgctgggccttatgtgctgcgtatcatcaacgagcccacagctgcagctatcggctatggtcttgacaagaaagctaccagtgtccggggagagaaatgtcctcatctttgatcttgggaaggtgggcccttggatgct

SEQ ID NO: 90652 - DNA, 786 bp, Zea mays
  misc_feature: Ceres CLONE 1578661
  misc_feature: Encodes the peptide sequence at SEQ ID NO. 90653
tggagctcaccgcggtggcggccgctctagaactagtggatcccccgggctgcaggaattcgtctcacccctagaaaaaccgtttctggcgcacagcacagtcacagtgctcggcatcttttccgctccgctctgacgctctcccactcccccacagtcccacgccctccagtcaaagcaagccgctgcttggccggccgggaaggctcggtcgcagcgccgaggaatggcggccaagccggtcaccgtcggcgacctcatccaccgcgtcgcctcttcctgcctctccaaccgcctgccgtgcaaccacaccttccgcgactccgtggacagcgactttgacgacgacgacgacgaccccttcgccgacgccgtctccagcagcgagaaatgccagcggtccccgcccgctgcggaggtcgaggaagaggaggaggaggacgagaagctcaagatctgggaggagagggagcaggagaaggagaggctggccgccgcgtccaggggcgccgagcgcgcccgcgacgctgacgcgctgatggcggatgtgttcgacgccgtctcctgggtgcgccgcgcctacgccgcgctccaggacgcgcactgcccctgggaccccgacaagatgcggaccgcggacgccgccgtggtcgccgagctccgccacctcgcgcgcctccgcgaacgcttccgccgcttcgcagccgtgggccacatcccgcgcccgaaaacgtcggcgccgccgctggccgaaagcccttgcgcgccttacgaaggcggcgctcc

SEQ ID NO: 90653 - protein, 186 aa, Zea mays
  misc_feature: Ceres CLONE 1578661
  misc_feature (90)..(186): Pfam Name: DUF641 Pfam Description: Plant protein of unknown function (DUF641)
MAAKPVTVGDLIHRVASSCLSNRLPCNHTFRDSVDSDFDDDDDDPFADAVSSSEKCQRSPPAAEVEEEEEEDEKLKIWEEREQEKERLAAASRGAERARDADALMADVFDAVSWVRRAYAALQDAHCPWDPDKMRTADAAVVAELRHLARLRERFRRFAAVGHIPRPKTSAPPLAESPCAPYEGGA

SEQ ID NO: 90654 - DNA, 970 bp, Zea mays
  misc_feature: Ceres CLONE 1578664
  misc_feature: Encodes the peptide sequence at SEQ ID NO. 90655
  misc_feature (13)..(13): n is a, c, t, g, unknown, or other
  misc_feature (58)..(58): n is a, c, t, g, unknown, or other
  misc_feature (68)..(68): n is a, c, t, g, unknown, or other
ttttttttttttntttgattgtaggtttataaaaaaaacagaggaggggctagagagntagggtcttntttttttctgggactccccgcggtggcggccgctctagaatagtggatcccccgggctgcaggaattcgtctcacccctagaaaaaaagaagccggcagagacacactggacgcactctcagacagccatggcggtcgggggcgatgccaacggcggcggcggcggggtgcgtcagcgccagcgcgggtgttcgtgcaccaaggcggacttcttcccggatgagtcgttctcgagctggtcggcgtacgggcgggcgctgcccatcacggggccccggctggcctaccgcctcacgtcgcagtcgctggagtcgacggatctgcacgaggagcgcgcccgcagcggcgcccacatgaagcaggacctcacgtggtgggacctggtgtggttcggcctcagcgccgtcatcggccacgggatcttcgtgctcactgaccaggaggccagggaggacgtcgggcccggccgtcggccgtctcctacgttcgactccggcggtctccgccatgctcttccgtctttctgcttacaccgaggtttctcgatcgagattcccccggcgccatggtgggattcctttccccgttaaattgtcgtgggggaaacctaaggcccacccttccttgggcgggttccccggggcagggggaggcaaaccttcccctggcctgggagtttccttcccatctgggcggcccccggacccgttgggccgcgccccccccgggaaggggccgtatctgtgggccaaagggttggcttaaaaccaaccgcgaccccaggggaattttttcagaaaatccaaagacattttttcccaattcttcggccccaaaaaaaaggggagaagggtgtgaaaccaccattgtgtccccgttgctctattaaatgggagagcttg

SEQ ID NO: 90655 - protein, 153 aa, Zea mays
  misc_feature: Ceres CLONE 1578664
MAVGGDANGGGGGVRQRQRGCSCTKADFFPDESFSSWSAYGRALPITGPRLAYRLTSQSLESTDLHEERARSGAHMKQDLTWWDLVWFGLSAVIGHGIFVLTDQEAREDVGPGRRPSPTFDSGGLRHALPSFCLHRGFSIEIPPAPWWDSFPR

SEQ ID NO: 90656 - DNA, 1333 bp, Zea mays
  misc_feature: Ceres CLONE 1578666
  misc_feature: Encodes the peptide sequence at SEQ ID NO. 90657
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (481)..(481): n is a, c, t, g, unknown, or other
  misc_feature (512)..(512): n is a, c, t, g, unknown, or other
  misc_feature (533)..(533): n is a, c, t, g, unknown, or other
  misc_feature (535)..(535): n is a, c, t, g, unknown, or other
  misc_feature (567)..(567): n is a, c, t, g, unknown, or other
  misc_feature (609)..(609): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (660)..(660): n is a, c, t, g, unknown, or other
  misc_feature (684)..(684): n is a, c, t, g, unknown, or other
  misc_feature (693)..(693): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (753)..(753): n is a, c, t, g, unknown, or other
  misc_feature (785)..(785): n is a, c, t, g, unknown, or other
  misc_feature (786)..(786): n is a, c, t, g, unknown, or other
  misc_feature (789)..(789): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (862)..(862): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (902)..(902): n is a, c, t, g, unknown, or other
  misc_feature (939)..(939): n is a, c, t, g, unknown, or other
  misc_feature (941)..(941): n is a, c, t, g, unknown, or other
  misc_feature (944)..(944): n is a, c, t, g, unknown, or other
  misc_feature (945)..(945): n is a, c, t, g, unknown, or other
  misc_feature (948)..(948): n is a, c, t, g, unknown, or other
  misc_feature (983)..(983): n is a, c, t, g, unknown, or other
  misc_feature (987)..(987): n is a, c, t, g, unknown, or other
  misc_feature (988)..(988): n is a, c, t, g, unknown, or other
  misc_feature (990)..(990): n is a, c, t, g, unknown, or other
  misc_feature (991)..(991): n is a, c, t, g, unknown, or other
  misc_feature (994)..(994): n is a, c, t, g, unknown, or other
  misc_feature (1010)..(1010): n is a, c, t, g, unknown, or other
  misc_feature (1015)..(1015): n is a, c, t, g, unknown, or other
  misc_feature (1016)..(1016): n is a, c, t, g, unknown, or other
  misc_feature (1017)..(1017): n is a, c, t, g, unknown, or other
  misc_feature (1018)..(1018): n is a, c, t, g, unknown, or other
  misc_feature (1028)..(1028): n is a, c, t, g, unknown, or other
  misc_feature (1043)..(1043): n is a, c, t, g, unknown, or other
  misc_feature (1044)..(1044): n is a, c, t, g, unknown, or other
  misc_feature (1072)..(1072): n is a, c, t, g, unknown, or other
  misc_feature (1073)..(1073): n is a, c, t, g, unknown, or other
  misc_feature (1076)..(1076): n is a, c, t, g, unknown, or other
  misc_feature (1080)..(1080): n is a, c, t, g, unknown, or other
  misc_feature (1081)..(1081): n is a, c, t, g, unknown, or other
  misc_feature (1118)..(1118): n is a, c, t, g, unknown, or other
  misc_feature (1123)..(1123): n is a, c, t, g, unknown, or other
  misc_feature (1124)..(1124): n is a, c, t, g, unknown, or other
  misc_feature (1126)..(1126): n is a, c, t, g, unknown, or other
  misc_feature (1127)..(1127): n is a, c, t, g, unknown, or other
  misc_feature (1128)..(1128): n is a, c, t, g, unknown, or other
  misc_feature (1129)..(1129): n is a, c, t, g, unknown, or other
  misc_feature (1161)..(1161): n is a, c, t, g, unknown, or other
  misc_feature (1164)..(1164): n is a, c, t, g, unknown, or other
  misc_feature (1165)..(1165): n is a, c, t, g, unknown, or other
  misc_feature (1166)..(1166): n is a, c, t, g, unknown, or other
  misc_feature (1167)..(1167): n is a, c, t, g, unknown, or other
  misc_feature (1194)..(1194): n is a, c, t, g, unknown, or other
  misc_feature (1211)..(1211): n is a, c, t, g, unknown, or other
  misc_feature (1213)..(1213): n is a, c, t, g, unknown, or other
  misc_feature (1219)..(1219): n is a, c, t, g, unknown, or other
  misc_feature (1240)..(1240): n is a, c, t, g, unknown, or other
  misc_feature (1267)..(1267): n is a, c, t, g, unknown, or other
  misc_feature (1272)..(1272): n is a, c, t, g, unknown, or other
  misc_feature (1273)..(1273): n is a, c, t, g, unknown, or other
  misc_feature (1330)..(1330): n is a, c, t, g, unknown, or other
  misc_feature (1331)..(1331): n is a, c, t, g, unknown, or other
ataaatttttnnnnnttataacaattattcgttgggcgcggggggggggggggggggggggggggatttgggaggtggagctcccgcggtggcggccgctctagaactagtggatccccgggctgcaggattcgtctcacccctagaaaaaagaagccggcagagacacactgcacgcacacacagacagccatggcggtcgggggcgatgccaacggcggcggcggcggggtgcgtcagcgccagcgcgggtgttcgtgcaccaaggcggacttcttcccggaggagtcgttctcgagctggtcggcgtacgggcgggcgctgcgcagcacggggccccggctggccgaccgcctcacgtcgcggtcgctggagtcgacggagctgcacgaggtgcgcgcccgcagcggcgccgacatggaagcgcgacctcacgtggtggggacctggtgtggttcgccgtccgcccggttcgcctggnccccacaacctggcccgcgcccccgggctanggcacccccgactgcgcaccnangccccgggtcgcgcggcgcgcccgcccgcccnagcccccccctccgggcgtcccgcccgtaccccgcacccttngccgacctcccgctgngnnnnctccgtgtgtgctcccgccccgcgaaaaanatagtgcgctcaacctccacgtgngtggcggcnggacagattccctcttggtcgcgcacgccctccccgccagatggatgtaaaattnnnnanaaagaacgccgctcacggtgccccgagggcgnngancaaggccgaactcgcaggatcgtcccgcgccgccagtcgcctgagttgggtgatgatatcnnannnnnnnacnttctacaccaagtcgtctgcggttagtcattatannnttntactctcgtctcctcatctcactcgtctgtccgtggncncgnnggncactccagtcgccacccgccgacgtcgggtttggngtgnnanngtntggcggtgatgatgangtttnnnntggcgggtgncgtcggtcggtgggnntctcactcgccgccgcggcgggcggcannaanaagnnagtgagagtatgtgagctgctgggcatcagcggtggngaggnntnnnnaccacatgaccatgacgaacacagcgcggagngtnnnntaggcgcgcccgtcccgcgcgcgaccnctcggtgcggatgggtnantggagngtggtgtggtggtgttggccncgcggcgaattcgcgagccgtagcttntgtgnngccgacgctggccgtgatgctgtataatggggtacgtccgaggcgccaggtcatatnnag

SEQ ID NO: 90657 - protein, 231 aa, Zea mays
  misc_feature: Ceres CLONE 1578666
  misc_feature (97)..(97): Xaa is any aa, unknown, or other
  misc_feature (107)..(107): Xaa is any aa, unknown, or other
  misc_feature (114)..(114): Xaa is any aa, unknown, or other
  misc_feature (115)..(115): Xaa is any aa, unknown, or other
  misc_feature (139)..(139): Xaa is any aa, unknown, or other
  misc_feature (145)..(145): Xaa is any aa, unknown, or other
  misc_feature (146)..(146): Xaa is any aa, unknown, or other
  misc_feature (156)..(156): Xaa is any aa, unknown, or other
  misc_feature (164)..(164): Xaa is any aa, unknown, or other
  misc_feature (186)..(186): Xaa is any aa, unknown, or other
  misc_feature (187)..(187): Xaa is any aa, unknown, or other
  misc_feature (198)..(198): Xaa is any aa, unknown, or other
  misc_feature (199)..(199): Xaa is any aa, unknown, or other
  misc_feature (220)..(220): Xaa is any aa, unknown, or other
  misc_feature (221)..(221): Xaa is any aa, unknown, or other
  misc_feature (222)..(222): Xaa is any aa, unknown, or other
  misc_feature (223)..(223): Xaa is any aa, unknown, or other
  misc_feature (224)..(224): Xaa is any aa, unknown, or other
MAVGGDANGGGGGVRQRQRGCSCTKADFFPEESFSSWSAYGRALRSTGPRLADRLTSRSLESTELHEVRARSGADMEARPHVVGTWCGSPSARFAWXPQPGPRPRAXAPPTAHXXPGSRGAPARPSPPLRASRPYPAPXADLPLXXLRVCSRPAKXIVRSTSTXVAAGQIPSWSRTPSPPDGCKIXXKERRSRCPEGXXQGRTRRIVPRRQSPELGDDIXXXXXLHQVVCG

SEQ ID NO: 90658 - DNA, 1092 bp, Zea mays
  misc_feature: Ceres CLONE 1578671
  misc_feature: Encodes the peptide sequence at SEQ ID NO. 90659
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
ggtttgtgtgnnggnnacggtggtaggcactttttgccctgatgaggggggaggggtatcnntntttttttgggggttggtggtgtggggctccccgcggtggcggccgctctagaactagtggatcccccgggctgcaggaattcgtctcacccctagaaaaaagaccgcaccgcggccacagcctcgcgtcgtcgccccacagccacgcgagccttcgccgatccgcgagcgcagatcgccgaagccaggcggcggagagggagctcgaggcggcggaggaaggcgttcgccacagtcgctgatttccctggggaagagatggggctctcctttggtaagctgttcagccgcctcttcgccaagaaggagatgaggattctcatggtcgggctcgatgccgccggtaagaacaccatcctctacaagctcaagctcggcgagatcgtcaaccaccatcccccactatccggattcaatggtgaaaaactgttgaagtataagaaacattaagccttcacctggtttggggaatggttgggggggccagggaacaaagaatccaggccccccctgggggggagggcaacctacctttttccagaaacaacaaccaggggagaccctttatttttttttgtgttgggagaggaaccaggcccaaacggaaaccaggggggaaaacccgttgtgttttggttttgaaaaaggccctctagagaaagaaatatgaaagaacccctcccccaccacagggggaaatgggccccgtggataaatgtggaaaggggaattggagaagccctctcgcccggtgtgaaacacccccctggtgggccctggtgcctcttggttaatttttttgcccctaaaaacccaatacccatgaggattcctttttcccccacaaatgggccttattttggaaaagggcgccgcgcctggaaaaaattttacccggagaaacaaagcccttgggggccctgggcaattttccccctggggaaaaaagaggcgggcgcctggggggaacattccccagaagaacacttggtggcgctaacatcctggggggaaaagggggtggttaag

SEQ ID NO: 90659 - protein, 63 aa, Zea mays
  misc_feature: Ceres CLONE 1578671
MGLSFGKLFSRLFAKKEMRILMVGLDAAGKNTILYKLKLGEIVNHHPPLSGFNGEKLLKYKKH

SEQ ID NO: 90660 - DNA, 776 bp, Zea mays
  misc_feature: Ceres CLONE 1578673
ctggagctcaccgcggtggcggccgctctagaactagtggatcccccgggctgcaggaattcgtctcacccctagaaaaaagattctccctcgttgtcttaccatgtcattgttgacgggttttcttggctatggaccgagccacaaaaatggagtgcagtactggcgcctaattttagcaggggggaggggagcgaagcctggggaggaactcgcctggctccaagaaaccagtccccattttttcatcccagtgcacccgattttgatttcattattgtctgtcttcgcggggaaccaattccgtgttccttcataagaatgtacaagatgatgcagcgggagggcctgaaatcgcatgcgccggttctcacggtggagtggacggagccgatgccaagaaccaccaggtacccccacgatagattcaccacatggcgccgggcgctggtggcgtcggcagcggctctccgactataattccagactccaatcctccggcgatagacgaccatcggcatcaggtgctccaattgcataactggggaatagggctgctcgtgctgtcctactcgatgccggaactgaaaccgccgcagtagcgctcccgcggggatgtgcccttaggaggccggggctgcaactcgaggtcgtaactacagcggggctctacaaaaatgggccctgggccaaaggcgggacccatgcccaatttcttcccgccatgggggggcggaccaacgttcgaacgaattttgaaccccccggggaacggg

SEQ ID NO: 90661 - DNA, 812 bp, Zea mays
  misc_feature: Ceres CLONE 1578678
  misc_feature: Encodes the peptide sequence at SEQ ID NO. 90662
cggccgctctagaactagtggatcccccgggctgcaggaattcgtctcacccctagaaaaaaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccggcgaggttagcccgcaaggcgtggcaactcctctccatcttcctctcccacaatcggcggggctggggccttggccctcctccctgccggcgcatggggccttcccccggggctcaacagccggccggtcgcccacttgagaaagcttccccctttaaaccgccggccttcttccgcctcttcaccaaaggaagggcattccggggccccaccggccattttccctttttttctttggggcggcggggttccttcaaaaagggggccttcgggcaaacaaaaatccccccccctatcttcctccaaaaggggccccgggaaacaaacccccctaaggcccttttcccttaggggggcttaccccccagagaaaggccccgggaattcgcg

SEQ ID NO: 90662 - protein, 153 aa, Zea mays
  misc_feature: Ceres CLONE 1578678
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPRPGEVSPQGVATPLHLPLPQSAGLGPWPSSLPAHGAFPRGSTAGRSPT

SEQ ID NO: 90663 - DNA, 793 bp, Zea mays
  misc_feature: Ceres CLONE 1578679
  misc_feature: Encodes the peptide sequence at SEQ ID NO. 90664
ctggagctccccgcggtggcggccgctctagaactagtggatcccccgggctgcaggaattcgtctcacccctagaaaaaactagcctctgctcctctgaaatggcggcggcgacttcctcttccacctacctcgccatcggccgcaaaaccctaagccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgaggagggatctgttccctccttttccctgaggcctcgccggggaatcaaaacagatccgtggtaaccggctaggggatcccacgggcctggaaaaagcccctaacttcgtgagactccactatgtgaagggaaaggtgacttgttcctgctccccgatgggcccccggggaacagctctagagccttaaggaaaaaggccgaagcatcggggatctccccttagaagaggggcaacgctggggcttactcaaggaagggtcatcgtgggcacagggccgttttctttgcatcttacaaccccggagtttcctgaaagagggggcctcccacaaaaaaaatttgccgcccctcattaaacccaaaggaggtctgggaggcgacaacccaaagggcttttcccacaggggcata

SEQ ID NO: 90664 - protein, 114 aa, Zea mays
  misc_feature: Ceres CLONE 1578679
  misc_feature: SWISSPROT Homolog: EC 1.1.1.86 Ketol-acid reductoisomerase
MAAATSSSTYLAIGRKTLSPAPSVATAATSVSFPATQHPCLVAASADRRRAVAAKVSSPSVIGTAMPSLDFETSVFKKEKVSLAGHEEYIVRGEEGSVPSFSLRPRRGIKTDPW

SEQ ID NO: 90665 - DNA, 792 bp, Zea mays
  misc_feature: Ceres CLONE 1578681
  misc_feature (717)..(717): n is a, c, t, g, unknown, or other
ctggagctccccgcggtggcggccgctctagaactagtggatcccccgggctgcaggaattcgtctcacccctagaaaaatttgttgctgcctcgcagcgacagcttgcgatctgtagatacttatgtgtatctttcccctcatctaacgcagttactacaactggagccacagtcattgggctatgaaactgctctgatttcatgtcttaagcctccactaccaaaatcaatcttctctgaacgcttaaagcatgctcaggacattggagacattgtactgaagtgcagtgccgagacagaacagattctacatgggagaagatatcctgctacagcacaaagtggatccttggccaaccttgcagacatcctgccacctcaaggccctaatatttccagcagcatgtctttgtatgtcaaaaactctgtttcttttgaaatatcgctatatactggtttcgctctgcatgcttgatgctgcagatagctacttttatgatggcttatctaaacgagtaccttgcatattctttttgtactgataatcaagccgcgttgacgagatagacacatggtcccatgattcatcactgtataaagcttcaatgaggactaccttcggttggaacctaaccgtacatgccatgcataccacaggatgatcactgttagtagcacgtcgacatgatttcagcatgaagtgactggtatgaancaccaatttcctcctttgaaagggggatatcccttcccggatctcatgatttctaggaagggctccccctttccc

SEQ ID NO: 90666 - DNA, 1055 bp, Zea mays
  misc_feature: Ceres CLONE 1578687
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (61)..(61): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (908)..(908): n is a, c, t, g, unknown, or other
ttttttttnnnncnccattgttttctattaatagatattagaattggatggttgtggtttngggggggttnnnggggaaaactggagctcaccgcggtggcggccgctctagactagtggatcccccgggctgcaggaattcgtctcacccctagaaaaacctacactttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcggagtgcagctgttgggttggtgggtaagagtgagaaggacatgaaggcgctgcggcgatccagcacctcgtcctcgccgacggccgcgtcctcccctccgtcctcatcgtggatccacatccggtcgctcctcgccgccgccgcgtcctcgtcctcgtcctcctccttcgcaccaactgcagctgggagcgcggtggctgtggtgtcggctagcggtggccgcccttcgtctttcttcctcgcccggcgttcgttcctccgccgcacctcggaagcgggggtgggtctttaaattcctcccattgggcccccggggagggaaaaagaaaaaaacgaaggccacctttttcctccgttggaaaccaagtggggagaaagaaagtttttttgtcttttgtcccagggcaaaaattgggagagaaaagggccttttccgcgtgggaatcgaggggtgggaaaagagggaaaagtctttttctccccaaaaaaaaaaagtttctcgcacaaggtggaggtggggcccttttcggtaaaacccaaagagcgcatttcaaggggccttgaaaaaggttttcagggccgcccttttcccttacacttanggaaggtccctaaaggaaatcctgtggaaataaagctcccctcgaaaaaaaaggaaaaagagaaaacctccctattccagggaattccgagagatagagggggaatacaccgtttttgaaaaaaaacccttgagaaaagaggacagt

SEQ ID NO: 90667 - DNA, 954 bp, Zea mays
  misc_feature: Ceres CLONE 1578689
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (490)..(490): n is a, c, t, g, unknown, or other
gtttgtgtgtgnnnnngangagtatgtacccacaaatacctctgaataggtatcccaaactggggnnnntnngttgttggtgtaaaaactggaactccccgcggtggcggccgctctagaactagtggatcccccgggctgcaggaattcgtctcacccctagaaaaactctcgaaaccctagtcctctgttacttctcccggcgccgccaatcccctacagttctccgccaccgccaatcccctcccgtcctccgccacctctgctgagagcgagaagagatggccggctagggtgatgggccggcaatcggcatcgatctcggcacgacctactcttgcgtcggtgtgtggcagcacgaccgtgtcgagatcatcgcctacgaccagggtaaccgcaccacaccctcgtacgtcgccttcaccgactccgagcgcctcatcggagatgcggccaagaaccaggtcgccatgaaccccatcaacaccgntctttgatgccaaaacgtctcaattggcaggaggtttaagcgatgcctcctgtcccaaagtggatatttaaagctgtgggccccttcaagggtcatttccttggggccccgggtgcagaaaaccaaatggaatagttggggtcagcccacaaaggggggggagggaaaaaaaaacaggtttttgcaacccccgaaaagaaggattcttcccctcccaatggggtttcctcaattcaaaggaatgccgctggaagaatcccccccgaaaaaccttaacccctctggggccagccaccaaatccaaaaaaatgggctggtttggcccaccgggatacccctgggccctaagttttccaaaagaacgttcttaaaaaaggggcgggggcccaacccaaaaggaattgcctggaggggttggatattgccctggcgcccctccaatgggtggccgcgcgggaattcct

SEQ ID NO: 90668 - DNA, 1116 bp, Zea mays
  misc_feature: Ceres CLONE 1578690
  misc_feature (14)..(14): n is a, c, t, g, unknown, or other
  misc_feature (15)..(15): n is a, c, t, g, unknown, or other
  misc_feature (736)..(736): n is a, c, t, g, unknown, or other
  misc_feature (801)..(801): n is a, c, t, g, unknown, or other
gtttgggggggttnnttttttgtctttatgttcagggtgcgggggggggcggcggagataaaataggggtagttgggggaaggaaagactcccctcggtggcggccgctctagaatagtggatcccccgggctgcaggaattcgtctcacccctagaaaaaaatacagtctctgctggtctcacgtggccacgttgctccgcatccgcgattccgcgaggcaaagcaacaagccgcagccgctttcggtgttctactgccgcgtagcagcggcagcggcaccgacggcatcccaaaaggcagcgacgtctgggtcggacttggaggccccggggatcggtggccaggctgagctcctcccagagtcccagtacgcctccggagtccggatccgcggagccgaccgacggcccgaagctcctctgggtcctactctccagtacccgggctcggcaagggaccggggaagcgaggacgaagcgtcccggcgtccgaacggaatcgggcgggcccggaagaagggctgaaaatcctgccccttcccgtctccgggaacggcccgaatgcccggggcctttgccccggggagaagggtgcccaaaaccgaaaaccttgtgaagccctaaagggcccccggggcaggacgggacgggcctgcctttgcctggctttggagcccctcaaattttagccccttgggcgggtccctcccccccccagttttggggcctttctangggagttcacaaaccgaaacgcgcggggtagagaaagggggcgtaaacccggaggtcaataaagntcttttaaaaaagggcggcccccccccctctaggagggatgtcggcccgggaaaaaaccgcggaggtgggacacacccccgtcgggtttttggggggggccttcacatattgtcggagttggggggggggccccccccccagaggaaaaaatagtggggggttcacgcagaactaggggaggtgccgctgtggagggccccccgggggacggaaaatttttgtctaagaacgggggagtatgggagaggtccacccccatggttttttggtgggactcgcgagccacttcattaagtattctgtgcccacaactt

SEQ ID NO: 90669 - DNA, 777 bp, Zea mays
  misc_feature: Ceres CLONE 1578692
  misc_feature: Encodes the peptide sequence at SEQ ID NO. 90670
ctcaccgcggtggcggccgctctagaactagtggatcccccgggctgcaggaattcgtctcacccctagaaaaatcgcgcacctgcctgcttgcctgcctacctacctgcgttgttgccttcttcgcctcctccccctgtggccgcaccgcagctgctgcggcggcggcagaggtgaacagcttcccgcggccttgtcctgtccggactccggggccgggaccggcagcgcagcgggctcgcgggatctcccgacccccatgcgtcggcctcggtgacagggtttgctagcggagtccatccaactataatgaattaggcacccagtacgtaatggcaacggaagtcaaacaaacttatttttcatggtcacaaggagagtcaactgaacgggatggtcctcaaggagtatctgtatcccagacacttgatcatggttccatttccttcggaagatttgaattagagtcactatcatgggagaagtggtccgtatttactaatgacaggcgcaatgaagaatttgggaaaatcaatgttttagtcgctcagaaaaaggcttattttgaagagtattacaagaagatcaggaaactaagggctcacagcagcaaaaacagcaaactgaactttatctggaatacagcggtgatgggtagtgactccagccaaacagcagatgaagagcagggtgctgatcttgaaaccccccactggatctgggagcacctgttgatgtttaagggggaaaatgttccatgtgaaacccccttcggaa

SEQ ID NO: 90670 - protein, 148 aa, Zea mays
  misc_feature: Ceres CLONE 1578692
MATEVKQTYFSWSQGESTERDGPQGVSVSQTLDHGSISFGRFELESLSWEKWSVFTNDRRNEEFGKINVLVAQKKAYFEEYYKKIRKLRAHSSKNSKLNFIWNTAVMGSDSSQTADEEQGADLETPHWIWEHLLMFKGENVPCETPFG

SEQ ID NO: 90671 - DNA, 762 bp, Zea mays
  misc_feature: Ceres CLONE 1578693
  misc_feature: Encodes the peptide sequence at SEQ ID NO. 90672
  misc_feature (667)..(667): n is a, c, t, g, unknown, or other
ctctccgcggtggcggccgctctagaactagtggatcccccgggctgcaggaattcgtctcacccctagaaaaaacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatcctgaaaggatactggacgggagcaattcagacattggagcgaattcgtaccatatgtacaaaacggacgtcagattgctcaaggaaatgggcatggacgcatataggctctctatctcttgggccagaatactgccgaagggaacaaagaaggatgtattaacccggatgggcatcagtactacagaaacctcatncactttgtgctagaaaaacgcatagagccatatgtaacaattttccactgggatgtacctcaagcactagtatgagaagtacggtgcttccctaa

SEQ ID NO: 90672 - protein, 118 aa, Zea mays
  misc_feature: Ceres CLONE 1578693
  misc_feature (9)..(117): Pfam Name: Glyco_hydro_1 Pfam Description: Glycosyl hydrolase family 1
  misc_feature: SWISSPROT Homolog: EC 3.2.1.21 Beta-glucosidase
  misc_feature (115)..(115): Xaa is any aa, unknown, or other
MLSPSEIPQRDWFPSDFTFGAATSAYQIEGAWNEDGKGESNWDHFCHNHPERILDGSNSDIGANSYHMYKTDVRLLKEMGMDAYRLSISWARILPKGTKKDVLTRMGISTTETSXTLC

SEQ ID NO: 90673 - DNA, 937 bp, Zea mays
  misc_feature: Ceres CLONE 1578694
  misc_feature: Encodes the peptide sequence at SEQ ID NO. 90674
  misc_feature (1)..(1): n is a, c, t, g, unknown, or other
  misc_feature (2)..(2): n is a, c, t, g, unknown, or other
  misc_feature (19)..(19): n is a, c, t, g, unknown, or other
  misc_feature (20)..(20): n is a, c, t, g, unknown, or other
  misc_feature (31)..(31): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (57)..(57): n is a, c, t, g, unknown, or other
  misc_feature (60)..(60): n is a, c, t, g, unknown, or other
  misc_feature (464)..(464): n is a, c, t, g, unknown, or other
nnggggtgttgggtggtgnngccccctcctntgctgttctgtggttctttnnnnttntanaaaaccctggttgtgtttgttggactccccgcggtggcggccgctctagaactagtggatcccccgggctgcaggaattcgtctcacccctagaaaaaaaagcgccgcgcctcgcccctgcacagctcacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggtggacncggcggctcggtgccggtgcccgtggcggcgcgacggcggtggcggcggccctgccggggccgaggggcctgcccgtggtcgggagcatgtggctcatgacgggcctggcgcaccccaagctcgcggcggcggcaggggagccctcggcgcccaggcgcctgatggcccttctcccctcggggcaactagggggtggtgggtggccctcgcaaccccggaacttgggcgccccgaaaatccttcaaccaagccccggcgtttcgccgggacccggccccatcaaaggaagtccggcggtaagggggctccctgtgttcccaccggggcccatttggggtttcccgcgcccctaaggggggccctaatgggggcgccgcggcttggggcccccggggggcgggtccaaagaaaccctcttttttcccccagggggggaagggtccccccccccttctgggcccgcaccaagcgc

SEQ ID NO: 90674 - protein, 178 aa, Zea mays
  misc_feature: Ceres CLONE 1578694
MATPDDRGSWLLYLSLAAKCAGEQPYRLAGFLAVCAVAFVVTCLLHWCFPGGPAWGRWWWTRRLGAGARGGATAVAAALPGPRGLPVVGSMWLMTGLAHPKLAAAAGEPSAPRRLMALLPSGQLGGGGWPSQPRNLGAPKILQPSPGVSPGPGPIKGSPAVRGLPVFPPGPIWGFPRP

SEQ ID NO: 90675 - DNA, 946 bp, Zea mays
  misc_feature: Ceres CLONE 1578697
  misc_feature: Encodes the peptide sequence at SEQ ID NO. 90676
aagctggagctccccgcggtggcggccgctctagaactagtggatcccccgggctgcaggaattcgtctcacccctagaaaaaacccatccgttccacgctccgttcaccccgtccatttgatttgcgttcactgccttgcgtttccttggaggggattgttctctcctctcctttggattggaggtccctccttcttctcctctctctctcagacgaaggcctgatgatccatgaagaggacagcattgggggaaggtgcaggtgtacgtgtcctgagccgcctcctcagcgtcaaggagcgcattggcgactcactctctgcccaccccgatgagcttgtcgccgtcctcaccatgctgaaaaaccttggaaagggtatgctgcacccccacctcatgattgccgagtacaacaatgctatccctgatgctgagcgcgataagctcaaggatggtgcttttgaggatgtcctgagggcagctcacgaggagattgtcatccccccatgggttgcacttgccatccgccctatgcctggtgtctgggagtatgtgagggtcaacgtcagtgagctcgctgttgaggagctgaccattcctgagctcctgcagttcgagaacagcttgtgcaataaaggccaacaacaactttgtcctcgagctggactttgagccattcaatgactctctcccccgtcggtctctgtatgactcattggcaatggcgtgcagttcctcacaggcaactgtcatcccagctcttctttgacatgtagagcatgtaccccgtgctcagtatcctgctcgccaaaactacggggggatgacactctgttgaacgacatactcgcggacttgtgcactgctagggaggcttaggaaagctgaggacacctgtcaccctgagctgaaacccttacctgaattcacaagggtcgcggagct

SEQ ID NO: 90676 - protein, 146 aa, Zea mays
  misc_feature: Ceres CLONE 1578697
  misc_feature: SWISSPROT Homolog: EC 2.4.1.13 Sucrose synthase
MKRTALGEGAGVRVLSRLLSVKERIGDSLSAHPDELVAVLTMLKNLGKGMLHPHLMIAEYNNAIPDAERDKLKDGAFEDVLRAAHEEIVIPPWVALAIRPMPGVWEYVRVNVSELAVEELTIPELLQFENSLCNKGQQQLCPRAGL

SEQ ID NO: 90677 - DNA, 827 bp, Zea mays
  misc_feature: Ceres CLONE 1578698
  misc_feature: Encodes the peptide sequence at SEQ ID NO. 90678
tggagctccccgcggtggcggccgctctagaactagtggatcccccgggctgcaggaattcgtctcacccctagaacgacgcagaattgcagccgaatccatcggagcccagcacggccgcaccccggccagcggccaccgcatcgcctcgtatgctccgcgcttgcacacgcgtcggcggcgcgggcgcgggcggctgcggccgacgagaacgcctcatggcctccctcatccccttcctccctccctcaccttactccactcacctcccgcgccagccccagccccagccgccgacagccgctacccaggtcgccgcagcgggcgcgcccatcccggttccgccctcctggttcgcgcgcgccgcgggcgcagcgggcagcgcgacttcgaagccggccccgcggcccaagagaggcgggtccctggccctccaaacgggggaaactgttcctgggggctggcggccccttctgcttgcccggaaccggggccccaaccttaacctttggggccccccgtggaaacaaagtggaggcaatgaacggggggtgtgtttttttggggggactctttttccccccgatggccgcgttcggtgaagggtggtgactaggctgtttatgcacattactccggttgttagcacccgagagggcgcctaagcggtgtcgctctttttttccgcaaccacccattggcggtccaggaagagggtggggcaggggggggatagaccttgttgtatgtgccccccccctccccgtcactcccgtgtttggggggtggtggtgccacgtcacgccattcaatgtatatggtgggtt

SEQ ID NO: 90678 - protein, 149 aa, Zea mays
  misc_feature: Ceres CLONE 1578698
MLRACTRVGGAGAGGCGRRERLMASLIPFLPPSPYSTHLPRQPQPQPPTAATQVAAAGAPIPVPPSWFARAAGAAGSATSKPAPRPKRGGSLALQTGETVPGGWRPLLLARNRGPNLNLWGPPWKQSGGNERGVCFFGGTLFPPDGRVR

SEQ ID NO: 90679 - DNA, 969 bp, Zea mays
  misc_feature: Ceres CLONE 1578699
  misc_feature: Translation starting site: 113
  misc_feature: SWISSPROT Homolog: EC 3.6.3.14 H(+)-transporting two-sector ATPase
tggagctccccgcggtggcggccgctctagaatagtggatcccccgggctgcaggaattcgtctcacccctagaaaaatacaatccaagtttatgaggaaacagctggactgatggttaatgaccctgtattgagaacaagaaagcctctttcagttgaattgggacctggaattcttggaaacatttttgacggtatccagcggcctctaaaaaccatcgctattaagtcaggagatgtgtatattcctcgtggtgtttcagttcctgcccttgacaaagatgtattgtgggaatttcagccaacaaagctaggtgttggagatgtcatcacaggtggagatctatacgctactgtttttgagaacacattgatgcagcaccatgttgctcttccaccgggttctatggggaaaataagttacattgcaccagctggccagtacaacctgcaggacacagtgctagaattggaatttcagggcataaaaaagaaatttaccatgcttcagacatggcctgtgcgttcaccaagggcctgttgcatcgaagcttgctgcggatacacctcttctgacagggcagcgtgtactggatgcactattcccctcggttctgggaggcacttgtgctattcccaggagcatttggctgtggtaaaactgtcattagtcaggcactttccaagtactccaattccgaagctgtggtttatgtggggctgtggtgaacgaggaaacgagatggctgaagttctcatggacttttcccagttgacgatgacattgcctgatgggccgtgagagtctgtcatgaagagaacaaactggtggctaaccatcaaacatgcctgtcgctgctcgtgaagcttcattttcccaggattacaattgccgagtatttccgtgatatggctacaacgccagtaggatggctgactccccctcccggtgggctgaggcttgccgtg

SEQ ID NO: 90680 - DNA, 1333 bp, Zea mays
  misc_feature: Ceres CLONE 1578706
  misc_feature (500)..(500): n is a, c, t, g, unknown, or other
  misc_feature (1134)..(1134): n is a, c, t, g, unknown, or other
  misc_feature (1245)..(1245): n is a, c, t, g, unknown, or other
  misc_feature (1304)..(1304): n is a, c, t, g, unknown, or other
tctgagtgaaaaaacaaaacgtgctggacgaggcaaaataaagggaagaaatgagtgggctggtcgatagtggaagctccccgcggtggcggccgctctagaactagtggatcccccgggctgcaggaattcgtctcacccctagaaaaaccagcggcatctatagcaaccggtccaacactttctcgctcaggtgctcagctctagcaatggctgactccaacatggacaatctcctccacacgcgatggtcgggtacccccatcaaagtggggttactttcggcctagggccgcatataccatgcggcaatgacctgggggtaattccaaagttggggagattagggcacccctctgtgttaagaccccgtaccgctctttagttagttcgaggtccccttcctgcgggtgaatcccccctaagactagccgtacccggtggaattcctcccggctgagctacacttcttgtgaaaacgtgttgtgggtatgataccnacaaaacccccccccccccccccccccccaaaaaacctcagaaacgtgggagtggggtattcgaccctccatccttcgagccccttgctcttcttgctgggtgtcgcgactgagcgagtagttccaccgggaggtgggggtgcgttggtggacaaagcgggggggtgatagactacgcggtgtcgatgagccctctcccttgggttgactactggcgcggtttgatatcgagaaaatcttgttctaccgtatatgtgcgcgaggccccgaggcactcttttttctttcggagtgaatactcgggatctgctttgtatgtgcgactatgcggctcatactatgcgtttacgacttgcggagactaacctgagtgtgtgacgatcgttgtcagagttgtacagtacggctcacgcgactggtggccactctccctctctctaaggtgaacgcgtactactctctctatgtgtcatgtggcgggagacagagcgtgttaccttatgacgagtaggatatcctgcgtggacattgtatccatgacgcattacccacttgaggggtatgcaagatagtattgtctacaacactcgactccctcccgcatcttgttgacgcgagatacgtatggcatggnacatggcttgtctcttcctgtgtgtaaacgcttacatgtgttatcacaatataagggtctcattttggaacaatgcgacttatatgtctctcgcccacggatgtgtatgtngtaccagtgcacgccgctgtgtgcgtatatttgtgtgtggcgtcgctggtctgcgctanttgtatctatggatgaggtatgtggctcg

SEQ ID NO: 90681 - DNA, 951 bp, Zea mays
  misc_feature: Ceres CLONE 1578707
ggagctccccgcggtggcggccgctctagaactagtggatcccccgggctgcaggaattcgtctcacccctagaaaaagtctccgattctggatctgcccatgccgtaacccgcaggctcccggcatctcgttctcccctccaaaattcaccttcgccgattgccgccgtgaggccgccgcgacggcgttgcggacgcctcttaccacctccgtcgcattctccgctgactcccccctcggtggcgtcccactgcgctcctcaacagcctgctccattcccacgccacctcctctcgctccgctgcgaccaccgaggaccaccagagcgggacgccgcggaactcgtcggccacgtcctggccgtcgcgcatgctgacgacgaggccgttgccctcccgggcaccctcgacgcggagctcgcgcgcgtcctgcgagcgcacggcgccgctcaggtacgccttcacctcctcgtaggtgctgtcgttgtcggagacggggccgtagcgtgagtagcgcacctcgccgccgggctccgagatgtcgatggtcacgtaggggtccacgacgttgagtaggcggcgggcgcgccggcggaggaacaggttgaaggttggtccgaacagaggacagggagggaccctaaaatcaacccaaagggccaaagcccgaagtttctttttctccccgcaagaaaagaggcaagagttctccgcttctcgcaggtcgcgacagaaaaagaggcggagttgccggagaaatgccgagcagcaccctgaataagggagatcagcgagggcccacaccacatttcgctgcggcattcaacgcttggggttaaggcgggacctttggcccggcgaacacggttcagggttatacattccaattgggtgagggatccgtccgcctctcccttcggttccggggtgtacccccgggggggggtccgc

SEQ ID NO: 90682 - DNA, 890 bp, Zea mays
  misc_feature: Ceres CLONE 1578708
  misc_feature (733)..(733): n is a, c, t, g, unknown, or other
ctccccgcggtggcggccgctctagaactagtggatcccccgggctgcaggaattcgtctcacccctagaaaaaattccaaccctctgggctctggcacacagctactcctcctcctcgcccttttctcctcatccctcgctttcgcttcgccgttccaacgcggagcccccacggaaaataaaggccaagaagtgatggtagtggagtaaaaccacgcgttggagggcagagggacaggttggtggaggacgcgcacccagcgtggagagcagcaggagctacgcgaattcgggccgcgagtgcgccggttcaggttgccgccgccggtggaattgtggcagacgaggtggcctgttggtagccgcgggagtttgcgagtaggtcggttccggttggtgtgcgagcgaaggtgctgttggaggcgtggatctggccggcggcgggcgatgggaaggagggactagggctcgattggagggaaaggcgcgatcttggaggtcccatggggcggatgcctctcgcagggagagcaccggctccagagcaggccagctgaagctgctggagcagatggattgcggaagtctaaatctgattctaaagctgtagccagtggtcttgctcctcaaaagatgtggtggaccctgcagtagaaggatatggaaatgtgaatattttcacatatgacgaataagagcgccacaaaaaacttcggccagatcaattctggnagaggtgggatttggattgtttacaaaggggtattatgaaatgttagagcaggttccctcaagacagttgctgtgaaaaactaacccgaagccttcaagggaacaggagtggctgcaaaatcactttcctggcaactatcctccaatctgtggatgg

SEQ ID NO: 90683 - DNA, 965 bp, Zea mays
  misc_feature: Ceres CLONE 1578709
  misc_feature: Encodes the peptide sequence at SEQ ID NO. 90684
ctggagctcaccgcggtggcggccgctctagaactagtggatcccccgggctgcaggaattcgtctcacccctagaaaacatcttcgtcgtgttgctcccagggtcggacgtcatcgagaggcccagggtcgggcgtcatcgagaggcctaggctgacgctcccctcgaaccacttgggagagggacgcgttggaggcgggattgagcacgacagccacgacgagcaatctgcagactacgggagcgcgccatgggatgtacccgttggcttttacgctgcctgcaccaccagaggaatcgccagctgtgggctcacccacatggttgtcacgacgctcgacctcgccaaatgcaacatgcagaaccctcttgagaatgtgaatggtaccatgcaaggatcatggaacggctatgtgaatgatgatgacagagcacttttgaaggtatgcgtttagtattgaattatatatttacggagacatgctttgtgtctacaggaattttctttgtagattgagttatatatagcacatcattctttatatataattgtttcacttgggagataaatatacatggaatatatatttacgatttgatctttaagtgtcttgatctctatgtaaaaaactcagaaaaggatgattttcttgccatgttcgatcaatctttctatctaagtgcatgttcgtgatactgccttaatgtgcactgcttctcaataagaaaaaggtttttttctcaggttccctaggaatagtccagtgtgcaagctccacttgtttagtctactaaacaacattggagggattagaaaattacccttacaaacttattggttcctttaggttattaaagttggccccaccaaccttatgtttagagctgactggatttgcccctgaatggagctggggttggaacaaaagggggacatgtttgggacattctaggaaggccccac

SEQ ID NO: 90684 - protein, 44 aa, Zea mays
  misc_feature: Ceres CLONE 1578709
MVVTTLDLAKCNMQNPLENVNGTMQGSWNGYVNDDDRALLKVCV

SEQ ID NO: 90685 - DNA, 1243 bp, Zea mays
  misc_feature: Ceres CLONE 1578710
tccctttcctctccctttccaccccccccttctttctttttatccgcccaacattttttttttcccctcttcaatctggagctccccgcggtggcggccgctctagaactagtggatcccccgggctgcaggaattcgtctcacccctagaaaaagagagagagggaagaggggcataaaaaatatttgcacccgcgatattcccaagaatcttctcttcctctcgctatatccctcatccgcccacccggccacccccattgcgctgcactgctcccacacgctcggattcctgctcgctttctcctcccactattccatcgccagccgccccttttcccttcctttttcccttgctcgcccgcccgcccgcccaggactcgtccttcgcgcttcttcgccatgctcgtccttggcgcttctttcccagccttcgtcgagaaagggtgagaggatcctactttgcttgtaccgctcccccgggagccgggccggaatacgctccccgtcacctttccccccccccggaaatgtggccctgaatgggtttggaactaaccctccaggggaagccccggcctttctgtaaaccagggaaatccgtaaccgtgtgtcccccccggtaatgcctatgtgaataaaaagcttgtttaataaaaaacaagcggggccgtttgcgccccccccaatggtagaaccttaagcctggaaaatacaacttttgttgggccaatttcacttccccgggtcctatgtggggaacaatgtggccccgcaatattatttgtggaaagagggtcccccgcatatgtatcccaattattatataaaattatctcgcacagtgtgtttgtggccacctttcactctggaatcaccgggcgccaacatatataaaaagtctgtcggtgttaatgaaacatcatacggccccccagagggaaggtggagcgggacattttcgcttttcccatataggcggagagggttatcaggaacggcgcccacttattgttgcctaaaaatataaccggggcgttcatatttgtgcccctctggaataaatattttccccacccggggtgcggaccaccgttgagaaatatatcccggcaattgcctcccctcccttatggaggcgctcgaaaaatggcgcttcttagaaaaatgtgttatctctctttctcacacaccgcgaacagtgaggagtgtgtgctcaaaaataaattcctcccgacccccg

SEQ ID NO: 90686 - DNA, 952 bp, Zea mays
  misc_feature: Ceres CLONE 1578711
  misc_feature: Encodes the peptide sequence at SEQ ID NO. 90687
  misc_feature (945)..(945): n is a, c, t, g, unknown, or other
ctccccgcggtggcggccgctctagaactagtggatcccccgggctgcaggaattcgtctcacccctagaaaaaagccttcgtcgtccccagccccacggccgctgcgtcgccttcccctctcggtcgaaaccacaacggcctcttccggcataacaatatgcaccgaatattcagctcatccgctctcctataaaaacgaagcgcaaatccaaaaaaaaaaacccgcccgcacgacgcattgtccgttccgtttggacccatgatatatctcgctgggatcttgaccgtgcgcgagacgaatctcctcgtgcggtaaccgataccccccaagtcaaaaatcagcccataaaatttttatgggcggaggatcacccgtcgccgcagttcaggacgcgagcgacgacggcgccagggtcgtggtgctagtcgcgggttctcccgtcgattccgcctccgattccctccctcctcccgttgcggcgactcctgctcctgcggcggaggccaagcaggagtcggtgtcggagacggaggaaactaagcaggcggcggcggcggcagcagcagcagcggcaggaggtgtgcaggccatggcggtcaccgtagtgcgggacgtcgagacgggcctggacgcgagcaccagcgaccggtacggtgacaagccttcctgggtcacacctaagagattacttgtcatgttctgcattatcaacatgctgaactatatggatcgaggagtaatagcaagtaatggggtcaatggtacccgcaaaaggtgttctggtggcacatgcacctcgggctcaggaattcaaggagacctcatctaattaaatctgaagatgtaactgtccccagcatttatgggttgggttggtggtgccttcgttgaaatttgcagcctggaaaagaataatccttccagctaattggggtggcctgntaagggg

SEQ ID NO: 90687 - protein, 157 aa, Zea mays
  misc_feature: Ceres CLONE 1578711
MGGGSPVAAVQDASDDGARVVVLVAGSPVDSASDSLPPPVAATPAPAAEAKQESVSETEETKQAAAAAAAAAAGGVQAMAVTVVRDVETGLDASTSDRYGDKPSWVTPKRLLVMFCIINMLNYMDRGVIASNGVNGTRKRCSGGTCTSGSGIQGDLI

SEQ ID NO: 90688 - DNA, 983 bp, Zea mays
  misc_feature: Ceres CLONE 1578712
  misc_feature (383)..(383): n is a, c, t, g, unknown, or other
  misc_feature (645)..(645): n is a, c, t, g, unknown, or other
ctccccgcggtggcggccgctctagaactagtggatcccccgggctgcaggaattcgtctcacccctagaaaacttccccttgcgctctggttttctctctttgcgccgctgttcaggcgcctcgcctctcctatccttgtcttgccctgtgtcccttcgtcgcctcggcgcgctcgcccttcgtccatcgggcttccgcgcgctcgcgtttttcattattccttctctgtaccccgtttcgatttcgagcggggtcagtttcttcttcaccggttgatttgttctgctgctttgcgtctccgtgctctcgcagatcccttgtagccgctttgcctccgcgcgaccccgggagcgagccgagtttggtttgccgggttgttcngtttgcggtttaccctttctgcgattatagtttcctggtggatcctgttttgttctcgacttctcaacgtgtgggttgcaggattgggtcccaatccggggttgggaattgttccgcatgggcctcctggggccaggaggtgcaggcaaggtaatcttctgtcaaatccgggggtccttgggttttggcccgggaaagggattcggggggttcagggcccaagtggtttcgggggggggcccccaaaaacaaaaagcgcccnccaattttccccccccggacccgggggaatccgaaacctggggccctttttttttttaagcggggataccccctgggggcgccttggggggtcccccccaactccaaaaaaaaaggaagggcccctccgcgggtttggaaaaatatgagaagagggaggggggtcccaaaaaaaccccccccgggttctctcgtgaaacacccacgtgggggaaaataaccccccccccccaaaaaataattccccccccaaaataacccgccggaggtgtcaaaagaaaaaaaattttgattaatagagggggggcggccccactttttttggtaggaagaagaggt

SEQ ID NO: 90689 - DNA, 1139 bp, Zea mays
  misc_feature: Ceres CLONE 1578715
  misc_feature (245)..(245): n is a, c, t, g, unknown, or other
  misc_feature (255)..(255): n is a, c, t, g, unknown, or other
  misc_feature (256)..(256): n is a, c, t, g, unknown, or other
  misc_feature (316)..(316): n is a, c, t, g, unknown, or other
ggagctccccgcggtggcggccgctctagaactagtggatcccccgggctgcaggaattcgtctcacccctagaaaaaactagtactaggtctagggtcgcctcgccgccagccaaccacgcgcgcacacgccccgtccggccgtacccgctcttcattccccactgcacacaaatactactgtgactccgtgagggagcaacaggaggaagaagcaggggggagaggggaggggatgtttttcntttttttttnnttccctcttccccccttttttttccttgccgtccctccctgttcctttgttccggttgantagagcgcgcccccgcccctccccttttttcccatctcctttttcggggggcgccctggtattactcctcttgttttacccccccccaccccccccacctttttccattattttcccctctccccggccgcctatatttagcccgcgggccgcgcttaatctttttacccctctttatccgacccttcttcccccctctcttttttttttttttcctgcgcttcccgctcccccctagtttacatatggccgggtcccatgttccctatgtgttcttccctcccttttttcctttatattattcgcgcccctgaccctgctctcttttctcaccattttttgactcttctttccttcctctcgtccggtgagcgcccgcccattctgccttacccgcgctgtctcttgtgtcccttcactcaccaggtgctgttatatatggtgttccagtcacctttcatgcttatctactcgcgtttggccattattatgttctcccatgtccgttgtgtttctggtgcaccttcaccttatcgagtgctaaacatgtaactgtcatgatcgttttcccccgtcttctcttttttatggtattgtggattgcacccccccccccacctaatccccttgttgtagataataacgttgccgccgtccgacaccgttcgcttatattcctgttcggcctctgctccgctttccgcccccattcctctgtctgtcgtcgtttgacgagatgccgccagcaccctttctattatctcccattgtcgttcttccttgttcgtcgccccggtatatctaatagagtcttgtacttgta

SEQ ID NO: 90690 - DNA, 1014 bp, Zea mays
  misc_feature: Ceres CLONE 1578721
  misc_feature: Encodes the peptide sequence at SEQ ID NO. 90691
ctggagctccccgcggtggcggccgctctagaactagtggatcccccgggctgcaggaattcgtctcacccctagaaaaactctacctcttcgctggggggctcctttccctcccctcgcgtggcgtctgtggcggctatcctcgcctcgtctcccctcccccctccctagggtttatcctccaccaccacctacccaccgcctctccccaccacagataagaattatcttatcgattttttacaccggccttgaattcgatccaggagcagtcgtttggtgttggtagctgcggcagacgtctgtcctagatcgaattgactcgcgagaagaagccatgtcgacagttgctcctgcccctagcgctgctgaccagaccaccaatcttctgcagaagctgtctctggagggcaaggatggctccgacactgccaagaagcccttctggatgccatatgggaggatctacccacgctggagatgcacagagcgctggctcacaggtgggacaggtcaaaacaccctctactacaggaggccatgggatccttattttctttctaccaaccccagtgcatatggcctcccccagccaattacctccccctaagggggttatgaaggggcccacccaaaggaaggggaaccccaggggtttcgcgggcccctaaaagaaaagggaaaaaccccccccccccccggggtttgggaaaaaactgttcccctgggaaaaatggggtatggccccaaaagggcgcaaaatatcttggggggttcccacaaacaaaaagtgtggggactaaaggcccccacttattgggttccccaaaaaataaaaaccccccctaatttttttttgtccccccccccaaaaaacgaaaaaggggtaaaagggggggattttcaaacaaaaaaccccttgtttgattataaaagaaaaatttgttgtttaaaaaaaaacccccccgggggggggtgggggaaaattctccaaacttttctccagaaaaaaac

SEQ ID NO: 90691 - protein, 90 aa, Zea mays
  misc_feature: Ceres CLONE 1578721
MSTVAPAPSAADQTTNLLQKLSLEGKDGSDTAKKPFWMPYGRIYPRWRCTERWLTGGTGQNTLYYRRPWDPYFLSTNPSAYGLPQPITSP

SEQ ID NO: 90692 - DNA, 893 bp, Zea mays
  misc_feature: Ceres CLONE 1578722
  misc_feature: Encodes the peptide sequence at SEQ ID NO. 90693
ggagctccccgcggtggcggccgctctagaactagtggatcccccgggctgcaggaattcgtctcacccctagaaaaaatcccacgctgccctcggcgctgcgcctggccccggcacctacctcccccctccccacctcgccgccggcgggtggagtcgggctggagcagccgctctcctctgttaccccctaaccccctataaagaaaaagaaaaaaacagagagagagcgagcgaccggcggctcggcagccatggggcacggcgtcagctgcgcccgcaccggtgacgagcacgactacttccgcgcggcgcaggtcggggacctcgaggccctggaagcgctcctcgacgctgacccctcccttgcccgccgcgccacgctctacgaccgcctctccgcgctccacatcgccgccgcgaatggccgcctcgaggtgctgtcaatggtcttggatcacggggtgccgccggacgtggtgaatcggcacaagcagacgccgctgatgctcgcggcgatgcacggcaagaccgactgcgtgctgaagctcctgcaggccggcgccaatatcctcatgttcgactcccagcacgggcggacctgcctgcaccacgcgtcctacttcggccacgtcggctgcctgcaggccatcttcacggcggggcggaccacgcccggtggccaactcatggggttttcgctcgggttcgtccacctgaagaaaagaacaaaggggcccagggcggtttccacctttgccgccagggaagggccgccccccggtttggtttaaagggcccttttttgggaaaaagggggccactttttttcccgctttttgaaccgcgctcataagggggttttcccgggagaaaacacctctccccgcccc

SEQ ID NO: 90693 - protein, 179 aa, Zea mays
  misc_feature: Ceres CLONE 1578722
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGVSCARTGDEHDYFRAAQVGDLEALEALLDADPSLARRATLYDRLSALHIAAANGRLEVLSMVLDHGVPPDVVNRHKQTPLMLAAMHGKTDCVLKLLQAGANILMFDSQHGRTCLHHASYFGHVGCLQAIFTAGRTTPGGQLMGFSLGFVHLKKRTKGPRAVSTFAAREGPPPGLV

SEQ ID NO: 90694 - DNA, 935 bp, Zea mays
  misc_feature: Ceres CLONE 1578724
  misc_feature: Encodes the peptide sequence at SEQ ID NO. 90695
tggagctccccgcggtggcggccgctctagaactagtggatcccccgggctgcaggaattcgtctcacccctagaaaaacccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcccccccatcagccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacacgaccatcagcgtcgacagcaagcccatcacggtcgtctccagcaggggaccgctcaagctcccatggggggagctcggcattgacatcgtcatcgagggcaccggagtcttcgtcaacggcccccgcgccggcaagaaaatccaggccggggcgaaaaaagggatcatcacggctcccgccaaggggggcgaaatccccaacctatgtcgtcggggttaactagggggaaatcgaacacgggtgtggcgaaattattaagaaaccgtcccggaacaacaaaatgcctcccgcccttcggtaaaaaccttgaacaaggaattccgatacctgtaagggaaacatgtaaaacaaccaccctgtaacccggggaat

SEQ ID NO: 90695 - protein, 218 aa, Zea mays
  misc_feature: Ceres CLONE 1578724
  misc_feature (83)..(215): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGENAVRAPAEAKLKVAINGFPPISRNFLRCWHGREDSPIDVVVVNDSGGVRNASHLLKYDSMLGTFKADVKIVDDTTISVDSKPITVVSSRGPLKLPWGELGIDIVIEGTGVFVNGPRAGKKIQAGAKKGIITAPAKGGEIPNLCRRG

SEQ ID NO: 90696 - DNA, 910 bp, Zea mays
  misc_feature: Ceres CLONE 1578730
  misc_feature: Encodes the peptide sequence at SEQ ID NO. 90697
ctccccgcggtggcggccgctctagaactagtggatcccccgggctgcaggaattcgtctcacccctagaaaaaatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgatgctcgcgccagcaccgccgaactggcgtcccccgccgcaaggggtcggcgtcggcgggcgtgtcgcaaggcgcaggcgcgcgacgatggagcacgtgatgacggtgctttcggcggcatcacaaccagtacactgcctcgaggggttccgtacagaaggggcggggcgtggggggctaattgagcgaacctccccccgggtcccgcttgggagaaaaccccctggctggccaaaaaatgcccggggccggggcctaagggggccagggcccccgggaaccttttcggggaagggaaaatgggaaaaggttcccccggggggggcccccggaacacgcccttttaaagccccggtgttggcttttccccaaaaaggggtgcgaaaaaggcggggaattattgc

SEQ ID NO: 90697 - protein, 180 aa, Zea mays
  misc_feature: Ceres CLONE 1578730
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLSARDRLAINDCLELLSTTMDDARASTAELASPAARGRRRRACRKAQARDDGARDDGAFGGITTSTLPRGVPYRRGGAWGAN

SEQ ID NO: 90698 - DNA, 921 bp, Zea mays
  misc_feature: Ceres CLONE 1578731
  misc_feature: Encodes the peptide sequence at SEQ ID NO. 90699
ctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggccaccacggctgggacaccggcgggctgtccgcggacccggatgcgttcgctcggaacagggcgctggaggtgatccacgggcggtgggcgatgctgggtgcgctgggctgcatcaccccggaggtgctggagaagtgggtgcgcgtggacttcaaggagcccgtgtggttcaatgccggcgcacagatcttctcagagggcgggctggactacctgggcgaccccaacctggggcacgcgcagagcatcctgggcgtgctcggcttccaggtcatcctcatgggcctcggtcgagggctcccgcatcaacggcctccacggcgtcggcgagggcaaaaacctctaccccggcgggcagtacttcgacccgggggggcctcgccgaaaaacccggtcaccttgccccgagctcaagggtcaaggagatcaggaacggccgccctcgcccatggtcctccagggttcgggcttcctccttccagggcattcgttcccggttaaagtggccccttcgaggacct

SEQ ID NO: 90699 - protein, 246 aa, Zea mays
  misc_feature: Ceres CLONE 1578731
  misc_feature (69)..(218): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGHHGWDTGGLSADPDAFARNRALEVIHGRWAMLGALGCITPEVLEKWVRVDFKEPVWFNAGAQIFSEGGLDYLGDPNLGHAQSILGVLGFQVILMGLGRGLPHQRPPRRRRGQKPLPRRAVLRPGGASPKNPVTLPRAQGSRRSGTAALAHGPPGFGLPPSRAFVPG

SEQ ID NO: 90700 - DNA, 1009 bp, Zea mays
  misc_feature: Ceres CLONE 1578733
  misc_feature: Encodes the peptide sequence at SEQ ID NO. 90701
ctccccgcggtggcggccgctctagaactagtggatcccccgggctgcatgaattcgtctcacccctagaaaaagaaccagctccaaccctaccagaacctgctcgacccggccgccgcgaccgtcccccctcatcgactcgaggctacgaagcggccggatgggagcagctgcctgaccctgacgacgatgagcccgcccgccatgctgctgcccgtctgctccgccgcgcccatctgctcccccctctgcccggtgacggcctcgcacgtcgtcacgcgggtggcgcggatggtggacgtcgggtcctcgctcaggtcctacgacaactcgctcgtcgcgcaggtgcactaccgcccgacgctcggcgactcctctattactctcccccctagatcaccgcgccggaccacatcgcgcgagccttctgcgccccacgccttccgaggtccggcggctcccccatcgccgaccccattccctgggctatgttgcactgggcaccgtaccaaccggctggggggcagtcttacgaccctgggcccccactgccgtaggtcaaagtggaagtaccttccgaaaactgccgaaaccggggcactggttctgaaagcgccggtttcccaatgaggtttgcccctttcttaccccggcccgagggtccaaaggaattcaatgggcccgggacttcattacaaaagggcccggcaaaccaaggaatttcccggggggtaggaaccctctttaacttgtggcccccaggaaaaaacacggaggttggtccacgctacttaaacctctttttttgccctgaaagaaaaaaatgtgttccgcaccgcatttggggtggcattaaagaacgtctggttcaccccccggataacaaacatggcttcccgataggtgggccaaggtttgttttctcgcgcctttttctcataaaaatgtgcgcgcagaatctggggcaccccctccctcttatgtttttcctagaagaggcatttttttg

SEQ ID NO: 90701 - protein, 146 aa, Zea mays
  misc_feature: Ceres CLONE 1578733
MSPPAMLLPVCSAAPICSPLCPVTASHVVTRVARMVDVGSSLRSYDNSLVAQVHYRPTLGDSSITLPPRSPRRTTSREPSAPHAFRGPAAPPSPTPFPGLCCTGHRTNRLGGSLTTLGPHCRRSKWKYLPKTAETGALVLKAPVSQ

SEQ ID NO: 90702 - DNA, 1029 bp, Zea mays
  misc_feature: Ceres CLONE 1578736
  misc_feature: Encodes the peptide sequence at SEQ ID NO. 90703
ctccccgcggtggcggccgctctagaactagtggatcccccgggctgcaggaattcgtctcacccctagaaaaaattaaactcacaacacggtagcagggggtggtagtagaaggcataagctctgttctctgaccctcaagtgtttgagcctatttgcgcaacgaaaaaatgagcatcaaaagcattaatggaaagagccccatagtggttggaccttggggagggacaggagggtacccttgggatgacggcgtgtactcaacaatacgccagatcgtgattggccatggtgcagctattgactcaataaagattgaatatgatctgaaaggaaggtcggtttggtcaaaaacgcatggaggtactgatggtgggtccctaaaagatttgtggccccaccacattttccagatgaagtcctcgtggtctgtaagttggacacttacggatctggtctgcgggacaccgggtcatccataaaaatcgttggaagttttcaaaacaaacaactccgaacgttcgggaccccttcggccacccgaggaatgggcacacccttttctcactcccccaagttagcaaggggcaaaaaatctttgggatttccccgcggggggggtctgggggcccgtatctcaaaccccaaatcgggtgttttctaccttaaaaagaaggggggctttttttccccaaacccccgggtgaaaactttttttccaagttgttacctgttgtaagccccccccgatgtccccgaaaaaataaaaaagggcctcttttggccccccccccggggggggaacccttgaaccctgaatagggttttccctcccggggagaaaaaaaaaaaaaaagttttggggtgtttccggagaatatccccccaaaagagttgacaaacccccctccccgggggagaacctgaaaaaaaaaggttttctccccccttatctcggaataatcaagagtctccgcggggggggggcccctaatatatgccccggaggggggggggcccctttatagt

SEQ ID NO: 90703 - protein, 103 aa, Zea mays
  misc_feature: Ceres CLONE 1578736
MSIKSINGKSPIVVGPWGGTGGYPWDDGVYSTIRQIVIGHGAAIDSIKIEYDLKGRSVWSKTHGGTDGGSLKDLWPHHIFQMKSSWSVSWTLTDLVCGTPGHP

SEQ ID NO: 90704 - DNA, 988 bp, Zea mays
  misc_feature: Ceres CLONE 1578737
  misc_feature: Encodes the peptide sequence at SEQ ID NO. 90705
  misc_feature (795)..(795): n is a, c, t, g, unknown, or other
ctcaccgcggtggcggccgctctagaactagtggatcccccgggctgcaggaattcgtctcacccctagaaaaaaggatgaactcgcccgagtgggcctacgcgctcgccggctccatcggctccatggtctgcggctccttcagcgccatcttcgcctacatcctcagcgccgtgctcagcgtctactacgcgccggacccgcggtacatgaagcgcgagatcgcaaaatactgctacctgctcatcggcatgtcctccgcggcgctgctgttcaacacggtgcagcacgtgttctgggacacggtgggcgagaacctgaccaagcgggtgcgcgagaagatgttcgccgccgtgctccgcaaacgagatcgcctggttcgacgcggacgagaaccccagcgcgcgcgtggggcgcccagctagcgctggacgcccagaacgtggcgctccgccatcggggaccgcatctcccgtcatcggtcagaactccggcgctgatgctggtgggcctgcaccggcgggggttcgtccctccagtggggcgcctcgccgctcgtggctcctcgccgtgtttcccgccttccgtcggggggcgcccacccgtgctgcaggaagatagttccatggaaagggctttcctcgggggggaaccttggagggccccgccgcccgcccaggggccaaccccaaaattgccggggcgaaggcccttgggccaaaccctcggcaaccgtggggcccccgtttcaacgccggaagcgccaaaaatccagggggggttgttttcaagggncaaaccttggggggaggccccgttcccgggccttggttttttggaaagggggagaaattctccggatatcggcttaccagggtggggccaatttcccggtttgttaccctccctaacccccctgagggttgtggttaccccggcgtggttttgggaaaaaaaggtgtgtccaaattttttgcgaaccatttgg

SEQ ID NO: 90705 - protein, 140 aa, Zea mays
  misc_feature: Ceres CLONE 1578737
  misc_feature: SWISSPROT Homolog: EC 3.6.3.44 Xenobiotic-transporting ATPase
HRGGGRSRTSGSPGLQEFVSPLEKRMNSPEWAYALAGSIGSMVCGSFSAIFAYILSAVLSVYYAPDPRYMKREIAKYCYLLIGMSSAALLFNTVQHVFWDTVGENLTKRVREKMFAAVLRKRDRLVRRGREPQRARGAPS

SEQ ID NO: 90706 - DNA, 1068 bp, Zea mays
  misc_feature: Ceres CLONE 1578739
  misc_feature: Encodes the peptide sequence at SEQ ID NO. 90707
ctccccgcggtggcggccgctctagaactagtggatcccccgggctgcaggaattcgtctcacccctagaaaaagcaagccacaaatatttgcaagccacaagccaagccaagcaaaaccctaagaaacccaccctccctccagtctcctcgacccccgccgccgccaccgccatcacaacccagagcaccccctccccaccccaccctgtcccgatggctgcggacgccgccgctgcggcgatgtccgcgacttccctctgcgacgatctcgagcccgccaccgtgcgcacccgcatccgcgatgtcctggccgcaggtgccgcgcgtgccggggaccgcgtcctggtccgtgggtgggtccggacgggccgggagcaggggaagggctcttcccccttcctggagctcagcgacgggtcctgcgctgccacgctttcaggccatcgttgacgccgcggtgcacccgctagggggcctcaccgccaccgggaccttcgtccctcttggagggcgtgataaaggggccccccccaggggaccaaccaaaaacgtcgaacttgaagggaacccccgctggcttaagggtcggggaaaggtcaaagcccccctttcttcccgcttggcccagggggtgaagggcaaaaccccccccgccccgaaaaaaccccaggggaacgtggggttaatccctccgggtccgcgccccccaaaacagaattgggggagggggcggtgctttggattttgggggacccaatttggcccctaaggggtttacaagggggttcttttgagagggaaaggaagactctcctttggggtggtacacccccacaatataattttttattgtatcttcccgcaggcgcctggtgaaatttatttacaaaagagcagattgtctttagccccccggtgagttaacacataaggacggagttgtggaaatacaccactctacctcttgttgttgttatatgaggattgcgcgaaccccccggccaaaagataaaggtgtggtgtcccgcgtcgttgcccccgtaaaactgcacaatagaggtactct

SEQ ID NO: 90707 - protein, 78 aa, Zea mays
  misc_feature: Ceres CLONE 1578739
  misc_feature: SWISSPROT Homolog: EC 6.1.1.22 Asparagine--tRNA ligase
MAADAAAAAMSATSLCDDLEPATVRTRIRDVLAAGAARAGDRVLVRGWVRTGREQGKGSSPFLELSDGSCAATLSGHR

SEQ ID NO: 90708 - DNA, 1333 bp, Zea mays
  misc_feature: Ceres CLONE 1578740
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (1137)..(1137): n is a, c, t, g, unknown, or other
  misc_feature (1233)..(1233): n is a, c, t, g, unknown, or other
tctccccgcctgtttccccccgttggcctcccctcccttttttctctcccgtttgttttggtgtcnnncttttatgtggagctccccgcggtggcggccgctctagaactagtggatcccccgggctgcaggaattcgtctcacccctagaaaaagcgtgcgcgctctatctccctagctccctcgcctcccgagatctcctctcttcttccctccctccctcccttctcccttggcgacgttttcgctctccagccccaggtaagcgggtctttttcggacaaggtcgctgccgccccacgccaggtggtcatgtctttttgagtctcttcccgggcgacgtacctccaggttgagctccatagtggttcttgcagaggtttcaaggttgccaccgacttgcttgggtgaatacaccccgctcttacacactacagattaaatggggaagaaacaaatttctctctgaatttcccccccccctcgctaaaataattatgacaggagctggtggccaaagggcccttggggcgaaggggccattttctcatattttgggatggagataacttttttccccccctattttattgttccaacttggggccccctattggccttctttttaattcacccttccgcggggcctgtgggtttgtccccctcacctcctttggggataatcaaccccccccccccggcaattccccgctccccctcggacgtcaggtagggtgataaaccagcgctctccgccgttgattctatggacactatcggcgtggacgggcggaagtactaggcattccattgtcgcgcgttggcctccaatgtataccgtcttggtttattcgccatatgctttatgttacgcccgtacacttcttctgcgttcgggtttatatcgccggcgatttgcccgcgcgtcttttttttgttactaccgctcctgttctgcacgaacacacaccgtcggcgccacattttttcacctcagtaacacttttttcttcacctcgtatgtatgttgctggcgttaataacaatccccacgccgttgccccgagtatgttacatgttgttgttgagcgtatcacttacctgttttctttcgcgttcttcacaccacacatgagngtgtttctgtgccgtgatgaccgcgtttgcggtgcagtatgttctcccgactctccttgtctcgtttctatgtggcacttattcgagtgttcgagncgcgcccactacgccactttattatatagttccacgtggtgagtgtgagaaccgtgttgtctatctaccccacctctaccatcgaggatcaaccttatgt

SEQ ID NO: 90709 - DNA, 1109 bp, Zea mays
  misc_feature: Ceres CLONE 1578741
  misc_feature: Encodes the peptide sequence at SEQ ID NO. 90710
tggagctccccgcggtggcggccgctctagaactagtggatcccccgggctgcaggaattcgtctcacccctagaaaaaagcatctgcctctgcctctgcccccccagactaccccctgcctgcaggctcctgcaactgcaatgtcggcgctcgggacgctctccggcggcgccgccggtgtctccggcctcctccgcctccgccgtcgggtcgcccccgcgctcgcggcgccgtcgcaccacgccgctgggacgttgaactgcgccgccttgcccgatgccgccccgctcgtctggggacgccagctccgcccgtcgctcctcctccccgccacactgctcccgtcgtcgtcgcaggccgccaggaggcacacgccacggcgggccgccgcatccccagggtcagctgcttgcttgcttgctggcactcccatcccatgcaccaggcaccaccttcggttgatgacttgattccctaattattaaccttggcgacagcaggggaggcccaagcctggtgggtttccctgggagaagtacccgggccctggtcaactgggcttctttcttccttcatggggggaccgttttgttttcctcctgcacatttttgcttccattccacctggtttcctgtccctggtggtaaaaacagggggccttcctggcaagggtaacttctccctccaaacggtcaattaattccagaaatctccctccaaacaaagaaaagatttttacaaaacttagctttccccccctattcccatataacttttgggggcccctttgatatccacccctaaggaaggggggtggggtcggtattaactgcgccccacaccacggtgtggaggtgtgccggttcctccccacagcgcaaggggggtaagcccttatcccccagggcattcggttttatttaatcttaaaggaaagggagggaccatcctttgtttttctcgcggcctctccctagaaagaatttcctttggtttgggaagccaaaatatgtggcccgcttcttaaaacctccttttccaatcgccccggtgcccgggtgttggtacacttcaatgaaatggtgcctccccgcggtgtgagccccc

SEQ ID NO: 90710 - protein, 109 aa, Zea mays
  misc_feature: Ceres CLONE 1578741
MSALGTLSGGAAGVSGLLRLRRRVAPALAAPSHHAAGTLNCAALPDAAPLVWGRQLRPSLLLPATLLPSSSQAARRHTPRRAAASPGSAACLLAGTPIPCTRHHLRLMT

SEQ ID NO: 90711 - DNA, 1188 bp, Zea mays
  misc_feature: Ceres CLONE 1578745
  misc_feature: Encodes the peptide sequence at SEQ ID NO. 90712
  misc_feature (318)..(318): n is a, c, t, g, unknown, or other
  misc_feature (791)..(791): n is a, c, t, g, unknown, or other
ctctccctccgcggcgcgaggaggaacccaaccccccaccttttatttattttttttttcaaatctggagctccccgcggtggcggccgctctagaactagtggatcccccgggctgcatgaattcgtctcacccctagaaaaaaacaaagtggcagccagaaaactcggcagagcatctcgcttgcgaaacaaaggacggcgcgcgagaggaggggaaaggaaaacaaccaccacgaccccgtccattccgttccacttccacccgagctcagcgatcgcggcggcggatgcggatggggaaggggctgtcgtctcnagcggggtcgcggcaccggcagttccgcgcccgagccatgacccgcgtcgacgacctccaggaggtcttctcgggcctgcagtccgcgcgcaaggactcacgctccggggacgccgccgtccttgatgcgcatctccagcagatgccacccgagtggcgctgcgagctcaacgctccctctcgcacctcctcccctgagggcaacgccagggaactgtcggatccgcctttgggaaactctttggtccaccgcagttgggggggtggccctatgaagcatgattgacgcccccaaaccaagttggtccgagcaagcatcaggcagcccccccacttccggctaccaagtcttaaccggtagcccacgggcctatgtgtcatcgcttgtagtggtccaggggcaattatatgcctgtgaggcccccaccggaagcacaatacagagttggacacttccccggttttggtggacncatgtcccagcaacccctgcctttggagtacccccgggcgtggtgcttccgccccgaaaacggggtcggcggtggtgtaaccggggttcctgggcggaggggtttccactgagattatgcatctggctccctatagtggacacaccacgggaaagctgtcaccggttccaaacgatatttcctctccttatgcatagagggaatgtcacaagaacagtaaccgttacactggaggtgaaagaccagggagtgcgcactttgtgtaacgccgccaccggattttgttgtctatagacacacaccccgagtttctcgtttttgccccttgtggttgtagccacctaaggggcatcccgcggaagataatatatttgtagtgcaatatgtccggggcctt

SEQ ID NO: 90712 - protein, 102 aa, Zea mays
  misc_feature: Ceres CLONE 1578745
  misc_feature (8)..(8): Xaa is any aa, unknown, or other
MGKGLSSXAGSRHRQFRARAMTRVDDLQEVFSGLQSARKDSRSGDAAVLDAHLQQMPPEWRCELNAPSRTSSPEGNARELSDPPLGNSLVHRSWGGGPMKHD

SEQ ID NO: 90713 - DNA, 728 bp, Zea mays
  misc_feature: Ceres CLONE 1578748
  misc_feature: Encodes the peptide sequence at SEQ ID NO. 90714
ctccccgcggtggcggccgctctagaactagtggatcccccgggctgcaggaattcgtctcacccctagaaaaatttccaaatccgtctccgccctcacgcacgcggcccaactagcctaacaaaccctagctagatttagaaaaaaaatttgtccccaatccgaaccgacgaggagctcgccgccgtgagatgtccgagtacgacgagcgctaccagggcaacggcgacatgcccgcagccgaaggcggctatccgcaggccgagtacgccgccgccgccgcgcctgccgccgggggttcgccgcccgcagacagcaagcccctcggggttctcccgaccacggccgacgggccgctccctccccagcacaggcatggagaccccatccccttggacagtgggttccccccaaaatctccgggaaaaggggcccgaaaacccgcgattaggggccagggatttggggaccggggaaccgggggatcttggggccccaaaaaagggggagggggccccgaaaaccggggtttaaggggtccccgggaaaaaaaagtgccccaaaaaaaccggaaaaattcgcggttttccccccccccccggggggggcgccctcctctagaggaccccccccccgggaaaaaaaaggggggaacccccccccggggggaggccccccctcccaaaaaaaaaaaaagggggtgaccccccccccccccccccggggtg

SEQ ID NO: 90714 - protein, 52 aa, Zea mays
  misc_feature: Ceres CLONE 1578748
METPSPWTVGSPQNLREKGPENPRLGARDLGTGEPGDLGAPKKGEGAPKTGV

SEQ ID NO: 90715 - DNA, 972 bp, Zea mays
  misc_feature: Ceres CLONE 1578749
  misc_feature (213)..(213): n is a, c, t, g, unknown, or other
  misc_feature (889)..(889): n is a, c, t, g, unknown, or other
ctccccgcggtggcggccgctctagaactagtggatcccccgggctgcaggaattcgtctcacccctagaaaaaagcggaaggcccgccgcttccccttcttcattcccgtcccacacacgccgccgccgccggtgcggctcgcttccgtcccccccggtccgcgcgggctgcctgcgggagcagggtggcagggcactccggcaaccacgtngggtggggaggcgacgacaccaccctatgctctgtcctcgcccgcagagtaagattgcagcagcagtgaatttgggagcttgaagcattcatctgagacatggaaaaagtgatctgctgggcatatctccttcaacgcaagcagttctcgaaagaaactcttgattgctgtgtcttagctcgtgggaacactcctctctcctctctcgtgaactacacatagtggttatatgttcctctatgctcaacaacaagcaggctgatgcgatattttgctgaagttattatatttcagtctatgccagacatctacatgtagatggtgctcatataagtgggggttgatatatttgctgtgttcagcttacatctgttgcggccctagttagctatttgtcttttgtgtactatctgaggcaagagattgatcagctaggacttggcgaacacttgcctgtgttggctgttcatctgaaggggataatttgcacgagacacctcggatattacaacaatggatagattcaagttggattaaggaagttggcgatgggactttcggggagtgtatggcgtgctataataaacaagaatggtgaaagtgttgctgctaagaaatgaaagaaaagtatattcttttgaggaatgtatggggttgcgtgaagtaaagtcttgcngcgcatgaatcatccctacattgtgaagctcaaagaggtatccgaggaaaatgatatatatacttcataagggaatacatgga

SEQ ID NO: 90716 - DNA, 946 bp, Zea mays
  misc_feature: Ceres CLONE 1578759
  misc_feature: Encodes the peptide sequence at SEQ ID NO. 90717
  misc_feature (759)..(759): n is a, c, t, g, unknown, or other
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccggcgaaagaccttcttcacgacgtcggcctcggcggcatcggctacgaggtcacccgctacctctacgccacctgcaacgacctcaagttccccaacttcggcatcaagacggncgccaacgcccagatgttgagcgagtccggcacgttcatcgggtacgtggccgtgtccaccgacgaggagatgcgcggctcggccgcgggacatcgccgtgtcgtggcgcgcacatcacccgcctcgagggggtgccgatctgacggccacagatccctttcgcgagacggggtcccctgcccgaac

SEQ ID NO: 90717 - protein, 233 aa, Zea mays
  misc_feature: Ceres CLONE 1578759
  misc_feature (171)..(171): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPAKDLLHDVGLGGIGYEVTRYLYATCNDLKFPNFGIKTXANAQMLSESGTFIGYVAVSTDEEMRGSAAGHRRVVARTSPASRGCRSDGHRSLSRDGVPCPN

SEQ ID NO: 90718 - DNA, 934 bp, Zea mays
  misc_feature: Ceres CLONE 1578763
  misc_feature: Encodes the peptide sequence at SEQ ID NO. 90719
ggagctccccgcggtggcggccgctctagaactagtggatcccccgggctgcaggaattcgtctcacccctagaaaaaacctaccctcgccacccgcccattccagttcccaatccgatcggtgcacgagctccgaatccactatccctgttgttggcggcctccagctcccgctgggaccatttccgtttcagggaggcggtctactctgtatttagatccgccccctccttgcggtagtcgggggagcggatttaggtgaacaagcatcttgatttttttgaccccccaatctttgctctacccaccgcgtggtcttcgcctttaaatcctctggaggtggatagacggacgaggcaaagccgaaggcaagaacggtcgtttcaagtatcctgctaccggcgtccgaaggaaccttcaagtgttccagtggaggtattaggagtggtggggaaaaaggggattgtagagggtaaacgatgttgagacagagctctagtagaaatcagagatccagaggtctgaagctgaagaaagctcttcagattagtctcttgcttctggtttctgtttggttgctctaccaagttaagcattcttacgagaagaagcggcgttcagcggaggtgaaggtgatgatttgcataaagatgacaagggccagggagaagcagtcagattgggcaaggaagatgtgcctccaaagatggaggctgattcctcaccctggatgaccgggttgaggattgaaaaaaaccattaagggaacccagaatggacctggttgagacctatgaggaccccccgatgaccaagacctgaaaaaggacaggaacttccccaagccggtgagaattctctaaaaaggaaaaaaatgggggtggtttttaagacaaaaaacgaaaggaacggccctcggaggaaacaaaaaaaa

SEQ ID NO: 90719 - protein, 84 aa, Zea mays
  misc_feature: Ceres CLONE 1578763
MLRQSSSRNQRSRGLKLKKALQISLLLLVSVWLLYQVKHSYEKKRRSAEVKVMICIKMTRAREKQSDWARKMCLQRWRLIPHPG

SEQ ID NO: 90720 - DNA, 1248 bp, Zea mays
  misc_feature: Ceres CLONE 1578764
  misc_feature: Encodes the peptide sequence at SEQ ID NO. 90721
  misc_feature (318)..(318): n is a, c, t, g, unknown, or other
ttctctccgtgcaaccagtttgtttcttctttcccattacctctttcttggggtgttgctatcctggagctccccgcggtggcggccgctctagaatagtggatcccccgggctgcaggaattcgtctcacccctagaaaaaccacgccacacaccaccagccggacgctagctcaccaccaacctcagcacatcgaggagaagaggagtggccatggcttcgtcggtggccaccgcggcgagcacattcctgggcacccgcctgggggacccggcgccgcagaacgggcgcatcgtggcccggttcgagttcaacancaaaaagcccaaggctgccctcccgaataatgtggcgaaaacgttagattcctctgaccggccgctgtggttcccgggagccgggggggccgaataacctccaccgggtgcttggtgggggaatacgggttctaacattttcccccccgagaagtccggggacttcccggagggtcaaattggaaccccgctggagcaaaaaccttggccaaaaaactgaggccggggggccagcaactgtgtcccccgttttgaggcccccccatagtcccagggttaccccgtttttcacgtccttttgctccccggggtgtctggcgcccccaaggcgggtgtccccctgaggtggttagcccccccccccactggttcctcagggggtccgagttggtcgttccaatccttttggggggcccgtattacggctttccaaaagtggggtgcgaaccggcggagggatcatcttttgtataacgagacgccttgcggacacagagggacggagatgtccgcgagtggtgtaatggtggtgtttatagtataaacttatgtgggttgtcatagctgcgcctgtgcccccgttgtccgcatccgattcgacagagcctacggtggtgagaatgcccaatagcagtgctccccgtagtcgggccatattactgtttgaagtgtgccaccgcttgttgcggtgggcatgggctgagacccgtatataccaaaatattgttgtgcttcggcgggctcaacgttatcttcggattcgccctctttcccgtggtggtcgagactcccctatcagaaacaagcgcggcccgcttcctgtttgtggtgattcttactgtctactggcctctatcccgatgtcgcacatctccttggggttgcccactggtggatccacccctccgccatggcgctctgtaacacgcg

SEQ ID NO: 90721 - protein, 66 aa, Zea mays
  misc_feature: Ceres CLONE 1578764
  misc_feature (35)..(35): Xaa is any aa, unknown, or other
MASSVATAASTFLGTRLGDPAPQNGRIVARFEFNXKKPKAALPNNVAKTLDSSDRPLWFPGAGGAE

SEQ ID NO: 90722 - DNA, 934 bp, Zea mays
  misc_feature: Ceres CLONE 1578765
  misc_feature: Encodes the peptide sequence at SEQ ID NO. 90723
  misc_feature (675)..(675): n is a, c, t, g, unknown, or other
  misc_feature (832)..(832): n is a, c, t, g, unknown, or other
  misc_feature (834)..(834): n is a, c, t, g, unknown, or other
ctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaggcatctcaacgccggaatcttcggcaccggcagcgacgggcacacgctgccgtcggaggtcacccgcgcggcgatgctggtgcgcatcaacaccctcctccagggctactccggcatccgcttcgagatcctcgnagccatcacgaagctgctcaacaccggtgtcagcccctgcctgccgctccgggggaccatcaccgcgtcgggcgacctggtccgctctcctacatcgcgggctcatcacggccgccccacgcgcaggcgtcccgtctacggaaggaagtggacgccncnaagcggtcagatcgcggcatcgagggcggctcctcagctcaacccagggaggcctcgcatcgtcaaggaacgtgtggggctcgcgcctccggcacgtgat

SEQ ID NO: 90723 - protein, 253 aa, Zea mays
  misc_feature: Ceres CLONE 1578765
  misc_feature (41)..(252): Pfam Name: PAL Pfam Description: Phenylalanine and histidine ammonia-lyase
  misc_feature: SWISSPROT Homolog: EC 4.3.1.5 Phenylalanine ammonia-lyase
  misc_feature (167)..(167): Xaa is any aa, unknown, or other
  misc_feature (220)..(220): Xaa is any aa, unknown, or other
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGFGGTSHRRTKDGPALQVELLRHLNAGIFGTGSDGHTLPSEVTRAAMLVRINTLLQGYSGIRFEILXAITKLLNTGVSPCLPLRGTITASGDLVRSPTSRAHHGRPTRRRPVYGRKWTPXSGQIAASRAAPQLNPGRPRIVKERVGLAPPARD

SEQ ID NO: 90724 - DNA, 1084 bp, Zea mays
  misc_feature: Ceres CLONE 1578766
  misc_feature: Encodes the peptide sequence at SEQ ID NO. 90725
tccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcgggggcctccgccaaggggcttcttcgagttgcacccacgacgtgacgtcccccaccttgcgccgacttcctgcgcccccccggcgtgcggacgcccgggatcgtgccctttctcgacggtgatccaccaagcggggggtccccggaaaacaatccgcaacccgctgcgggttttccccgtgaagtttcttccccccgccaaggggccaactgggggaccctggtgggggaaaaaactttccccgggttttttttcaatccgcggaaggggactcctaatttccccccataaggttggttccagaggggttttaaagggctcacaaccctcgcgtgttttccaccgctgcaggagaaaaatccggggccggggtgggtgttcaacactttctcttgttgtgcgcctcactcccccgaagaaagccggcggacaacccgtgggtcgttacttcccccttgaaaagacaaagggggggaggtacccttccgcaaaattttgccccacaaaggaaaaggggtcctgtggttgtgtaaaacactaaccacgttttctgtatgcccggggtgttgaaacgcgcctttccacctacatttcccacctgggggaccctgaaggcggtgtgggcgggggcgccccctctacaaataaatggagtgggcgtttttgggggagtaaataaacaaaccccgggatatgcatccgtgttagacccccggccgggggaattacttgtgagtg

SEQ ID NO: 90725 - protein, 107 aa, Zea mays
  misc_feature: Ceres CLONE 1578766
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGGLRQGASSSCTHDVTSPTLRRLPAPPRRADARDRALSRR

SEQ ID NO: 90726 - DNA, 881 bp, Zea mays
  misc_feature: Ceres CLONE 1578768
  misc_feature: Encodes the peptide sequence at SEQ ID NO. 90727
aaagctggagctccccgcggtggcggccgctctagaactagtggatcccccgggctgcaggaattcgtctcacccctagaaaaaagtccccaccaggcaatcaagaacaccacctaccgctgacttgtcaattcctgtctgtgcgcgcgcgcgcgcgtggcgccggccgagcggccgttgacccgatgaccggcgcggcggccgtcgatcccccggcgcctcggccgcggcggctgacggtcctcccgctcatcgcgctcatcttctacgacgtctcgggaggccccttcggcatcgaggactcggtccgcacgggcggcggcgcgctgctcccgatcctcggcttcatcgtcctcccagtcctctggtcgctcccggaggcgctggtcacggccgagctcgcatcggctttccccaccaacgccgggtacgtggcctgggtgtccgccgccttcggccccgccgtggtgttcctcgtcgggttctccaagtgggcgtcggggacgctcgacaacgcgctctacccggtgctgttcctcgactacctccgctccggcggcgggctggcgctgccgccgccggcccgctcgctgggggtcctcgcgctcacggccgcgctcacctacctcaactaccgggggctccacatcgtcggcctctcggcgctggcgctcaccgcgttctcgctctccccgttcctcgcgctcaccgtgctcgcggcccccaagattcgcccgtcccgctggttcgccatcgacgccggcgccgtcgacctcagggggtacttcaactccatgttctggaaccccaacttctgggaaaagccagcacgctccccggcgaagtcgaagaccccgggaagaccttccccagggggggtt

SEQ ID NO: 90727 - protein, 232 aa, Zea mays
  misc_feature: Ceres CLONE 1578768
MTGAAAVDPPAPRPRRLTVLPLIALIFYDVSGGPFGIEDSVRTGGGALLPILGFIVLPVLWSLPEALVTAELASAFPTNAGYVAWVSAAFGPAVVFLVGFSKWASGTLDNALYPVLFLDYLRSGGGLALPPPARSLGVLALTAALTYLNYRGLHIVGLSALALTAFSLSPFLALTVLAAPKIRPSRWFAIDAGAVDLRGYFNSMFWNPNFWEKPARSPAKSKTPGRPSPGGV

SEQ ID NO: 90728 - DNA, 861 bp, Zea mays
  misc_feature: Ceres CLONE 1578771
  misc_feature: Translation starting site: 186
  misc_feature: Pfam Name: Hs1pro-1_N Pfam Description: Hs1pro-1 N-terminus
ctggagctccccgcggtggcggccgctctagaactagtggatcccccgggctgcaggaattcgtctcacccctagaaaaagaggctaaactcaaaacaagaacctgataatcaacttcagtctcgtcccgtaggaggaatttgaaaacccaaacgtacacctctgatacttcagctggagctgcaatggcaacgcccgatttgtccccggtctcgccggtgcggcgggacgacaagcagtgcgcgccatcctcctcgtcgtgcacaattctgagagtgcaggacgcgtccgcggccgaggcgtacgagcagtacctgcggctgccggaactgtcgagcctgtgggaggccgggtgcttcccggagtggtgcgggcgaggtgcctggtgaagccggcgctgcaggcgctcgaggtcaccttccgcctggcgtccctcgcgctctccgacccgcgcgggtacgccagccgccgcgagctcgcgcgccggctggagtccctccccgcgccggaaggtggggctggtgtccccccctcctctaagggcaacggaaacccgccccctccccaaacttgggcgcctcccggggggggggttccccccgcaaagcccaaccccgtccaaaagggggggggaactcccccccgggagggcccccccccccggggtgtttgtggcccttttacataaaaagaggggataatcgttttccccccccttccccccccccccggggggggggataattcttaaatatccccccccccccccaaaatattttttcctcccccccccaaaaaaacaaaaataaaggagggggggggttccctctctaccgggagtggcggggaaaaaaaaaaaaa

SEQ ID NO: 90729 - DNA, 957 bp, Zea mays
  misc_feature: Ceres CLONE 1578773
  misc_feature: Encodes the peptide sequence at SEQ ID NO. 90730
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (881)..(881): n is a, c, t, g, unknown, or other
aagctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgtttcagaaccccctggcgcccgtgttcccgcgcctggcgcatggcacgtccccgacgagatgacggtgacgtggaccagcggctacgccatcgatgaggcgtacccgttcgtggagtgggcgcctgccgcccnnnnnnnnnnggggggggaacccccggaaaacgagggcgccccccgcggggaactcaccttcaaccccgccagcatgtggcgggagccgcgcccacccnccgggtggaaggacccccggttttccccccgcccttctcagaaccctgggcccaaaagaagtccccttccgttcgg

SEQ ID NO: 90730 - protein, 185 aa, Zea mays
  misc_feature: Ceres CLONE 1578773
MAVALLAALVASAAMFMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFQNPLAPVFPRLAHGTSPTR

SEQ ID NO: 90731 - DNA, 904 bp, Zea mays
  misc_feature: Ceres CLONE 1578774
  misc_feature: Encodes the peptide sequence at SEQ ID NO. 90732
  misc_feature (373)..(373): n is a, c, t, g, unknown, or other
  misc_feature (375)..(375): n is a, c, t, g, unknown, or other
ctccccgcggtggcggccgctctagaactagtggatcccccgggctgcaggaattcgtctcacccctagaaaaaatccaggaagctgatcggcgcgcgctacttcaacaagggctacgcggcggcggcaggcgcgctgaacgcgtcgatgaacaccccacgcgacatggacggccacggcacgcacacgctgtccacggcgggcggctcgcccgtgcccggcgcgtcggtgttcgggttcggaaacggcacggcgtccggcggctccccgcgcgcgcgcgtggcggcctaccgcgtgtgtttcccgcccgtgaacggcagcgagtgcttcgacgcggacatcctcccggcgttcgacgccgccatgcacgacngnttgcacgtgctgtcgctctccctgggcggcgacccctccgactacttggacgacggcatcgccatcggatccttccatgccgtccgccgcggcatctccgtcgtctgctccgcgggaactcgggccctgcactcggcaccgcctccaacttggcgccgtgggtcctcaccacgggggctagcaccttgggaccgcgagttcccgtcctacattgttcttcaacccccccaaaggccaaggcaggcaactcctccagaaagccctcgtgcttagaccgcccaaacaggggccctcccaaaaattaaggggacacaattctgtcgaatgactacgcccgccccggtaagacccccttccccccggtaccaattccgtgaaagcctgggtcttgccaatcgcgaccacttaggagggccgcccgtcggatgaatcgggccccccgggacacagggaaaagttatggcgccaatcgcgtgtgtgtcctcccggtgacccaaccccccgttgggtgcatggggacaacccactt

SEQ ID NO: 90732 - protein, 166 aa, Zea mays
  misc_feature: Ceres CLONE 1578774
  misc_feature: SWISSPROT Homolog: EC 3.4.21.25 Cucumisin
  misc_feature (76)..(76): Xaa is any aa, unknown, or other
MNTPRDMDGHGTHTLSTAGGSPVPGASVFGFGNGTASGGSPRARVAAYRVCFPPVNGSECFDADILPAFDAAMHDXLHVLSLSLGGDPSDYLDDGIAIGSFHAVRRGISVVCSAGTRALHSAPPPTWRRGSSPRGLAPWDREFPSYIVLQPPQRPRQATPPESPRA

SEQ ID NO: 90733 - DNA, 1090 bp, Zea mays
  misc_feature: Ceres CLONE 1578775
  misc_feature: Encodes the peptide sequence at SEQ ID NO. 90734
  misc_feature (800)..(800): n is a, c, t, g, unknown, or other
ggagctccccgcggtggcggccgctctagaactagtggatcccccgggctgcaggaattcgtctcacccctagaaaaaaaaaaggttcagacttcagaggtgctctaggcttcaaggggcggctgggtgagggcagagctctcaactaaatgcccaaagttaggatatatccagcaaaggacagaatgaaagtggtctctgtacaccttgctgctgctgttgctgttctacttctgttggcggcaaagcgcacccccgctattgcggttcctagccctcaatgccaatggcaatgcggcggcgttgacattgcgtttccgttcggcatcggtgacaactgctcgctttcacgaggattcaacctcagctgccaggatgtccaaagtggctttttcccccccacccccaggtaatggtgaggtgctcaacatctccttgataaatggcacgatccgggggtgtgaaaccacatctcgacttttctgcttccgtactcctcctcttggtttccttggagccccactacccgtggcatttcaatacgcggagcgggatacccctcttcctgggtttttcgcgaacgtcccataaaaaaagttcttcccgtctataaggggtgtcacttacccctctggccttaccatttaacgggattatacatcgctacactaataatctttccccgtatatcgggggcggccgtctttcgaaccagtacccaataaagtggtgttctaaaaccttatttcttgacacggtattctctgcctttcctgccaacggaggcatgccttgtcagntatctatacatcttccctcactaaaaaatatgggcgcccacatcgcataggtaactcttttcctatttgtggctctgtttaacattcgccttattcctccttgcgtttgatgccccacgctatcttgttacttaccaaccaggcttttttggagcacttaaactattttctcgtttctgtcccctagtaaactctcaatgttagagagctttcttacttaccccttcccaccgtttcgtcgacctcgttcgcgataagccctcgcgttaaaggtataccccgcccccctt

SEQ ID NO: 90734 - protein, 87 aa, Zea mays
  misc_feature: Ceres CLONE 1578775
MPKVRIYPAKDRMKVVSVHLAAAVAVLLLLAAKRTPAIAVPSPQCQWQCGGVDIAFPFGIGDNCSLSRGFNLSCQDVQSGFFPPTPR

SEQ ID NO: 90735 - DNA, 909 bp, Zea mays
  misc_feature: Ceres CLONE 1578776
  misc_feature: Encodes the peptide sequence at SEQ ID NO. 90736
ggagctccccgcggtggcggccgctctagaactagtggatcccccgggctgcaggaattcgtctcacccctagaaaaaggataagcccccgcgccggtgcctacacagtacacactgaccacgtcagtttcgccatggctacctcctccaccaccgcgctccactcgcaattccggccaccgctgcgcgctccccgccatctccgtccgcttccacactcgtattcctcctcctcccgcactcgcggctgcgctcctgtccgggcctcagcggcgtccgcatccgcgccggcccagcgggagatcgccgcgggcgtcccgtggggctgcgagatcgagtccctggagagcgcggcatcgttggagcggtggctcatagactcgggcctaccggagcaacgcttggccatccaacgcgtggacatcggcgagcgcggcctcgtcgccctcaagaacatacgcaagggggagaagctgctcttcgtgcccccttccctcgtcatcaccgccgattcagagtggggtcgccctgaggtgggagatgtgatgaaaaggaactccgtgccggactgggcgcttatcgctacttacctcataagtgaagccagtttagagggctcgtccgagtggatcagctacatagcagcgttgccaagcagccttactcccttttaactggaacctgcaaagctaatgcatactatggcctcccaatccagaaacggccattcaaagaaaactgatgggattgggaaaaaaacgaccctcgaaacgtatttttccaggttcccaattgtccccgaaaaggggtaaaaagaaaaattctagggcccttggaatttgtcccacccgggttccgtcccaaaagggggagaaggggccaattctcgggggaatatatttaaaaccc

SEQ ID NO: 90736 - protein, 179 aa, Zea mays
  misc_feature: Ceres CLONE 1578776
  misc_feature: SWISSPROT Homolog: EC 2.1.1.127 [Ribulose-bisphosphate carboxylase]-lysine N-methyltransferase
MATSSTTALHSQFRPPLRAPRHLRPLPHSYSSSSRTRGCAPVRASAASASAPAQREIAAGVPWGCEIESLESAASLERWLIDSGLPEQRLAIQRVDIGERGLVALKNIRKGEKLLFVPPSLVITADSEWGRPEVGDVMKRNSVPDWALIATYLISEASLEGSSEWISYIAALPSSLTPF

SEQ ID NO: 90737 - DNA, 1158 bp, Zea mays
  misc_feature: Ceres CLONE 1578777
  misc_feature: Encodes the peptide sequence at SEQ ID NO. 90738
  misc_feature (26)..(26): n is a, c, t, g, unknown, or other
  misc_feature (64)..(64): n is a, c, t, g, unknown, or other
  misc_feature (65)..(65): n is a, c, t, g, unknown, or other
ctgttgtgggtttattacttcaatantttaagtaagggggatgaaatttatccacacgggcaanngttagaactggagctccccgcggtggcggccgctctagaactagtggatcccccgggctgcaggaattcgtctcacccctagaaaaaggataagcccccgcgccggtgcctacacagtacacactgaccacgtcagtttcgccatggctacctcctccaccaccgcgctccactcgcaattccggccaccgctgcgcgctccccgccatctccgtccgcttccacactcgtattcctcctcctcccgcactcgcggctgcgctcctgtccgggcctcagcggcgtccgcatccgcgccggcccagcgggagatcgccgcgggcgtcccgtggggctgcgagatcgagtccctggagagcgcggcatcgttggagcggtggctcatagactcgggcctaccggagcaacccccggccatccaacgcgtggacatcggcgagcgcggcctcgtcgccctcaagaacatacgcaagggggagaagctgctcttcgtgcccccttccctcgtcatcaccgccgattcagagtggggtcgccccgaggtgggagatgtgatgaaaaggaactccgtgccggactgggccgcttatcgctactttacctcataagtgaaagcccagtttagaagggcctcgtctgaggtggaatcaagctacatagccagcggttgcccgaaggcaaggcctttacctcgccttttttaaacctgggaacttcgtgggcacaaaactcaggatggccataactctaaggaggtcccttcacccatatcccatggaaaaaccgttggccaattttctgaaagagaatacctttgatagttgtatttgggggaaccatatcaaacggaaccctttccgaagacccgttataattcttgccagaggctatcccagaaatttggtttccctgaaacaaaggctgtattatacaatgagagaacctttgtcttaatggtcccatttgggggaattcctgttccccaaaaccctggggttcgctctgggccatttaatgtttatggaaaagttttccccaccattccccttggtgcgaaattaggtctataccataacccctcgaatgtgtaaaa

SEQ ID NO: 90738 - protein, 154 aa, Zea mays
  misc_feature: Ceres CLONE 1578777
MATSSTTALHSQFRPPLRAPRHLRPLPHSYSSSSRTRGCAPVRASAASASAPAQREIAAGVPWGCEIESLESAASLERWLIDSGLPEQPPAIQRVDIGERGLVALKNIRKGEKLLFVPPSLVITADSEWGRPEVGDVMKRNSVPDWAAYRYFTS

SEQ ID NO: 90739 - DNA, 938 bp, Zea mays
  misc_feature: Ceres CLONE 1578779
  misc_feature: Encodes the peptide sequence at SEQ ID NO. 90740
  misc_feature (723)..(723): n is a, c, t, g, unknown, or other
  misc_feature (746)..(746): n is a, c, t, g, unknown, or other
  misc_feature (793)..(793): n is a, c, t, g, unknown, or other
  misc_feature (934)..(934): n is a, c, t, g, unknown, or other
ccccgcggtggcggccgctctagaactagtggatcccccgggctgcaggaattcgtctcacccctagaaaaactcacggtcctcacctcactccaccacgttcgccgcctcgctgccgcgtcgggccagtgcgtgcgggcgggcgtgagtgactggctctcctcggcgcgcggacccaggggcggcggcgatggggaagaatatgcgcatcaagacggcgcccaaggcgaaccgtgtccccctcctcggcgacggggagacgtcaagggcgctctcggacctggaagagggcagcgacgtccagccagcgaacgtcggcttctgtcgggtcatcaaacttgcgaagcatgacgccggaaagctggtcctcgccaccgcggcgctgctcgtcgcctccctcagtaaccttctcgttcccaaatatggtggcaagataattgacattgtgtcaagagatgttcggcgcccagaagataaggcgcaagccctggaggatgtcaagggcacaattttgtacattgtgacaatcgtcttagtcggttcagtttgcacggctcttcgggcatggctattcaattctgctagtgagagagtagtcgctcgactaaggaaagacttgttcagccatctcataaaccaggaaatagcgttttttgatgtggactagaacaggagagctcttaagcaggctttctgaagatcacaaataataaagaatgctgnctacaccaactatcagaggcacntgcgcatggtactactacagctattggtctttggttcatgttttcancttcatgggaagtacattgctggcacttggtattgtcccgggtatatcaggtgctgggcgtagatttggacgttttcttcgtgagctttccatcaaacacagctgctgcagctgtagcttcatccatagctggaagaatcnttcc

SEQ ID NO: 90740 - protein, 158 aa, Zea mays
  misc_feature: Ceres CLONE 1578779
MGKNMRIKTAPKANRVPLLGDGETSRALSDLEEGSDVQPANVGFCRVIKLAKHDAGKLVLATAALLVASLSNLLVPKYGGKIIDIVSRDVRRPEDKAQALEDVKGTILYIVTIVLVGSVCTALRAWLFNSASERVVARLRKDLFSHLINQEIAFFDVD

SEQ ID NO: 90741 - DNA, 953 bp, Zea mays
  misc_feature: Ceres CLONE 1578781
  misc_feature: Translation starting site: 205
tccccgcggtggcggccgctctagaactagtggatcccccgggctgcaggaattcgtctcacccctagaaaaactagaaaaaacgggagagaaagccagacaggactcctcctcccccttccctccccctaaaagctaaaaacatttggagagagagagagagggagatcgaggggaaaccgagcaaccaagacgcacacgacgatggagcgagaggacgcgtgccgggtggcgctgctggacgcggccggcggcgagggcggcaagaagcagcagcagctcgcggcgcgggtgtgggaggagtcgaggaagctgtgggacatcgtggcgccggccatcttcagccgcgtcgtcacctacagcatgaacgtcatcacgcatgccttcgccccccacctcggcgacctcgagctcgccgccatctccatcgccaacaccgtcgtcggcggcttcaacttcggcctcatgttgggcatggcgagcgcgctggagacgctgtgcgggcaggcgttcggcgcgaagaattccacatgatgggcgtgttcatgcagcggtcctggattctgctggtcatgtgccgcggtgctgctgctgcccatgtactttcttcccggaaggagtgcttgctgctgaccggggcagccgcccggagctggcggcgaatggcggggaaaggtgttgcttgtgggttcatccccgttggactttctccttggacattctctttccagctgcagggctttctgggagtggctgaagtaggaattcggtcaacgcccgccgcccgcggaggcggggctttgggtgtcacctcctcgccaggcgggttccttcgtctccaggtttccctttttggcccccgggggattgccctcccggctaaacttctcctggggggtcacgggggtcctgcccctcgcccaactggcatgggggtggtgcccgcaaactgg

SEQ ID NO: 90742 - DNA, 1004 bp, Zea mays
  misc_feature: Ceres CLONE 1578784
  misc_feature: Encodes the peptide sequence at SEQ ID NO. 90743
ggagctccccgcggtggcggccgctctagaactagtggatcccccgggctgcaggaattcgtctcacccctagaaaaaaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaagaaatatgctgatcctaatgaagtcgctgccgtcattttggggtgggggtaccggggactcagctttttccctctcacaagcacaaagggcaccccctgctgttccctattgggaggaatgttacagggcttattgatatcccccatgaagcaactggtttccaacagtgggcattaaacaaaaaaattttgttaaagaactaaattttaaatctcagctttttctttaaaccggcacatttcatcggtaccctatcttggggggggggggggaaccaaccttcccccgaagggaaacctgttgaagggcgcgggcctgccaaacacaaaaaccctgtgggaaggcctccctggttttttttcccgggggcacaaaaaaaacccccgttaaaaaaattttctcggggggccctttggggagtttttcccaccgcaaaagcgtttaaaaccccttttgtttttttggcggggaaaaacccccctctcccagagggaaaaaaaggagggtgggggaaaaaaatggtggaagaaaaagggaaaaaaatctttttgtgcgcccccctttggaaagaagccccacctcttccttgtgtt

SEQ ID NO: 90743 - protein, 136 aa, Zea mays
  misc_feature: Ceres CLONE 1578784
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFSARGAVSSTQCVLTSDAGPDTLVVRTSFRKKYADPNEVAAVILGWGYRGLSFFPLTSTKGTPCCSLLGGMLQGLLISPMKQLVSNSGH

SEQ ID NO: 90744 - DNA, 969 bp, Zea mays
  misc_feature: Ceres CLONE 1578788
  misc_feature: Encodes the peptide sequence at SEQ ID NO. 90745
  misc_feature (535)..(535): n is a, c, t, g, unknown, or other
  misc_feature (664)..(664): n is a, c, t, g, unknown, or other
  misc_feature (706)..(706): n is a, c, t, g, unknown, or other
  misc_feature (707)..(707): n is a, c, t, g, unknown, or other
ctggagctcaccgcggtggcggccgctctagaactagtggatcccccgggctgcaggaattcgtctcacccctagaaaaacgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagcagcaccgccaccccgccgcccccgccatcgccgtcagcgacagctccctcaagttcactcatgtgctcaacaacctctcgcctgctgagctgtacgagcaggccatccagtacgaaaagggggccgtttaatcacgttcacccggggccccttggcaacccttttccggttcccaaaaaccggggggggttccccaaggggacaaaggcgcccccctcaaaggaacaaagggtccccccccccaggggaaactcttgggtgggggggggaaaagagggtcctcccccccaccactttttntaattttgggggcccacaaaaaaaaaacccttttttctttgtagaaaaaatatatgggggtttataaaataattgggggtctccacccaaataaatattatttatttctcaataaatatcaggcccttnttttatatataaataaaaggaaggttgttttccttctttctnnacaccaacccccgggcggccccccccctcccctcttttgcgtgggggggggggcgccccccccccaatcacattctcccccccctctttgttggtgggcgttaccctccacaattttctcttttcctctccgtgggtgcgtggtggggttgatgattcatttttcatcccccacctcccccttttttattttgtgttttttaatcgcatacattccgctctgctttttctcctgttgtcacccacccccccattgttaaaag

SEQ ID NO: 90745 - protein, 86 aa, Zea mays
  misc_feature: Ceres CLONE 1578788
  misc_feature: SWISSPROT Homolog: EC 4.1.1.49 Phosphoenolpyruvate carboxykinase (ATP)
MQSISASLASLTRETGPKVVKGDPAAKGEAAAQGAPSTPRAHQQHRHPAAPAIAVSDSSLKFTHVLNNLSPAELYEQAIQYEKGAV

SEQ ID NO: 90746 - DNA, 1064 bp, Zea mays
  misc_feature: Ceres CLONE 1578789
  misc_feature: Encodes the peptide sequence at SEQ ID NO. 90747
  misc_feature (410)..(410): n is a, c, t, g, unknown, or other
  misc_feature (906)..(906): n is a, c, t, g, unknown, or other
ggagctcaccgcggtggcggccgctctagaactagtggatcccccgggctgcaggaattcgtctcacccctagaaaaaacacccaccagtccaccaccactgctcgcactcactccaccgctgcccacttcttgtttgtattgtatccagactccagaggaagccgagagggccaatgaggcaaggcatgagctccccttccgccgccgcggcgctcgtgctcctcctggccctgctcgccggaggccagtgccgagaggcccagctcgacgccgcggacgccggcaccggcacggaaactacaccgccagcgacgcccccctgtactggggcccctgggagatggcccgggccacctggtaaggccagccaaaggcgccggccccaaacacaaccccccccccccccantcaaggggaccaaccagtaccccttcagggccatgggctcctgggggaaccaagccttggttcaaggacaggaaaggggctggcggctcccgcctaaaaaatttgggggcaaggaaagaaccccctccctggctccggggggggaacggaaacggtgtattcttctccccaaattgtaaatttcttacccggggtggtcaaagatacccaacttcaaaccctcaggggggacactgggttttcgggagaggaggtggggacaaaaccccggcggcctcaaaaaaaaaaaaaaactccctccccaccctcccgcgggtatatttcccaaaaatattaatgtttttcccacgcgggggtgccccctccaaaaattttcccccccgcccccataaaaaaaaaggggggcccccccggcgggggagagatattcttaaaccccccgtgtttctttttgcgggggccgttgggggtatttttaataaattctcgctccccncatatcctgctccttcgggggcccccttttgaggttcaaaataaaggggcccgccccccccacaaaggggggggggtgaaccccataatccgagcctgtgggggtgccccctgggggggggaggaaccagcacctctcgtggggcccctctcccaccc

SEQ ID NO: 90747 - protein, 137 aa, Zea mays
  misc_feature: Ceres CLONE 1578789
  misc_feature (79)..(79): Xaa is any aa, unknown, or other
MRQGMSSPSAAAALVLLLALLAGGQCREAQLDAADAGTGTETTPPATPPCTGAPGRWPGPPGKASQRRRPQTQPPPPPXKGTNQYPFRAMGSWGNQALVQGQERGWRLPPKKFGGKERTPSLAPGGERKRCILLPKL

SEQ ID NO: 90748 - DNA, 948 bp, Zea mays
  misc_feature: Ceres CLONE 1578791
  misc_feature: Encodes the peptide sequence at SEQ ID NO. 90749
ggagctccccgcggtggcggccgctctataatagtggatcccccgggctgcaggaattcgtctcacccctagaaaaaccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggagctgcgtgcccgctcaatgccttgtgctatgctgaactggcgtctcggttccctgctgtggttgggggagcatacttgtacacgtacgcagcgttcaatgagatcaccgccttcttggtcttcactcagttgatgctggattaccatatcggcgcagcaagcattgctcgcagcttagcaagctactttatcgagttcttggagctaatcccgttcttgaagggccaaattccaagctgggtaggccatggggaggagttttttggtggtgttgtatcaattaacatactggcccccgttcttctcatcatcttaactgcgattctctgctatggtgtcaaagaatcatcagcagtggacacgtttattgacactttgaagataatcattgttataggcattgtatttgctggtgttgtttgaggtggatgtattaaacttggtctccgtttatggcaaaatgttttcaaatctgtaggtacgggagccccagaagtcttttttgcaaatgttgggatttgatgcgggtgctaattccgccgaggaaagccaaagga

SEQ ID NO: 90749 - protein, 231 aa, Zea mays
  misc_feature: Ceres CLONE 1578791
MEEARDHRLSSTAGRPFLSGFCAAALRRKPLGARASAAAAATGEGLVRQLGVLDLVLLGIGASIGAGIFVVTGTVARDAGPGVTISFVLAGAACPLNALCYAELASRFPAVVGGAYLYTYAAFNEITAFLVFTQLMLDYHIGAASIARSLASYFIEFLELIPFLKGQIPSWVGHGEEFFGGVVSINILAPVLLIILTAILCYGVKESSAVDTFIDTLKIIIVIGIVFAGVV

SEQ ID NO: 90750 - DNA, 1252 bp, Zea mays
  misc_feature: Ceres CLONE 1578792
  misc_feature: Encodes the peptide sequence at SEQ ID NO. 90751
  misc_feature (62)..(62): n is a, c, t, g, unknown, or other
  misc_feature (63)..(63): n is a, c, t, g, unknown, or other
  misc_feature (775)..(775): n is a, c, t, g, unknown, or other
  misc_feature (837)..(837): n is a, c, t, g, unknown, or other
  misc_feature (1125)..(1125): n is a, c, t, g, unknown, or other
accgggaggaccgaaaacagcacccaaaaaaatctactaattctccctgtgggggggggccnnacaaactgggactccccgcggtggcggccgcctcccaacagtggatcccccgggctgcttgtattcgtctcacccctagaaaaaaagaagagcacgcccactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgccgcggcggcggatctggcggggacccacctggacgaggtgaagcgcatggtggcgcaggcccggcagtcggacacaaacatcaacggatccacgctccgcggagggcaaaaggcccccgtcgcacccgccagagaagcgaccggacccccccaccaacctcaaagacgacgccccacccccagcaaaaggccagcaacaaaggggcaggctcagactggggtggcgaacgcgcggcgaacatacggcgggagggcaccacgccgctcacctgctgcctcccgcccgacagagaaggaccccgggggaacggagccaccagggctagcgaggggacgaagaagggttttatggaccatccgcctaaagaagatggaaaacccgttgtcagggacacaggaggctatactccagagggtggaagccctattggagcggacgggattganttaagaaacgatccgagccatggggggcgaatcgaggtcacaaaaagaagccgcgaaggtgnggccgagggacaggttgaagtaaaacggacgtcgccgattggagagagtggcgcgcaagcgcggcaagagagaggttaagtgggagaagtgaggagcgagacctcgattctaggaagcgcagtcgcggcaataaaaccctcggggtgaagtatacccgcggagcgggacgatccggggcgggctatgagctcgcgcacgcggaggtgtcgctagaaggaacacctggccgccaggagaggacacgcagcatggtctgggagagaagattgaagggcggtaagacagantcccgatgcacaagctcaaaccacacagggccccgttgccacccgaccctcggaaggcgccgtagagtgggataagaggccagacgcaagcgacagagagggggagtgagatagggcggcgcgccac

SEQ ID NO: 90751 - protein, 165 aa, Zea mays
  misc_feature: Ceres CLONE 1578792
  misc_feature: SWISSPROT Homolog: EC 4.3.1.5 Phenylalanine ammonia-lyase
MAGNGAIVESDPLNWGAAAADLAGTHLDEVKRMVAQARQSDTNINGSTLRGGQKAPVAPAREATGPPHQPQRRRPTPSKRPATKGQAQTGVANARRTYGGRAPRRSPAASRPTEKDPGGTEPPGLARGRRRVLWTIRLKKMENPLSGTQEAILQRVEALLERTGL

SEQ ID NO: 90752 - DNA, 948 bp, Zea mays
  misc_feature: Ceres CLONE 1578795
  misc_feature: Encodes the peptide sequence at SEQ ID NO. 90753
agctccccgcggtggcggccgctctcgaactagtggatcccccgggctgcaggcacttcgtctcacccctagaaaaagtacgtgtgatcgccgaaaaccccaccgccagtcaccactattcatcggccatggccgggcggtggctccaggtgactctcgccctcgtcgtcgtcacggcggcggcaacgacgctgtcctcagcccagcagacggcagcatcgttcccggccatgcccagctgcccgccggcgccgctcagcctgtccccgtgcatcggctacgtcttcggcgtcggctcggcgacgctcgcctcctgctgctcccagctccgtggcttcctccaggcccaggcgccgtgcatctgcgccgcatccaagctcgcgcccagccccatcggcgtgttcctcggccaggcgcagggcatgatccccaacgtctgcgacctgcccagcccatgcgatgccggcgccgccggcgagggctccaagccgccggcgggagacacttcgcctgtgtctacgacgacgactccggcagctgaaccgtcgacgggcgcgcctgccgctgctgttccagacgcgtcaggagcaccgccggcaccaacatcagatgattctgccactgcaatggcaccggcaggcaccgcatcgaagcgaccgtaactactgcatgcagcatgcgcgacaagctccagagacgtggctgcatgcactgtattcgtcgctgtgtttcttgctgcacttgcaaccatgtatgtgtaactgttgtctgctaagctaccattagatcacaaaaaaaaaaaaaaataaaaaaaaaccgctctgctccgtgtcctcctccctcgttcctcgtcccggacgcctccgcgcgcgatgcgcccgcctcgcgccccagaactcccgccgcccgggggcaaattcagggcgctggcctgcaaatgctcaccgg

SEQ ID NO: 90753 - protein, 177 aa, Zea mays
  misc_feature: Ceres CLONE 1578795
  misc_feature (38)..(110): Pfam Name: Tryp_alpha_amyl Pfam Description: Protease inhibitor/seed storage/LTP family
MAGRWLQVTLALVVVTAAATTLSSAQQTAASFPAMPSCPPAPLSLSPCIGYVFGVGSATLASCCSQLRGFLQAQAPCICAASKLAPSPIGVFLGQAQGMIPNVCDLPSPCDAGAAGEGSKPPAGDTSPVSTTTTPAAEPSTGAPAAAVPDASGAPPAPTSDDSATAMAPAGTASKRP

SEQ ID NO: 90754 - DNA, 936 bp, Zea mays
  misc_feature: Ceres CLONE 1578797
  misc_feature: Encodes the peptide sequence at SEQ ID NO. 90755
  misc_feature (765)..(765): n is a, c, t, g, unknown, or other
ctccccgcggtggcggccgctctagaactagtggatcccccgggctgcaggaattcgtctcacccctagaaaaaacaccacccactctaccctcccctccccaccaccactagcacccaccgtcccggcgcggagaccgcttccctccctccgcctccgcaaccctctcccgcctcgcccgcgcctccctccatttgtccgcggctcccctccctcccgatcttaaccacccgccacccggcttcctctcccccttcttcctccctcaaaccagacgctcgcccccctttcctccacctatcttcttcagacgaccagcaggaggtacgagcaagaccacctaggaggcctctctctctctctccccagccacccccgtagcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaagccagctatgagaatgtttcgaagaagtggatacctgaactgaagcattatgcacctggtgtgccaattattctcgtagggacaaagcttgatnctcgagacgacaagcagttctttgtggaccatcctgatgctgtccctatcactactgctcagggatgaggagctagaaagcaataagcgcgtcatactacatcggatgcagctcgaagacccactaaacgtgtagggcggtcttgatgccgcgaataaggtggtgctgcac

SEQ ID NO: 90755 - protein, 103 aa, Zea mays
  misc_feature: Ceres CLONE 1578797
  misc_feature (8)..(102): Pfam Name: Ras Pfam Description: Ras family
MSASRFIKCVTVGDGAVGKTCMLISYTSNTFPTDYVPTVFDNFSANVVVDGNTVNLGLWDTAGQEDYNRLRPLSYRGADVFLLAFSLISKPAMRMFRRSGYLN

SEQ ID NO: 90756 - DNA, 1275 bp, Zea mays
  misc_feature: Ceres CLONE 1578800
taccccccctacttctttttacgcgcgcttttgcccccgtatattttattttttcgtctcttttcaaagctggagctcaccgcggtggcggccgctctagaactagtggatcccccgggctgcaggaattcgtctcacccctagaaaaatagggaacacaagtgcgtcgtggtggtgctggcggttttgagttttgacccaccattcccgcattccttctcttctgcatcggcggctgcggcagccaggaaacgcacaccaggaagaggagcggtcgattcccaatctttatacgattgatctctgttaccaattgtatagccattccttcctgttcattgggcgtggggtttcaacctaataaatcggcccttttccgggcaactagtggggagtggagtcgctgagaataccaccccttttcctgccccaagatgcctgtttccgcttcttttctacggcacagcttcccaacaaccttcggcctcagctccccttttgcaggactaagtgtttctccaccctgcttggagtttggaggggggcagaataacacccttcctggggcgatttcccggaaaaaatggcctgaaaccctaagggtcaggttaagaagcgggcgtgtgcgaactggcaactgccgccggaaaggccaaaattcctggccaaccgggaatttgggaaactcgcctggcctcttccctgggtcattgggcccacccggtggagtcaaccccttccgcgggggtttttgaataggcgccgactgagtgcggggtgttttaaacccccccctgcgggtggggaaataatctcgcggactaaagagtaccgtttaccgtacgcccgcggctcgggggtcgcggggaaacatctcattgattcgctcgagtccatatgtgggcccctcatacaccgggatcttgggggggtttctggtggttccccccgtggggcgaaacctcctcatccctagagggtccatccccggtcggacctggggaagaaccctcctctggggtagaccccgatttctgcgcgtacagatggctttccgccccgggaattgtttgtcccaataaatcatgctttgtctttcgcgggtaaaaggggatgggggcctgccgaatgaacaatgggagaaacaaagagtagtgcgttataaagtctatggtaataagggtctgttatattactccccccataaaaggcgtgtatccgaaggagataacttcaggagacggggtgtaaaaagcgtcccgcagacacttttgg

SEQ ID NO: 90757 - DNA, 976 bp, Zea mays
  misc_feature: Ceres CLONE 1578802
  misc_feature: Encodes the peptide sequence at SEQ ID NO. 90758
tctccgcggtggcggccgctctagaactagtggatcccccgggctgcaggaattcgtctcacccctagaaaaaatccagcctcgagcaccgggacctgccgcgtgcttcttactggcaacttggcaagtggcacggccgcacggatccatctccatcgtcgaggcgaggacgaggaagcagatcgaagcacccaaccacaccacactgagtggtgagtggttgctggcgatggcgatggaagcgatgatgagcgggctcaactccggcgtggtgctcagcctgatcgccgtgctgtggacggtggtgtggcagaacctgcagcacctgcagctgcagcagttcttcgcgcggcagctgagccggagcgcgcggcggctggcggcgatggtgcacccccacctgtcggtcaccatcgccgagtacgagggcgggcggatgaagcgcagcgacgcgtacgaggaggtcaaggcctacctcagcgacgccagcgcccacggcgtgcgccacctccgggccgagtccgccaaggacgccgacaagctcgtgctcagcatgtcggacggcgaggaggtggaggaccacttcgagggcccgagggtctggtggtgggccttctccaaggagccgccgcgctcggaccggcccccggcgtggtggaaccggtggcggcgtcgcccggccaggaggatcccctctttcggacgcctctttctccctggaacaactgacggcagttgatgctagacccgtatctccccccgtttccctcaggtggtgccgcgtccgtcattggggttaaacccccagggggaaactggtccccatccttcttcactcaccgaggggaatctaccggggtgtgtcaatacggtggggggggggaacccccgtggggttttgtaatccaccgcgatggttccgcacccttttctgcgcgagaaccggcggaaatttattcaggtgctgcgacacccc

SEQ ID NO: 90758 - protein, 167 aa, Zea mays
  misc_feature: Ceres CLONE 1578802
MEAMMSGLNSGVVLSLIAVLWTVVWQNLQHLQLQQFFARQLSRSARRLAAMVHPHLSVTIAEYEGGRMKRSDAYEEVKAYLSDASAHGVRHLRAESAKDADKLVLSMSDGEEVEDHFEGPRVWWWAFSKEPPRSDRPPAWWNRWRRRPARRIPSFGRLFLPGTTDGS

SEQ ID NO: 90759 - DNA, 1251 bp, Zea mays
  misc_feature: Ceres CLONE 1578804
  misc_feature: Translation starting site: 238
  misc_feature (54)..(54): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (327)..(327): n is a, c, t, g, unknown, or other
  misc_feature (336)..(336): n is a, c, t, g, unknown, or other
  misc_feature (699)..(699): n is a, c, t, g, unknown, or other
  misc_feature (845)..(845): n is a, c, t, g, unknown, or other
  misc_feature (965)..(965): n is a, c, t, g, unknown, or other
  misc_feature (1013)..(1013): n is a, c, t, g, unknown, or other
tgcggggggggccggtgcgcggcccgcctcttttttttttcccgcaccaccatnnttnnnnttnnccacagctggagctccccgcggtggcggccgctctagaactagtggatcccccgggctgcaggaattcgtctcacccctagaaaaaatggagcctgacccttacgccttcgctcgcgccgccgccgccgccggcgctacgccccgcacctcgcttcattgcgtgtcgccaagatgacgaagcgcactaagaaggcaggaattgttggcaaatatggaaccaggtatggggcgaggttggggaagcaaatcctgaagatggangtatctcancattccaaggacgtttgcgagttctgtgggaaacccggctggtgaagaggaaagcagtgggaatttggggggggaaggactgtaggaaggggagggctgggggagctcacaccgtgaacactgccccccgcccgtcatccgttgagacgtggatcccgcccccttgaggaaccggacccgaagcatggcttaggcccctcgaggtttattggggggtgcgttggttgttggcttgggtggggggagggtggggcggcggcctcacccggggggggaaaggtggggtatccccccccccctcgcctggttttcgccccggaacaaagggatggttgttttgtttccgccctccccgcccccgangatattctaataaatgatttataccgtttagaccaagttgggcgctgtgggtgggagaggctatatggccgcgtttgctgcgcatgcaacagggacgcgtctgggacgctccggaaagaaaagaaaaaaaacgggttgccgccggntagcgcccgccgtggaggcggcacttcttgtcggtggccgccgttcctctgagttaagaggggcggtgttcggtgtgtaccccgcccggggggagcggcctgtgtaaagggggcagtagngggcgggttgccatacttgatgggcgaacctggccgggagggtgggtnctgcgggcgcaccatatgctgtcgcctgcctccagtctcgctcctaggagttgttatttgcggcgagaacgatcttgagaggtccattttcgttttgtatcccaacgatcgggtccccggtttgtcttttgtgggcggagtagtcctctcgaataacaccggtcgcacaacgggatgtggcctacccggcgccggcgtatgtcggctttagactgggtcctcgcgttcactggtaccg

SEQ ID NO: 90760 - DNA, 935 bp, Zea mays
  misc_feature: Ceres CLONE 1578805
  misc_feature (485)..(485): n is a, c, t, g, unknown, or other
  misc_feature (486)..(486): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (498)..(498): n is a, c, t, g, unknown, or other
  misc_feature (499)..(499): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaaagaccaccagggcaccagcaccaccacccagttacccaccaagcagcagcggtcgccgtgcgtgccacgcctctcgctctctctctctctctctctctaccgggaagcaagcaaccgcctccgccgcgccgtctcgggctcgcttggtgcagatcgggacccgccgcccggccgacgggacggatcccgccttgcatcaagtgaatcggagccggcgcagcgatacagcgaccgacccccgccgccgtccgccacctgcgctgctcttgagtaccctcatgccgtggcctgcttgttgcgtgcttttttttttgtttttctgatacgggtcgtgcgcgtgcgttggtgtggttctgtcttgtgtgacgctgtgggaattattaggcgtctgggtgggttggggtggggggnntnnntnnnnntnnttttttttttttgtttattaatttaaatnaagcggatatgttttaatttataaagagtattgttctttattaatgtgaccacggctctatgacctgtttcgtccctttgtaaaggacccttttcccctttccacactttaatctgtaaaaaaggtctgtgtccccagaaatacttatctcgtctggtaatacccttttgcccggtttttcatagtcttttgaaatacgccgacgagtcggttacgttttagattgttggttgatgccctcccgcctttgtttcacgtgtcttagggttccatgacatttgaggatatcacccttgggcgcacgttcttattcgccgccgcgatgttgtgtgtggcgttttttttaattcgacttctctgtgtagccgcgcccccacaccggtggtttgattgattatacacctcac

SEQ ID NO: 90761 - DNA, 1046 bp, Zea mays
  misc_feature: Ceres CLONE 1578807
  misc_feature: Encodes the peptide sequence at SEQ ID NO. 90762
gcggtggcggccgctctagaactagtggatcccccgggctgcaggaattcgtctcacccctagaaaaatgacggccggaatgagctccatgagcttcaagatgaaggagttgttccaggggcagactcccgctgataagattgttgaggacgccacctcggagaatctggacgggcctgattggaactcaaacttggagatttgcgacttgatcaacacagagaaagttaacagtgtggaacttatacatgggatcaagaagaggatcatgatgaaggatgcgagagttcagtacctctcattggtccggcttgagactattgttaagaactgtgagaaggccttctcggaagttgcggccgaacgggttcttgatgagatggtagaggtcattgatgatcctcaaaccgggggtgaataacaggaacaagggcccttatgctgatttgaagcatggggagagtccgggtgaagaactcccccttcctgcgcgttcttggagggaaacgtcaaacaccctcggaattcaaaattgggggttttcctgtgacttggacaatgagagcttgggctcccccttttttccccccccccccctactattgtctctaaaacctggtatgtttgaaaaaccggttctgtgccccaccaggggggttttggataaaacacctccgggggtccttcatttgtacggtggatggaaaaaaacaaaaaataacgcttttgtttgtgctcccttcaataaccctaagaaatcctccttttgcaatgttttgttcccctctcttcctctgagagtggagctcctctcccgtgtggttttttggcggccctcctttccctggtaaatttagtccccgtgcccgcccacccctctcgatatatttctgggtctgcgtagcaaaccaaaacactttttgcttttgtcggcctcgtgtggtacatagagctcggatttgttttgttttcggacaatgttaattacccgggcttccgcgttgtagagatacaatttgtttcttcgtttgtcctcctaagagatg

SEQ ID NO: 90762 - protein, 117 aa, Zea mays
  misc_feature: Ceres CLONE 1578807
  misc_feature (16)..(115): Pfam Name: VHS Pfam Description: VHS domain
MTAGMSSMSFKMKELFQGQTPADKIVEDATSENLDGPDWNSNLEICDLINTEKVNSVELIHGIKKRIMMKDARVQYLSLVRLETIVKNCEKAFSEVAAERVLDEMVEVIDDPQTGGE

SEQ ID NO: 90763 - DNA, 981 bp, Zea mays
  misc_feature: Ceres CLONE 1578808
  misc_feature: Encodes the peptide sequence at SEQ ID NO. 90764
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (530)..(530): n is a, c, t, g, unknown, or other
ctccccgcggtggcggccgctctagaactagtggatcccccgggctgcaggaattcgtctcacccctagaaaaaagctttaccatctttttcttcctcgcgccgccgccgccgtgacggaaggaagaggaggagcaaggagcacgacgcgatgggtcactccaacgtttggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgttgaagaggccactgtgctgctgtggagaacttcctacatcaaagaaatgggtccttcattagaaggcctaatttatgccctttagctttttgttcagaacttgagactcatgtgttaaactcgacttgttaaagttttgatggctactttgtgcttgttggaccagctataatcagaagattgaaattttctcaaaacnnnngcggagacgnagaattgctctcaccgtacaatgttcatgtggctccgttctttctttttttttcccctctcctcccaaattggttccccctacggttatttttttgcccaatggaacaccaaattttgtattcgccctcctgattttctggggaaaccccccctttggtgccccctcgcacaccctagtggttttttctttttgggggaggggttgcaaatcccggcccccggggaaattaccgcccaaccaatttaaaaaacccccttttgtgttctcccttaccccccccaaccgaaggatttttccaatgtgggaactcctttaggggcctcctctttgtattcccgcgtgttcgaagaagccctcttcttcgcggccccaagaaatgcccccccccccccggtattgggtcggaaactctgcggggaaaacacacctcactgggcgtttccctgcgg

SEQ ID NO: 90764 - protein, 56 aa, Zea mays; identical to SEQ ID NO: 1999
  misc_feature: Ceres CLONE 1578808
  misc_feature (3)..(56): Pfam Name: Ribosomal_S14 Pfam Description: Ribosomal protein S14p/S29e

SEQ ID NO: 90765 - DNA, 1160 bp, Zea mays
  misc_feature: Ceres CLONE 1578810
  misc_feature: Translation starting site: 112
  misc_feature: SWISSPROT Homolog: EC 3.2.1.23 Beta-galactosidase
ggagctcaccgcggtggcggccgctctagaactagtggatcccccgggctgcaggaattcgtctcacccctagaaaaaatttccactgtgctccttctcgccgactccgccatgaccgcctcgccctacccgacgacgccgtggctgcggccaccgcctcctatggcatttctgagtctcctcctcctccttggctgcctctccccgtcgatctcactggcgggtgcggaggcggcgggggttctgaaacaagtggttcgtggggacaacggcgggacattcttcgagccgttcaagggacctacgactcccgcgcgcttatccttggcgggaagcgcatgatcctcgtccctgggggggggcactacccgggtgccacctcgcagatgtgggcgtggtgtgtttgctcctccaatgttggccggcatgggaggggcttgagacacgtgggtgctgggaatggggtattggcccgtgctatagccccggttttccccccccatggaggatttttttcgtgtgcggggggtccccctagggtggggtttgcaagcgtgaataggcttgtttttcccgtgcgcctccctgaattctgtggtcgcttgccgcgctgcttgcgccataagggcaacatttttgtgggtgtgttgtggccgccgggcgtgtgtgtggcgccgcgtagatcgttttgctcgtgggccgggtgggagatgtgttccggggcacgcgggcgggtgaggtgtttatcgcgcgcgttgtggttggcccttgaccataggttcgctcgtccggtcttgtgatcgtggaaatggtcacctcgtcaatgtgtgtgttggcggcggctatccccgggtgcgcgttgagccgccgggtcgctgtcttgtggggatggttggttgggtttcgctttggtgtcggttgtgattggataaacggcccggggcgacgtatgtattctgtgttgtatcggttcgcagactgttcgtgcgcgtcatgcctgtgttcggtggtggttcctttctcgccgctcggtccggttttcaccccacaggcgcatatgagtctctgtgggcacgtgtccggggactgctgcgtcatctgttcgccgtggtggggtgctttgggttgtcccccgtcactcttgtctagcgtgccccgcc

SEQ ID NO: 90766 - DNA, 1333 bp, Zea mays
  misc_feature: Ceres CLONE 1578814
  misc_feature: Translation starting site: 245
  misc_feature (62)..(62): n is a, c, t, g, unknown, or other
  misc_feature (63)..(63): n is a, c, t, g, unknown, or other
  misc_feature (66)..(66): n is a, c, t, g, unknown, or other
ttttccggtctccctccttgaatgagcgctctatggctttgtggtctcccgttttttttgtnnctntcaaaactggagctccccgcggtggcggccgctctagaactagtggatcccccgggctgcatgaattcgtctcacccctagaaaaaatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcaacgaggccaccaacgacgataactccgtcgtcgctctgcaccctgacaccatgggagaggctgcagctcttccgcggcgacaccggtgctcctcaagggtaagaaaaggaaagaactaccccccattgtccttgcggacgatacctgggaggaggccaaaaggttcggatgaacaaaggtgtcccccagaaccccaagggtggaggcttgtttgaaggtggtttctcgcccccccagtgcccaggaattcgtaaattagggggaagaggggggtccacatttccttgccaaatgggatggaaaacaagtctcaaaagggcatttactccggggaaacccttgtttttgtatatcccccttcctttgaaaaacccatttattttctccttagtaaaagcaataaaccatgtgccccctttcgttatgggaaaaagcggaagcaccccctcttttcccctccttgtgttcgcggcatagggatggcgtacaattgcaatgcaagtgggtgtggcgcggtgaaaatctcttctcttataagtggcgggatataaggaagaagaaacttgtgaattccaccctgggtcgcgagtgaaaaaatctgtgtgtgaaatccctccatccatgtggcccgccggctaaacacctcggacgaaaataatattttttctttgtgagaaacagaggggtgaaaaacgctctctttctattaaataagcgtggaagccgaaccgacgagtgacccccgccccctcgtgcattgataaaagtcggcgcgacaataatattacaaagccgttccgtgggtcagaattctacgaaaaatatacatattgggtccccactaatcccacgaaatagcaccctctcatgagagctatgctctgactagtgtttcttcctccgtccgttgtttatcaaatatctggcgggcgtgtaaataccccctcaagaggggtgtattttgcgccgcatgacggcct

SEQ ID NO: 90767 - DNA, 881 bp, Zea mays
  misc_feature: Ceres CLONE 1578816
  misc_feature: Encodes the peptide sequence at SEQ ID NO. 90768
  misc_feature (603)..(603): n is a, c, t, g, unknown, or other
aaagctggagctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttggggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttcccgtgaccaaaagatatcaaagaacactttccggtcttcccncccgtgggttgtctgtcatctgggctctgaaacgatggcaggtcctgcaaatttgttgctggctgccccctccccctgtcttttgggattggggttccaagggattttaagaaacccccctggaaatcaaccttctcctaaggaaccctgttttgggctgaaccccccccgaaaggggaaacgcctgggcccctcccccgggccccaaatagaaactctttttttggaacctttgccggggggccccattgtggtgccaaacctcttaaagaaagaat

SEQ ID NO: 90768 - protein, 51 aa, Zea mays; identical to SEQ ID NO: 13325
  misc_feature: Ceres CLONE 1578816
  misc_feature (1)..(51): Pfam Name: AdoMetDC_leader Pfam Description: S-adenosyl-l-methionine decarboxylase leader peptide

SEQ ID NO: 90769 - DNA, 931 bp, Zea mays
  misc_feature: Ceres CLONE 1578818
  misc_feature: SWISSPROT Homolog: EC 3.2.1.21 Beta-glucosidase
ggccgctctagatctagtggatcccccgggctgcaggaattcgtctcacccctagaaaaaacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgtaccaaattgaaggtgcttggaatgaagatggaaagggggaaagcaactgggatcacttctgccacaatcatcccggaaaggatactggacgggagcaattcagaacatggagcgaaatcctaccatatggacaaaacggacgtcaaattgctcaaggaaatgggcatgggacgcctaaagggttccctatcccctggggccagaatccctgcccaaggggaacccaatagaaggggggttttaaccccgaaagggcgtccaggtccctcaggaaaaccctcttccaacctggtttggccgggaaaacggcgctaaaaagcctcttttgttaaaaatttttcccaccggggggtggccccccccgccccctcaaaaaaaaatatccgcgcgggcctccccaaaataaaaggccactaaaaacctctggggaaaaaattccccccaccctccgcaaaaggggggcttctataaatcccccgggaaaaaaggaagaaaattgggtcccccctttaagaggccccacattatttctttttttttct

SEQ ID NO: 90770 - DNA, 951 bp, Zea mays
  misc_feature: Ceres CLONE 1578821
  misc_feature: Encodes the peptide sequence at SEQ ID NO. 90771
tggagctccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcagccgtggaggcggcggcggtgggtacggtggtggccgtggaggcggcggctacggcggtggccggcgccgtgattgcagcggctgctaccgccgtgggcgcggcggctacggtggcggcgccggcttccgtgggtgttgggggcggctacggcggtggcaaccggggcggggggtacggggacccccaaagggaatatggaggaactgagcgggggggccccccccggccatgttttctggtcccccccccgtttttgttaccccattcccgaggggttttcctcgccccccccccccgtttggtgggttcccccccctttgttttttttatgaaagggcgcctttttttgcacaatgggttagggcgggggtacctccccggggcctcccgaaaaccttgtgtttaaaccacaaggggggggggggtatattttggtggttgtttcccccccgcggggggttttctcccaaatttattcttaggaagaaaaagggggcgcctctggg

SEQ ID NO: 90771 - protein, 157 aa, Zea mays
  misc_feature: Ceres CLONE 1578821
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGSRGGGGGGYGGGRGGGGYGGGRRRDCSGCYRRGRGGYGGGAGFRGCWGRLRRWQPGRGVRGPPKGIWRN

SEQ ID NO: 90772 - DNA, 885 bp, Zea mays
  misc_feature: Ceres CLONE 1578822
  misc_feature: Encodes the peptide sequence at SEQ ID NO. 90773
  misc_feature (543)..(543): n is a, c, t, g, unknown, or other
  misc_feature (561)..(561): n is a, c, t, g, unknown, or other
  misc_feature (612)..(612): n is a, c, t, g, unknown, or other
  misc_feature (613)..(613): n is a, c, t, g, unknown, or other
  misc_feature (638)..(638): n is a, c, t, g, unknown, or other
  misc_feature (713)..(713): n is a, c, t, g, unknown, or other
ctggagctccccgcggtggcggccgctctagaactagtggatcccccgggctgcaggaattcgtctcacccctagaaaaagtcctcctgcgtcgccactcgccagagcggagcagcgagcggcgcgcgcgatggcaggcggcggtctccagggagccaagaagcgcaagcgcgagcacgcggaagggaagacaaagcctcggaagcaagtcaagggaggcggggacggagcgaagcggaagagccactcggccgccggcggctacactgcccatggcggcgccggcgaagttgtggcgaggaagaagaccccggttacccccaaggagaagcgcctcgcggccaaggaaatgtcggaggccaggaagatgaagaggaggcagcattacagccttgagaaggaactaacgaaattgtgggaaaagatgagatgtcacgatgtgagcaaagaggagaggtccaaggcagtaagtcaggctatccataaaatggatgggaaatatttggacattgccacatcacatgttaactgcacgtgttcttncaacatgtgtaaagtggntgctcgagtcagagagggatgctatcctttgatgttctacaaccacatttnngctactctttctttgcagaaatatngccgtttttcttgggaaagaaagcttatagaactccgcctctaaaaaacagtttggcaggtttcatatcttcccnttcatgggcgtggttggccaacctccctcatcatacaattggaaactggcatcccttgatttttgcctttccgcgaggggaaccaaccgtcgaaaaagggcattgggttggttgaaaacggacccccccggatcttcagcctatttaaaggatcttgacgggggaaaaattc

SEQ ID NO: 90773 - protein, 183 aa, Zea mays
  misc_feature: Ceres CLONE 1578822
  misc_feature (138)..(138): Xaa is any aa, unknown, or other
  misc_feature (144)..(144): Xaa is any aa, unknown, or other
  misc_feature (161)..(161): Xaa is any aa, unknown, or other
  misc_feature (170)..(170): Xaa is any aa, unknown, or other
MAGGGLQGAKKRKREHAEGKTKPRKQVKGGGDGAKRKSHSAAGGYTAHGGAGEVVARKKTPVTPKEKRLAAKEMSEARKMKRRQHYSLEKELTKLWEKMRCHDVSKEERSKAVSQAIHKMDGKYLDIATSHVNCTCSXNMCKVXARVREGCYPLMFYNHIXATLSLQKYXRFSWERKLIELRL

SEQ ID NO: 90774 - DNA, 903 bp, Zea mays
  misc_feature: Ceres CLONE 1578823
  misc_feature: Encodes the peptide sequence at SEQ ID NO. 90775
ctggagctccccgcggtggcggccgctctagaactagtggatcccccgggctgcaggaattcgtctcacccctagaaaaaaattcgagttgtccgcttccagtcagtcgccgccgctgaaaccgaaacttaaaaacaagctcgccgggggtccggccgatttcccccaaattttgctgctgttgctgatagaaggccgcggcgaccaccatgggcaactgctgcgccacgccgtcgacgacggaggagagcggcaaaagccgccagaagaagccgaagcagaaggcgaacccctacaacgtggcgtacaaccgcggggcggcgccggcggcggcgcgcccgggcctggtggtgctgcgggacccgacggggcgggacctcggcgcgcagtacgagctgggccgccagctgggccgcggcgagttcggcgtcacgtacctgtgcacggagtccgccacgggggcgcgctacgcgtgcaagtccatctccaagcgcaagctgcgcacgcccgtggacgtggaggacctgcgcccggaggtggacatcttgcgccacatggctccgcaccccaacatcgtcggcctccgcgccgccttcgaggacgaggaccccgggctctccgcatggacctccgccaaggaagggagctcttcgacaggatcgccccccggggcacttcaccgagggtgcccccgccccctttagggcccacattgttgaaggctttccataattcccaaagggatggggtcctgtccccgggtattttaaacaaaaaaaactttttttttggcaacagaaaagggaagctcccccctcgaaaaaaattaaattttggggccggccaaggtttctctcaagcccttgtggagcaggatttcttaaaaatcctggggcccctccc

SEQ ID NO: 90775 - protein, 164 aa, Zea mays
  misc_feature: Ceres CLONE 1578823
  misc_feature: SWISSPROT Homolog: EC 2.7.11.1 Non-specific serine/threonine protein kinase
MGNCCATPSTTEESGKSRQKKPKQKANPYNVAYNRGAAPAAARPGLVVLRDPTGRDLGAQYELGRQLGRGEFGVTYLCTESATGARYACKSISKRKLRTPVDVEDLRPEVDILRHMAPHPNIVGLRAAFEDEDPGLSAWTSAKEGSSSTGSPPGALHRGCPRPL

SEQ ID NO: 90776 - DNA, 929 bp, Zea mays
  misc_feature: Ceres CLONE 1578824
  misc_feature: Translation starting site: 263
  misc_feature: Pfam Name: DUF544 Pfam Description: Protein of unknown function (DUF544)
  misc_feature (929)..(929): n is a, c, t, g, unknown, or other
ctccccgcggtggcggccgctctagaactagtggatcccccgggctgcaggaattcgtctcacccctagaaaaactgcctcgtattctattcccctccctcgccatctccgccgtcgttgccttctccaatccactagtcgacaacgcacgcgcgcaccttctcccgcggcggcgacccccgcggcgtcgtcctagggttaggattcaggcgacttccctcccttccgtgtcgcggcgaacgcgtgggagataatacgccctatgtcgtctgacccttcgcgccacctcccgtcgccggtggctccgccggacgcggcggaggtggatacccattccgccgagccgccagaggtgatgcaccggacgagagccgtcgacttccttggacgacgcacgcccatcgtctaccagaacgacaacgggccctgcccgctcctcgccatctgtaacgtgctgctgctgaagaatgtgatcagcatgaaccctgacgcggaggatgtgtcgcagcatatgttgctctcgctcgtggcggagcgcctcatcgatcccaacatcgctggacaggtcagggatgaggagtattgttaacaaccgggagcagaacatcgcggatgcgattgatcttctcccgtgtctcacgacaggcattgatgtgaacgtgatgttcagggagattgatgactccgagtcccccgagaacgggctatatttgaacttctggatatcccgctatgtcatggatggaatgggaaccctcgatacggaactgctactgccattgggatcgaggcccaaaatgctcctgcctcccggacttgttgaattcaagtcaggtaaccaacgaatgaaatgacccttggaagaagaaaacggtgattttgctccgccactgctgcagctataataattccctctcccatggtttttn

SEQ ID NO: 90777 - DNA, 964 bp, Zea mays
  misc_feature: Ceres CLONE 1578825
  misc_feature: Encodes the peptide sequence at SEQ ID NO. 90778
ggagctccccgcggtggcggccgctctagaactagtggatcccccgggctgcaggaattcgtctcacccctagaaaaagcgcggacgagaggcgaagagagcagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagcctcggccagtacaagtacgtgctgctggggcctctggtgtggaaggtgctgcaagaatggcgggagcatgcgggcctgccgctcggctcctggtggctgcacctgctgctgctgttcgcggcgcgcggcctcacctaccagttctgggtcagctacggcaacatgctctttctcacccgccgccgccgcgtcgtcgccgaccgcgtcgactttcgccagatcgacgccgagtgggactgggacaactttctcgtgctgcaaacgctgattggggccacggtggtcaacagccccactgcctcccgggccctgcgggcagctctgcctgtgggaccccgcccgggtggggcctcccccctggctgctgcatgtgggcctttccagacccgggcttctacctgggcccaccgggccctccaaagggccccgttttttgcccggtacccagccgggaacaattcctggggggtaaccaaccctttaaaaaccgggttcggaaaccccccggaggccccgccccaaccccgggggaaggggggcccccctggggagggccctccctggggggggccggctccaatgggcttggttattgttcacccctctccttttaaaatcgggcgcccatgggttacaaacccggaagagcggtgccc

SEQ ID NO: 90778 - protein, 231 aa, Zea mays
  misc_feature: Ceres CLONE 1578825
MAPPPLSSWPWASLGQYKYVLLGPLVWKVLQEWREHAGLPLGSWWLHLLLLFAARGLTYQFWVSYGNMLFLTRRRRVVADRVDFRQIDAEWDWDNFLVLQTLIGATVVNSPTASRALRAALPVGPRPGGASPLAAACGPFQTRASTWAHRALQRAPFFARYPAGNNSWGVTNPLKTGFGNPPEAPPQPRGKGGPPGEGPPWGGPAPMGLVIVHPSPFKIGRPWVTNPEERC

SEQ ID NO: 90779 - DNA, 891 bp, Zea mays
  misc_feature: Ceres CLONE 1578826
  misc_feature: Encodes the peptide sequence at SEQ ID NO. 90780
tggagctccccgcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcccggtctcgatgatgttgtgaagcagtgcaggggcaggaacctcttcttcagcactgatgtttgagaagcacgtcgctgaggctgacatttatcttgtcctcggggaaaaccccccaccaaagaaccccggggggcttgggaactgggcaaagggttggcccaacctccccctttattggggaaaaacccctttccccccctttgaatttgggggaagttgtctccccacaattttgaaaaaaaaaattttgtggggttggaaaaaaatataacccgtggtccccctgtgttaaaaccccccctggggggtttttgagaaaaaaattttttgccccccccaaagtgggggggggggtgttttcttccccaagtttttttttttccccaacccaaaaaatatttctcttggcgggagggggccccgcccccctttttggggaagaacactctgtttacacccgctgccaaagaagtgggtcttgttttgcggg

SEQ ID NO: 90780 - protein, 72 aa, Zea mays
  misc_feature: Ceres CLONE 1578826
  misc_feature (2)..(73): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLDDVVKQCRGRNLFFSTDV

SEQ ID NO: 90781 - DNA, 905 bp, Zea mays
  misc_feature: Ceres CLONE 1578827
  misc_feature: Encodes the peptide sequence at SEQ ID NO. 90782
ggagctccccgcggtggcggccgctctagaactagtggatcccccgggctgcaggaattcgtctcacccctagaaaaaagatcctcaatgcactgctaggtcccgtccacagccgctcactgccgccacctctaacgcgcctaggaccatcgccacctccacatctagcttctggagtcgagatccatggtcgactcccctggaggagcccggatctggcctaccgggcacggtctcgagctttaggcgtctcagcaggcagcgcggtgtactccgtcatcgcccaatggagcagccgaccaagcaagaactctatccgtgctcgtgccgaggcgctgtctctactctctactccatctgttctgttcccgcgcctgcgcgtcgtcctctacggatccgtccaccgccgcgccagcaccatgtgaactgagacacgcctccacctatgcatccaagacacacctctgcatctgcgtccgtgcactggctacactggatcgattacggagtggagggtgttctttacaaagaaaagcttgtaccttaaaacaggaggatacaagaagttggagtggttgtctgaaagcttttgaactgcttgaagcactagtgtactagatagctttggtgcttttgtgactgatcagctctggagcagctagagtgatgtagttgtgggcttttgaacaatagctggagtgatatgaaccattagtgatgtagttgtggggcttttgacctgcttccccctggaagtgatgtcgtttggggtgcttttgtgactgatcatcccctggagccttttgtgaatgatccagctagtaatcggaaaatgaatcctagtggtgaaggaaataaaaatggtgaagcgttttaggaaaataataattgtgggggcttttggg

SEQ ID NO: 90782 - protein, 47 aa, Zea mays
  misc_feature: Ceres CLONE 1578827
MEQPTKQELYPCSCRGAVSTLYSICSVPAPARRPLRIRPPPRQHHVN

SEQ ID NO: 90783 - DNA, 866 bp, Zea mays
  misc_feature: Ceres CLONE 1578828
  misc_feature: Encodes the peptide sequence at SEQ ID NO. 90784
  misc_feature (697)..(697): n is a, c, t, g, unknown, or other
ctccccgcggtggcggccgctctagaactagtggatcccccgggctgcaggaattcgtctcacccctagaaaaactcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactggctgttttgccgagacaatgctccttatatttggtttatgctctaggatctcaaagttgtgtttgtgagatttgccctcggttaccgttctgaatctgacaaatgatatttgatccaaaaaaaaaacatttcttctcatccaaccgcccggtaggatcacaaanaaagggggaatgccaaccgcggggccggtaagggaatttgggcttcccctgcggaccttgaagcggcggtgggccggggccccgggccgtggcccttcccctttttgggggtcctgggggggaggggtccaaacaaagggacgagggcttcccccacctcccccgccct

SEQ ID NO: 90784 - protein, 92 aa, Zea mays; identical to SEQ ID NO: 7812
  misc_feature: Ceres CLONE 1578828
  misc_feature (2)..(91): Pfam Name: Ribosomal_L37ae Pfam Description: Ribosomal L37ae protein family

SEQ ID NO: 90785 - DNA, 987 bp, Zea mays
  misc_feature: Ceres CLONE 1578831
  misc_feature: Encodes the peptide sequence at SEQ ID NO. 90786
tggagctccccgcggtggcggccgctctagaactagtggatcccccgggctgcaggaattcgtctcacccctagaaaaaatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgacgtggtcgaggtgtctccggcaaccgccgcggctgcagggtgggcctccggccaccacaagaggaagcggagccaggttgtaccgcaagaagtgattggaatcgatgatgatgatcctggatgaatcatacttattggtgataaagcacagccccaaaaaaataaccaaatggtgtatggcccagggattggtcaaaacatgccaaaaagggttgggtttaaggaacccccgggcccaagacacaatgggcttaaaaaataaccccgtccccgggggggaccccgaaaaagggtttccaagaagagggggggttttaaaaactttttcccagaggggcgcccccccccttttgagggggttattaaaaaaaaaaaaacctcgcccccttttaaaaaaaaaaaaaaaaatttttgtgagaggaaaagaagggggtttttattacaaccccccccctcccgtgcgaagggggggggcgcccccttgtggtgtgtccgccccccacctttggtaaaaacccctatggtgcgccccgaggggggggggggggtttcctttttcccgggagaacaaaacaagccttttggtttgttttcaaaaaaaacccccccccgggggtggggggttggtataacctcaaaaaaaccacggcccccccccactttttggggggggaaaaatgtgtgggcttttttcccccacacaaaataagggggggggtgggaaaaccacacacggggg

SEQ ID NO: 90786 - protein, 61 aa, Zea mays
  misc_feature: Ceres CLONE 1578831
MATRASKNCLCAGSSSFDDPDVVEVSPATAAAAGWASGHHKRKRSQVVPQEVIGIDDDDPG

SEQ ID NO: 90787 - DNA, 902 bp, Zea mays
  misc_feature: Ceres CLONE 1578832
  misc_feature: Encodes the peptide sequence at SEQ ID NO. 90788
  misc_feature (693)..(693): n is a, c, t, g, unknown, or other
  misc_feature (762)..(762): n is a, c, t, g, unknown, or other
  misc_feature (837)..(837): n is a, c, t, g, unknown, or other
ctccccgcggtggcggccgctctagaactagtggatcccccgggctgcaggaattcgtctcacccctagaaaaagtccggatccacctgcccacggccatctccaccggatccttcctccacacctcctcaaccgccgcctccaagaccctagtaccgaaccccaacctcgtcccgctccggctcgtccgccacttcccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatgaatgggaaacaaatccaagtgtcaagtgtattcttgtggaaagcagctcttctcgtgccttctcagcagggatggatattaagggggttgccgtggaaatacaaaaagacaaaaaaacaccacttgtgcaaaaggtattcacagtagagtactctttaatttgtaagatacatgagtatgcaaaaccttatatatgcttgatggatggagtgacaatgggatttggaattgggctatcagggcatggccgctaccgcattattacagagagaacactcctagccatgcctgaaaatggtattggcctgttcccagatgttggctttgcttacattggtgcaaaagcaccangagggggtgcagttggagtttaccttgggattactggaaaaaggatatcatcacctgctgatgctatgntcataggccctgggtactcactatgtacccttcggcaaatttggggtccactcaaggagtcccctgctgagtgcntacctccaccaatgatccctcaaagagaccgttgagttcagtctgtacaggatacaagaaaagac

SEQ ID NO: 90788 - protein, 222 aa, Zea mays
  misc_feature: Ceres CLONE 1578832
  misc_feature (20)..(196): Pfam Name: ECH Pfam Description: Enoyl-CoA hydratase/isomerase family
  misc_feature: SWISSPROT Homolog: EC 3.1.2.4 3-hydroxyisobutyryl-CoA hydrolase
  misc_feature (164)..(164): Xaa is any aa, unknown, or other
  misc_feature (187)..(187): Xaa is any aa, unknown, or other
  misc_feature (212)..(212): Xaa is any aa, unknown, or other
MAATAADEFVKGRVFPNGVAVITLDRPKALNAMNLEMDVRYKALLDEWETNPSVKCILVESSSSRAFSAGMDIKGVAVEIQKDKKTPLVQKVFTVEYSLICKIHEYAKPYICLMDGVTMGFGIGLSGHGRYRIITERTLLAMPENGIGLFPDVGFAYIGAKAPXGGAVGVYLGITGKRISSPADAMXIGPGYSLCTLRQIWGPLKESPAECXPPPMIPQRDR

SEQ ID NO: 90789 - DNA, 876 bp, Zea mays
  misc_feature: Ceres CLONE 1578834
  misc_feature (581)..(581): n is a, c, t, g, unknown, or other
ctggagctcaccgcggtggcggccgctctagaactagtggatcccccgggctgcaggaattcgtctcacccctagaaaaagccatctctgccccctccgccgtgctgtctccatgcatcgcctgcagtcgcttgcatcgctgccgtctccgtctcctaccccgccatacagacccatgccttcttcctgcctccgcgggccgtcgtcacgccatgaatgcgaaggtctcttcgccatcgagacctccgtcttcaagaaggaaaaggtctccttggctggccatgaggaggtttgatttgcaggcctagccacttcctccaccacctacctcgccatcgcccgcaaaaccctaaatcctgttccctccataggcacagccgccacctcgatccccttctcttccacgcaggctccatgccttttcttcgtctctgcgggccgctgtcgcgtcgtgtctgcgaaggtacctcgtcgtcgatcatcacgatgccaaccccttcgacgagggcagggcaaagacaaccccttctctatgagcacaaaaacccttttcacttactccagaaattttgctaccaccntaggctaaggggtttggtagatctagagattttaggcaagtatccgatcaaccgtggctgttggatggaaaatggaggaggcggaggcatcaagcagtaatacgacttctggctattgaagcccataagtttatggggccgggaaaaaaaaacaccctcgttctttttcccattcaaaaaaaggggggtaaggggcttcatttcaaacaggggccccctttttccctaaataacaattggggggccaaccccccaggggtttgggggactttaattacgggggaggggacctttt

SEQ ID NO: 90790 - DNA, 918 bp, Zea mays
  misc_feature: Ceres CLONE 1578835
  misc_feature: Encodes the peptide sequence at SEQ ID NO. 90791
ggagctccccgcggtggcggccgctctagaatagtggatcccccgggctgcaggaattcgtctcacccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgacgggctccctcaccgccgcgctcctcgccccgttggccgagctgcgggtcctcagcctcaagtccaacgccctcacaggccccatcccggaggccctcccgcgcgcgctcccaaatctcaagctgctgtacctcgccgacaaccgcctccagggccgcggtcccgcctacctcgccatgctccaccgggccaccgtcatcgtcctctccggctaccgactcacggggcagatcccggcctccctcggcgcccttgcaagcctggactcgctgctcctcgaccgcaacctgcttaccggggccgttgccccccctggcgcagcgcacgctcaagggggctaaaagtcttggccacccgccggtcgggggagatcccgcggctgcttcccgccaggttcaaacgccttggcgttccctccccatggcgggccctggcggggttcctttatacccttccctggcgtcctttgggtgcccaagacccgggccgtttaccgggggcaaggggggttttttccgcccctg

SEQ ID NO: 90791 - protein, 195 aa, Zea mays
  misc_feature: Ceres CLONE 1578835
  misc_feature: SWISSPROT Homolog: EC 2.7.11.1 Non-specific serine/threonine protein kinase
MPRRAGAAWPCFLLLHIIAHLHLAVNAADADALLTFKSSLDRSDRLPWRPDTAPAFCASWPGVRQCAPAGRVTKLVLEGLNLTGSLTAALLAPLAELRVLSLKSNALTGPIPEALPRALPNLKLLYLADNRLQGRGPAYLAMLHRATVIVLSGYRLTGQIPASLGALASLDSLLLDRNLLTGAVAPPGAAHAQGG

SEQ ID NO: 90792 - DNA, 973 bp, Zea mays
  misc_feature: Ceres CLONE 1578838
  misc_feature: Encodes the peptide sequence at SEQ ID NO. 90793
gagctccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcacccccatgaccaagtccgaccttgtcaacaacctcagtaccatcgccaggtccgggacgaaggagttcatgggaagcccttgctgccggcgctgatgtgtccatgattggccatttcggcggcggtttctactctgcctacctcgtgccccaatagagttgtcctgaccaccaagcacaacgatgaccagcagtccgtgtgggagtcccaagcggggcggggcgttcaccggttaccccggtgaaccctcagggggaccaccctggcaaggggcactaaagatcaccctgggttctttaaggacggatcgagctgggagtaccttgtaggaggggtcgccttcaagggattctggccaagaaaacactctgaaggtggataagtttccccattttccttggggaactgaaaaagacaccggaaaggggaatttcctgcccccgcaacccggggaagaaaagaaaattgccaagaaaagaaaagttgtagggtgtctgtttccagggaccaaaacacaactagaatacgctttctgggaggtttctctgaagcgggatttggcaacaagagatagccct

SEQ ID NO: 90793 - protein, 114 aa, Zea mays
  misc_feature: Ceres CLONE 1578838
MASETETFAFQAEINQLLSLIINTFYSNKEIFLRELISNSSDALDKIRFESLTDKSKLDAQPELFIHLVPDKATNTLSIIDSGTPMTKSDLVNNLSTIARSGTKEFMGSPCCRR

SEQ ID NO: 90794 - DNA, 898 bp, Zea mays
  misc_feature: Ceres CLONE 1578839
  misc_feature: Encodes the peptide sequence at SEQ ID NO. 90795
ctggagctccccgcggtggcggccgctctagaactagtggatcccccgggctgcaggaattcgtctcacccctagaaaaaccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatggtcacctttcctcttttgacaatgttgggcatcccactcaactacaggcacatgggagggctttggtggtcaatacctaccccttggttaaaaagggatgggaaaccccacccttgggaaatttccattgggaag

SEQ ID NO: 90795 - protein, 230 aa, Zea mays
  misc_feature: Ceres CLONE 1578839
  misc_feature (18)..(230): Pfam Name: Catalase Pfam Description: Catalase
  misc_feature: SWISSPROT Homolog: EC 1.11.1.6 Catalase
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTPVIVRFSTVVHERGSPETLRDPRGFAVKFYTREGNFDLVGNNMPVFFIRDGMKFPDMVHAFKPNPKTNLQENWRIVDFFSHHPESLHMVTFPLLTMLGIPLNYRHMGGLWWSIPTPWLKRDGKPHPWEISIGK

SEQ ID NO: 90796 - DNA, 960 bp, Zea mays
  misc_feature: Ceres CLONE 1578841
  misc_feature: Translation starting site: 680
tggagctccccgcggtggcggccgctctagaactagtggatcccccgggctgcaggaattcgtctcacccctagaaaaaatcttctctccttttgctcggaacgcacacacagcccggtccccgatctccgatcccctcgtcggtccaagatgcagatcttcgtcaagaccctcactggaaagactatcaccctcgaggtggagtcttctgacaccattgacaacgtctaggcctagatccaggacaaggagggcattcccccggaccagcagcggctcatcttcgctggcaagcagctcgaggacgggcgcacacttgccgactactacatccagaaggagagcaccctccaccttgttctccgcctcaggggaggcatgcagatcttcgtctagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggcgcggcatgcagatatctgtgatgactctgactggcaagactatcacccttgtagtcgagtcttctgataccatcgactatgtcaaggccaatatccaggacaaggaggtcatcccctccggaccagcagcggctcatgtttgccggcaagcagctcgaggacgggcgcacgctggccgactacataattcggaaggagagcaccctccacttggtgctgcgtctcagggatggcatgcaaacctccgtgaagacacttacgggcagacgatccccttggagtggaggcctcggacacctcgaacatgtcaagcttatacccggaaaggaatggttcacccagacagcagtcgctctctt

SEQ ID NO: 90797 - DNA, 980 bp, Zea mays
  misc_feature: Ceres CLONE 1578846
  misc_feature (671)..(671): n is a, c, t, g, unknown, or other
ctccccgcggtggcggccgctctagaactagtggatcccccgggctgcaggaattcgtctcacccctagaaaaagattccagcggctcaatccctgtcaatcatagagcagagcagcccgtgaccccgtgggcgtgtgctgcgactgcgaggagggaggagggaggaggaggacgaaaaagagtgccgccgtttcctgggggcagccagattccattccttgcgcaggagtactacggctactccttgtcctattccctactagcaggctgccgtggaaccaactgcctcctgcctatagcaatgcaagattatccacaccaagacagcccccctccctccctcggctgcctttttcccactccttcccgggatcgatattgctccttgcttcattccccccctcctcgtgaaggcgtcgagtgagtcctgcgtttcttgctctcctttgctaagcacccgccacaggaagaacccctctttattgccgggctgttgtcgttcctcccggggacttgtttttcttggcacccccaaactagcttgcccttgtctcgtgttcctggttttgtcgcctccctgatattacggttcctttctaacttcacgttttgtttttcccttttgttgttgggcccgccccccccccttgtgggccagaatttcccgcgnccctacaggccttggggtggttagagtctccttgcggcctctccgccacatagggagcaagccgtgcctcgtggatgcgctctgggggttttgtggggccccctcctctttgggccctatggacctttctttggtgggcgttcctttcttccccgtggtcggtgcttcgcccaccaggtgtttttccttcgtctgtgttcttactgtctctttgaattccactggggccctccgtgatagggcctccgagttgtttgatattatcggttgtgccccccccattaagattggggggcggggtgttttgtg

SEQ ID NO: 90798 - DNA, 962 bp, Zea mays
  misc_feature: Ceres CLONE 1578847
  misc_feature (818)..(818): n is a, c, t, g, unknown, or other
  misc_feature (833)..(833): n is a, c, t, g, unknown, or other
  misc_feature (907)..(907): n is a, c, t, g, unknown, or other
  misc_feature (913)..(913): n is a, c, t, g, unknown, or other
  misc_feature (916)..(916): n is a, c, t, g, unknown, or other
ctggagctccccgcggtggcggccgctctagaactagtggatcccccgggctgcaggaattcgtctcacccctagaaaaacagcggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaacaatgtaggcaagggaagtcggcaaaacggatccgtaacttcgggaaaaggattggctctgagggttgggctcgggggtcccggccccgaacccgtcggctgctggcggaatgctcgagctgctcgcgcggcgagagcgggccgccgcgtgccggccgggggacggaccgggaacggccccctcgggggccttccccgggcgtcgaacaaccgactcagaactggtacggacaaggggaatccgactgtttaattaaaacaaagcattgcgacggtcctcgaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgtatacacagccaagggaacgggcttggcggaatcagcggggaaaagagaccctgttgagcttgactctagtccgactttgtgaaaatgactgagaggtgtaggattagtgggagcctccgggncgcagtgaaatacanctacttttaacgttatttacttattccgtggggtcggagcggggcacgccctccctttttgcttcatggcctgnctcccnggnccatccggcggaaaatttttccaggtggggagttgtgctgggccgt

SEQ ID NO: 90799 - DNA, 955 bp, Zea mays
  misc_feature: Ceres CLONE 1578851
  misc_feature: Encodes the peptide sequence at SEQ ID NO. 90800
  misc_feature (616)..(616): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (637)..(637): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (804)..(804): n is a, c, t, g, unknown, or other
tggagctccccgcggtggcggccgctctagaactagtggatcccccgggctgcaggaattcgtctcacccctagaaaaaatagctggcgaaggcgcggcgcgcagggccagtagcaaccctcccatggcctacgctgcgcctcccatggcgtcgtccctcaccgcctcccacccccctctttccccgtcccacctcataacccatccgcatcgctgccctgcgcgccccaaccccaccaccggcctcctccgcctcaccccgtctcgccgccgcggtcgtccccccgtggccgtccgcctcgcaatatctgcctcgtccacctcagccccgcccccgtcggcggatcggtcggaggccgcgtcgtcgctggagagatacctctcggcgacggtgacgggagcggtgatgggaacgggggcggccccaccagcttcggccccgccgcgcgccccgccggcgatgaaggggggacggaagcagtatagcgcgttgggggctgtcacgctcgagaaggccaagctcgatctctcccagcgccgcaagaatatcatgcccgagctggcgacaggtggtggtggtggagatattggaaaaagatcgcatgtgggggggggntattagggggnnnnnnnnaanggggnnnnaggaggactactttgatgattttgatgagggagaaggaagaaagtggggctttttaggaaggggatttgttgtaaaaaaggtattcaatagggagtttgtagaaaatgggtttgaaagaatgggaaaagaggatgagtgattttggcaaacgggcttcnccaatcttgtgagaaggggtttggtgagttctgcaaagaagggaaccttactggcaaaatttggcaaaactacaaacgcgtggtcccttctcaagaagtcctccaggatggcatttccagaaagctgtttggaaaggaccctggcaaatcc

SEQ ID NO: 90800 - protein, 158 aa, Zea mays
  misc_feature: Ceres CLONE 1578851
MASSLTASHPPLSPSHLITHPHRCPARPNPTTGLLRLTPSRRRGRPPVAVRLAISASSTSAPPPSADRSEAASSLERYLSATVTGAVMGTGAAPPASAPPRAPPAMKGGRKQYSALGAVTLEKAKLDLSQRRKNIMPELATGGGGGDIGKRSHVGGGY

SEQ ID NO: 90801 - DNA, 1196 bp, Zea mays
  misc_feature: Ceres CLONE 1578852
  misc_feature (54)..(54): n is a, c, t, g, unknown, or other
  misc_feature (907)..(907): n is a, c, t, g, unknown, or other
atcaattagaccggggcgccccgcccttgggaggccttccccccctccctattnttttctattcccttaatagctggagctcaccgcggtggcggccgctctagaactagtggatcccccgggctgcaggaattcgtctcacccctagaaaaaaacccatccactgaccgcgaagtgcacagaggggggaaggaaggagagaccacgtaccgtctgcgaggaggacgacgaacaaggagaagaggctgattcgatcgagcagcatggcgcggcggccacggccgtgtgcccacctgacggccacgctccttctgctcgccgtcgccgcggcggtcgccatatccgccgacggcgacgagaagtgcggcagcccgtgcggggaacaacgcctcctccagtccttcttcgtaaagccttcaaaccgacgaatttgagcaactgcacccacagcgcgatccactgccggggtaagaagcaacttgttgctagcctcctctatggcgagccccctaccttggtttcccaccccgccccccaaggacggggtttgggttgttacggtctggcccgctgggggggcgccgtttgcccgaaccgcctctaacttctaactacttcccgggggggatgggaaaagcgactcccgatttctccgaggtgggaaaggcccacgcgctgcccacgttgggggggggaagtgaaactgttgccccccagggggccccttttcaaatggaccccgcctaaaacccccctggggttgggtgggccggtgtccctgcgggaactccccatataaggagtttccgcacccgggtgcgcctcttttcggcatttgtgggcataacagcgtgtgttacaaacaaaatagggacctcgggttgccaccggggggcggcagtttaanttgggcacgatgtaaacccctttcactttatccggggggcggccgaccaccgcggtttagttggcatcgcttgcctttgtgttagatccccacgaaaaggcccctcacgagcttattctagcgggtataagtctgcgcgggttttcttattattcaccccccgcggctctgctcttttggtagagcgcgtaattggatacccccctaaccatcttcgccgcgccgaatatgccgccccccacccctcggccgaaacgattggtaaggtggcgtggagccgggctactag

SEQ ID NO: 90802 - DNA, 931 bp, Zea mays
  misc_feature: Ceres CLONE 1578859
  misc_feature (340)..(340): n is a, c, t, g, unknown, or other
  misc_feature (779)..(779): n is a, c, t, g, unknown, or other
  misc_feature (852)..(852): n is a, c, t, g, unknown, or other
  misc_feature (906)..(906): n is a, c, t, g, unknown, or other
  misc_feature (907)..(907): n is a, c, t, g, unknown, or other
ctcacccgcggtggcggccgctctagaactagtggatcccccgggctgcaggaattcgtctcacccctagaaaaatccgccgcccccgaaaaaacatataaaacagaaccctcgcatcctgtaaatggcgacacgcctcgcctccatcttctctgccgtgcgcagccccacctcagccccgccccacactctccgccgcgctctcccaagcttcagctaccggcgagcacatccatctcagccccgcatgtcctcctcttcatgctgctccctcgcgccgtcgggcgtcgagaaagctacagtggcgccgttcgggtcctggaaggtcgccatcactgcngacgtcgtatctggcgcggataagccgcttcggcggtatcgctcccgcctggaaaagaaccccttcccctgggattcaaggggcccgcccccaaagaaaaaaaggggcgtagggggtttttgaaaaaggagggagggaaaacccccgggggaatggcccccccccgagagaattttggacacccccccacgggggcccaaaaaaaaagggggggggggggggattttgcccgccaaaaaaagagggtgggggggggttgccccccaattttccgggggggccccccccttctttttcccgcgaaaaaaatatttgggaaaaggggggggggcccccttggggggtctctttttatacaacaaaatttaagtgtgggggcccccaaaaaaagatgatttttttcctcggggaggggggggttttttttattaaacacccncccttcaaaaaaaaatattttttttttgtggggagaaaaaaaacccccccccaaaaaaaagatgtgttttttnttttttccccccccccccaccaaaaaggaaggggggggggggagaataaaaaannttaataaggggtgggggggggggg

SEQ ID NO: 90803 - DNA, 1040 bp, Zea mays
  misc_feature: Ceres CLONE 1578861
tggagctccccgcggtggcggccgctctagaactagtggatcccccgggctgcaggaattcgtctcacccctagaaaaaacagtatatgcaccgtcgtacacgccacagtggcacggtgccttcgtctcacacacggcgactaattaaccccactgattccgtacgaccgagctcccccacactttttcctggcagaccctgcacggcctccgcaaccgcgtcgtcggcgtgcgcaatccctagaggaccatccatcagctatcattggccgggtgtgtatgcacattcatcggccgtaacgagatcggctgatccaaggccatgtgtgaaccagacctcctcgcgacagatcccttcgcggacctccccttccccgaatttatggcgcacattgacgggcacccattctcaggctcgaggactccattctggaggatctggaccgggacgtggactttcgaacctccatccttcttacccctcggaaggggccaaccctggaaacaagaccccagtcgaagacggcttccacactcgccggggccccccgggtgggaaagtttatcctacttccgggtgcctttccggggaaagccaaaatggttaaaagaaaggaagaatccctttttggaaccctcctttcagggaaacctttggggggaacaaaatggggaaattcccaccgggaaaagggggaaagaaaagggtaaatgctaaaagcgggggggcgcctttagggccccaaactttctagaataccccaaatgtgtgggggggcaaaaataaaaagggtacacctttccggagattaaacgagaaaggggttattgggtttcaagaaaattctctctctaaaacggcagcgggtttttcagtgagtccccgcccgaaaacgccctctccaaaaataatctgttgggagctcttagaggggcgccacacccccccctctctagtttccccagatttttttctctccgtggcaagagagcactgtcttatccttatggggagagttatccccttgttttcacccccc

SEQ ID NO: 90804 - DNA, 941 bp, Zea mays
  misc_feature: Ceres CLONE 1578865
  misc_feature: Translation starting site: 275
  misc_feature (925)..(925): n is a, c, t, g, unknown, or other
ctggagctccccgcggtggcggccgctctagaactagtggatcccccgggctgcaggaattcgtctcacccctagaaaaagcctagaaacgggctcgcgcgggcgccgtgcctccgcggtttggccatctctatatacagcgagggatcaggcaataatcgcaaatcccacaccaccgcaatcatccacaaccagagccaccctgccgtcgtaggcgcacgcgccgtagataggaagcttattaagctagcgcgtgtcgctgcgccatcctgccatggaggatcaggcgctggcgccgctgctgcagccgctcccgctcggcgaaacgggggccatcaaggggcgcgcgaggcgggcggcgctggagtggtgggtggagtcgaagaagctatggcacatcgtgggcccggccatcttccaacggatcgcgctgtacggggtcaacgtcgtcacgcagtccttcatcggccacctcggcgacctcgagctcgccgccttctccattgctgccaccgtcgtcgggggcttcaacttcggtttcctgctgggaatggcgagcgcgctggagacgctgtgcgggcaggcgttcggcgccaagaagcaccacatgctgggggtgtacctgcagcgctccctggatcgtgctcctcatcttcgccgccgcgctgacgccgacgtacatcttcatggaggacctgctgctgctgatcgggcagtccccggagctgtcgcggttgggcgggcaaatgagcgtgtggctgctcccgcagcacttcgccatgtcgatgctgctcccgctcacgcggttcctgcagagcagctgaagaactgggtgacgcgatcacgcgggcgtcgccgctcgcatccacgtcgtcgcaacctacgtgctagtgcgtctcctcgaactcgggatcgtcgtggcgtncgctctgcggaaagga

SEQ ID NO: 90805 - DNA, 923 bp, Zea mays
  misc_feature: Ceres CLONE 1578866
  misc_feature: Encodes the peptide sequence at SEQ ID NO. 90806
  misc_feature (570)..(570): n is a, c, t, g, unknown, or other
  misc_feature (620)..(620): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
tggagctccccgcggtggcggccgctctagaactagtggatcccccgggctgcaggaattcgtctcacccctagaaaaagcctcccttcccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcccgcgcgccggccgcctcttctcccccgccttcgccacctccgtctctggagacttcctccgcccgcacggcgggggcgcctccggcatctccaacatcggagattcacattttgagccacgtgagcgtgttcgatacacaagagatcaacttctcgagctgcgtgagattgttgatgtgtctgaagaaattttaagaatcaagcaagagattgatgtagagcttcatgggtgagaccagagctggggtcgcaatgattcaactggntcaggacaagcacaagctcaaacacaagcacagaaatcgctatgctgagnactgattagcgttgatttggcgtgcaccggtctgcccacaagaactgacagcagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 90806 - protein, 94 aa, Zea mays
  misc_feature: Ceres CLONE 1578866
MQPDQPVISLRPGGGGGPRAGRLFSPAFATSVSGDFLRPHGGGASGISNIGDSHFEPRERVRYTRDQLLELREIVDVSEEILRIKQEIDVELHG

SEQ ID NO: 90807 - DNA, 1011 bp, Zea mays
  misc_feature: Ceres CLONE 1578867
  misc_feature: Translation starting site: 195
  misc_feature: SWISSPROT Homolog: EC 4.1.1.49 Phosphoenolpyruvate carboxykinase (ATP)
ggagctccccgcggtggcggccgctctagaactagtggatcccccgggctgcaggaattcgtctcacccctagaaaaagcctcccttcccttctcctctcttccccgcgaccgcttggggcttcatgactcttttcctttcaaaagcccgcgcacgctcgtaggtcgtcccgagcaggacctcgatcggccgagatggctacaccgaacgggcttgcgcggatcgagacgaccgggaagatgaagcaggacaacggcgtgtggtacgacgacagctcggtgccggtgcgcgcgcagaccatcgacgagctgcactcgctgcttcggaagcggccggcgcccagcacgcccaagaggactgctcccaccacgcccatcaaggggcggtgcccactcccccttcgccgtcatgatctccgaggaggagcgccccacgcagcaaatgcagtccatcagtgcgtcgttggcgtctcttacgcgtgaaaccgggccgaaagtggttcaagggcgacccggcggcaaagggagaagcccgcctcaaagggggcgcccggatcgcccagggggggacctttgagaggggaaccccggcggccccccgcaatgccggtttggcgaagcttgcccccaggttccctccatggtgggcaaaaaacctctcgcccggttgaacttttaccaaagggggcataaattttgggaaaaggggtgtgttttttaaaaacaacccgtgccccttggaaaatttttttgggggccaaaacacgagggggctcccaagggaaaaaggccctttttaggagaaaaaggccccggggggaaccctgggggggggggtggggggcccccaaccccgggggggcagaaaaaacttcctctttacaagaggaagaggggttaaaaacccaaaccccgctgggaaagagggtttgaaaaacatatccttctttgtgggcccacaaaagggagaggggcgccttcctcccgcggggggaagaccctctttttgaaa

SEQ ID NO: 90808 - DNA, 1073 bp, Zea mays
  misc_feature: Ceres CLONE 1578868
  misc_feature (470)..(470): n is a, c, t, g, unknown, or other
  misc_feature (772)..(772): n is a, c, t, g, unknown, or other
  misc_feature (773)..(773): n is a, c, t, g, unknown, or other
ctccccgcggtggcggccgctctagaactagtggatcccccgggctgcaggaattcgtctcacccctagaaaaaagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgttctaatggagtctaagggtggcaaaaagcctaccagtagtcgttccatgatgtatgaagctccccttggccccccccctcgaggacgtcctaccctgccggagggcctgaagaaaggtccccggttccgctgccttacctcgtttntggtgggtaagaagccatccctgaaatgcccgttcttgcgcttcctccatcccgagaggctttaagggagttcgtttttccgtgccccttttggattcttgaacccaaccctccttcggggtcttggcgcggtttgcctgagagtgcctgccatatcgctccccccggggtcgtggccccccttgtccgcactactcgccctccgcgtccgtttcctcccgcgtacgtggacggcgctcccggacgatctgcccgcccgcgcctcgaggggcgccggcgtttttccgtctcgtgggatcgannatacccgagctctcccgcgggctcttcccgcgtagtcctccgcgtctcggagcgggcgccccggccagacacgcgcccctcgtctatatctcccctctcgccccatgaggcgcactttgtgtcgattatgggtgaaacccacatacgggcgcaattgtgataatcttgccaccgtacaatacgagaatccacagtaatgagacaccagggtcccacataaagcccaaccgcggttcgtacaccgtgttcaatccaagctgctctactagccggtgagtcgctcctcacctccgccctccg

SEQ ID NO: 90809 - DNA, 940 bp, Zea mays
  misc_feature: Ceres CLONE 1578869
  misc_feature: Translation starting site: 182
  misc_feature: SWISSPROT Homolog: EC 4.3.1.5 Phenylalanine ammonia-lyase
  misc_feature: SWISSPROT Homolog: EC 4.3.1.3 Histidine ammonia-lyase
ctggagctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccggcttcggcggcacctcccaccgccgcaccaaggacgggcccgcgctccaggtcgagctgctcaagcatctcaacgccggaatcttcggcaccggcagcgacgggcacacgctgtccgtcggaggtcacccgcgcgccgatgctggtgcgcatcaacaccctccctcaaggctactccggcatccgcttcgagatcctcgaagccatcacgaaagctgctcacaccggtgtcagcccctgcctgcccgctcggggcaccatcaccgcgtcgggcgacctgttcccgctcttctacatcggcgggctcataacaggccgccccacgcgcaaggcgtcacccgtcaacgaaagaaagtggaccccgcccaggcgttcagattcgccgcttcgaaggcgcttcttcagctcaccccaggagggctcgcatcttcaacgaacgttgtggctccccgccgccgt

SEQ ID NO: 90810 - DNA, 1040 bp, Zea mays
  misc_feature: Ceres CLONE 1578870
  misc_feature: Encodes the peptide sequence at SEQ ID NO. 90811
aagctggagctccccgcggtggcggccgctctagaactagtggatcccccgggctgcaggaattcgtctcacccctagaaaaaaacctcctctgcctgccgcttctcctgctgcgggcgggcactgctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaacctttgttgattccggatcccggcatgaccttcccaatttcgggaccctccgtccagggggaaggggatttgctcctggtggcctaagcgggacccctaaagaacattaaaccccgggaattaccttgcgggctccgcaaggatttttttattaaaaggggccctgggcccccaaaaaatgatgggcccaaatgggaaggtgcccgttttaccacccccgggggggttttggctccattttttttgccggtgaaactccactttggtttccgcttttgtgtctcctcttgagaaacccgggggcaacacggggggacgcccctctttgttttcctccacccccaccatggggaaattcccaccggggggggcacccttctttaatgcctttaaagtgggggggggtgggccgtcatatttaacccatggggttctttttggcccgcttgtgttgccaccccctcgatacagactcttggggtggattcatgtggtgtttgggtggggatacatagagaaattccctccttcttttattgccatacaacccccccctttgtggggagaacacccctcccca

SEQ ID NO: 90811 - protein, 78 aa, Zea mays
  misc_feature: Ceres CLONE 1578870
  misc_feature: SWISSPROT Homolog: EC 1.2.1.3 Aldehyde dehydrogenase (NAD(+))
MARRAASSLVSRCLLARAPAGAPPAAPSAPRRTVPADGMHRLLPGVLQRFSTAAAVEEPITPSVHVNYTKLLINGNLC

SEQ ID NO: 90812 - DNA, 945 bp, Zea mays
  misc_feature: Ceres CLONE 1578871
  misc_feature: Encodes the peptide sequence at SEQ ID NO. 90813
ctccccgcggtggcggccgctctagaactagtggatcccccgggctgcaggaattcgtctcacccctagaaaaaaccttgccatcacctcctcgcctagcctgccactgccagcaggtgccaccgccatctctgctctgctctcgcaacgcaagcacacgcccggccgcctgccacagttgccatggcgaccatagccacgatggcgctgctgaagcccgccgccaaggccgcggcgcggtcggcgccgtccaccagcagcggcagcgtctcgctgcgcgtccggacggggcaggccgccaagaaggctgcgctgtccgtgtccgcgtcgtccacgctggcgggcgccttcctcgcggcgctggcgtcgtcgcccgacgctgcgctggcgcacccggcggcggcggacgccggcggcgacagccgcggccagctgctgctcgtcgtggtggcgcccgccatcgggtgggtgctgtacaacatcctgcagccggcgctgaaccagctgaaccgcatgcgcagcagccaggccgtggccgccggcctgggcctcggcgcctccgccgcccccggggaggcggccccgcccgaagcctccgccgccgtggtgcaagacctcgagtgaatcgccgccgccgcgcccggcgacgaaagccgcggcctcctcctgctcattctcgtcgcgcccgccatcggtggggggctccttaaaattcctccagccggggcccaaccaagtcaaccgcatggcggtccgactgaaacctagctagctagcgtccgtttcccaaacccccggggtgcttgttaaacgttaatcaaccggggtggttgaaaaaacgtacgtggaaccggtctcgcctttccacctttaattcgtagacgaattgtgctcccccgggggtgggtttacacttaaaggtgtaaactctcttctcctccccct

SEQ ID NO: 90813 - protein, 146 aa, Zea mays
  misc_feature: Ceres CLONE 1578871
  misc_feature (79)..(113): Pfam Name: PsbY Pfam Description: Photosystem II protein Y (PsbY)
MATIATMALLKPAAKAAARSAPSTSSGSVSLRVRTGQAAKKAALSVSASSTLAGAFLAALASSPDAALAHPAAADAGGDSRGQLLLVVVAPAIGWVLYNILQPALNQLNRMRSSQAVAAGLGLGASAAPGEAAPPEASAAVVQDLE

SEQ ID NO: 90814 - DNA, 950 bp, Zea mays
  misc_feature: Ceres CLONE 1578873
  misc_feature: Translation starting site: 169
  misc_feature: SWISSPROT Homolog: EC 5.3.1.9 Glucose-6-phosphate isomerase
  misc_feature (525)..(525): n is a, c, t, g, unknown, or other
tggagctccccgcggtggcggccgctctagaactagtggatcccccgggctgcaggaattcgtctcacccctagaaaaaaaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatggagaagctccttaaattggctgacgctgcgaagctcaaggagaagattgagaagatgtttaaaggtgaaaagataaatagcacagagaacaggtcagtgcttcatgtagctctgagggctccaagagatgcagtcataaacagtgatgcgggtgaatgtggtccctgaggnttggagtgttaaagataaaatcaagcagttttcagagacttttagaagtggatcatgggttggagcaactggaaaaccgttgacaaatgttgtgtcggttggaataggtgggtagcttcctgggccctctatttgtgcatactgcactccagaccgatccagaagcagcagaatgtgcaaaaaggcgggcaactgagatcccttgcaaatggtgattccagttgacgttgcccaaagctttaaagattgggtccgaaaccccccggggggggggtggatcaaagacttcccaacccggaaacaatgtaaatgctcgaactcttaagaagggatcgttcttccttggggccaaggcgtgcccaactttgatgcgggccacctaacttaacttgggaagggattgaaagacccaaaatgctttgcct

SEQ ID NO: 90815 - DNA, 1035 bp, Zea mays
  misc_feature: Ceres CLONE 1578874
  misc_feature: Encodes the peptide sequence at SEQ ID NO. 90816
ctccccgcggtggcggccgctctagaactagtggatcccccgggctgcaggaattcgtctcacccctagaaaaaatacctggcgaatgcccggcgcgcgaggccaacagcaacccacccatggcctacgctgcgcctcccatggtgtcttcgctcaccggctcccacccccctctttccccgtacatcctcataatccattcgcatcgctaccctgcgcgccccaaccccaacatcggcctcctccgcctcaccccgtatcgccgccgcggtcgtacgcccgtggtcctccggctcgcaagatctggctcgacaacctcaggcgcatccccgtcaggcgatcggtcagaagccgcgtcttcactggatagatactgctagcgactgtgacaccccccgtgatgggaatctggggccggaccaccaacttttgacccgctgcgcgccccggcaggaatgaaaggaggacagtaagcgtcttacccagtccggagctgtcacccctcgaaaaggggaaaattagatcctctccgcacacccccaagaatatccttggaccgagcctgggagaccaggtaagggcgggggggatataattgccataaacgaatccggtacggctggggactattaaaaacagggcccactgcctaaaaattcacccctttaccgggatggggagacaaaagatttctttccccgcaaaggtgttatagacaaacctcggtgttcccaatacagaaaacacacatattgtgcctttctttacctgaaacggccgacccccgtagaaaagtcatagcagaggccgtttctaattatttcccccccttttgcattcccttaaagagactccccttttctccccccccgtaaaattccctccccgtggaggcctctaaaaaccgaaaactaaaggggcttgctgttacgctcccaggggtgtgtatctagtggcgattggaacctgtctactatattgtaaaaacaaatatcctttgcgccattacatggaaagactcgggggaccccccta

SEQ ID NO: 90816 - protein, 86 aa, Zea mays
  misc_feature: Ceres CLONE 1578874
MAYAAPPMVSSLTGSHPPLSPYILIIHSHRYPARPNPNIGLLRLTPYRRRGRTPVVLRLARSGSTTSGASPSGDRSEAASSLDRYC

SEQ ID NO: 90817 - DNA, 948 bp, Zea mays
  misc_feature: Ceres CLONE 1578875
  misc_feature: Encodes the peptide sequence at SEQ ID NO. 90818
  misc_feature (693)..(693): n is a, c, t, g, unknown, or other
  misc_feature (694)..(694): n is a, c, t, g, unknown, or other
  misc_feature (781)..(781): n is a, c, t, g, unknown, or other
  misc_feature (826)..(826): n is a, c, t, g, unknown, or other
  misc_feature (907)..(907): n is a, c, t, g, unknown, or other
  misc_feature (916)..(916): n is a, c, t, g, unknown, or other
ggagctccccgcggtggcggccgctctagaactagtggatcccccgggctgcaggaattcgtctcacccctagaaaaagatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaacatattgaaagagctgctgnntctagtacctgtaatagaatgggaaattatgtggtggcgctatcatggaaccgtggtatcagagaagtagtggactggatgtcgaangaaaagtgtattcccgctccgagcttagggagcacctggtcatcntgcgaagcagtgatgccacacgcccatctgttgaggtgtcagctggccttgactctttgggtctcggtggaggacaatccntgctcaggntaaacaagttgtgagagtggacagaacaggga

SEQ ID NO: 90818 - protein, 199 aa, Zea mays
  misc_feature: Ceres CLONE 1578875
  misc_feature (85)..(188): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
  misc_feature (125)..(125): Xaa is any aa, unknown, or other
  misc_feature (154)..(154): Xaa is any aa, unknown, or other
MATTTSATTAAAAAATTAKPRGSSSALCQRVAGGGRRRSGVVRCDAAGVEAQAQAVAKAASVAALEQFKISADRYMKERSTIAVIGLSVHTAPVEMREKLAVAEELWPRAIQELTSLKHIERAAXSSTCNRMGNYVVALSWNRGIREVVDWMSXEKCIPAPSLGSTWSSCEAVMPHAHLLRCQLALTLWVSVEDNPCSG

SEQ ID NO: 90819 - DNA, 972 bp, Zea mays
  misc_feature: Ceres CLONE 1578877
  misc_feature: Translation starting site: 132
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaaacgcaaagcggttgattggtaggaggttctcggacccttccgttcagagtgatatgaagctatggccattcaaggtcgtggcgggccctggcgacaagccgatgatcgtggttagctacaagggtgaggataagcagttctctgccgaggagatctcctctatggtgctgaccaagatgaaggagatcgctgaggcctacctcggctccaccatcaagaatgccgtggtcaccgtgcctgcctatttcaacgactcgcagaggcaggccaccaaggatgccggcgtcatctccgggctcaacgtgatgcgtatcttcccccaccccaccgccgcggccattgcctacgggctcgacaaaaaggccaccagcagcggcgagaagaacgtgctcatcttcgacctcggtggtggcaccttcgatgtgtcgctcttgaccatcgaggagggcatcttctaggtgaatgccacccgccggtgatacccatctgggtggggaggacttcgacaaccgcatggtcaaacccttcgttcaggagttcaagcgcaagcacaagaaaggacatcagccggcaaccccgcgcgcgctgcggcgtcttgcggactgcctgcgagcgggccaagcgcacgctgtcgtcaaccgggcataccaacatcgaaaaccaaccccctgtacgagggcatctactttttaaaccaccatcacccccgccccggttccaggagctaaacctggaccccttcccccaattgcattgaaccccggggaaaaaatgcctccgcgatgcccaagatggaaaagaaccccgtggcccaaacttgggtgcccgttgggggggtcccacccgcattccccaagggggcaacaacctgtgtcccagaaattcttcaaaggg

SEQ ID NO: 90820 - DNA, 974 bp, Zea mays
  misc_feature: Ceres CLONE 1578878
  misc_feature (64)..(64): n is a, c, t, g, unknown, or other
  misc_feature (385)..(385): n is a, c, t, g, unknown, or other
tggagctccccgcggtggcggccgctctagaactagtggatcccccgtggctgcaggaattcgntctctacccctagaaaaagttcacatcgccctacccgccgtaccacatgccagacgctggccaccggcttcgccgccgcagcgactacatcgggggtgtgcagcctcccatcagactcccgccagcgccaaacccttcgactcggcgatggccacaccggataagaagtcatacccacctgccatggtcgcggaggaggtgagggcgtgaggctgactggcgattggacccgtccccccattccacccgtcgtcgccgacgtgtctgtccaaggtgagtccgcaaacgagtacatataaaagtcatcagggaaagttgttncgcccaaaagcttaccaaacctcttgactatgcaccaaaagaattattttttatataaaccggaatttgggggtgggaatttgggaccttggggggtaatggccgaagggaaaaccaattcctgggatttagagaacccctaagccctactaaacgggatccttataaaaaacccggcccggggaaaactttgggcccccaatgggggggcagaaaattttggccttaaacccttgggccccccgggaaaaacctgggtgtccccccccccctcctttttttttgaagggcccgcccttttttttttcaaaccccacacctcctaaaaaggaagcctcccccaagggggcgggggaaccaagggggccaaaaatctctgtggccccaaaattttgggagagtagaccccgtttttttttattaaaaaaaaaataaatttttttcccccttgtgtgggaaaaacacccccccgggggtaaacccccgtttgaatatatttttcccccggggaaaaacaattttttgtttttttttcccccgggcggggatatattttgggttcaaaaaattttattttccccccccggcg

SEQ ID NO: 90821 - DNA, 1016 bp, Zea mays
  misc_feature: Ceres CLONE 1578879
  misc_feature (328)..(328): n is a, c, t, g, unknown, or other
  misc_feature (329)..(329): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (753)..(753): n is a, c, t, g, unknown, or other
  misc_feature (818)..(818): n is a, c, t, g, unknown, or other
  misc_feature (819)..(819): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (870)..(870): n is a, c, t, g, unknown, or other
  misc_feature (871)..(871): n is a, c, t, g, unknown, or other
  misc_feature (873)..(873): n is a, c, t, g, unknown, or other
  misc_feature (933)..(933): n is a, c, t, g, unknown, or other
  misc_feature (943)..(943): n is a, c, t, g, unknown, or other
ggagctccccgcggtggcggccgctctagaactagtggatcccccgggctgcaggaattcgtctcacccctagaaaaatttataactacaatacaaggggcgccgggggttgggaaagaatagcctcatgagtcatgtccgtccattcatccatccatccatccatcacacggttcacagtcagtcacagtggactattgattcgttagtccacccattcttttctttccttggtgattgttgtgtgtgtcgcagaagtgataatttaaaaaaccatcgtacaagaagagggatgagctctgagctcacacctttactgcatcccggnnaaatgaaggaactcttcttgggttcccccccccccctttaaccaaaaaaaaatttaaggttacccatgttgggttttttcccccaaaaaattgcccccacacaatagtactttccggtttttttccccttttccccccctgttcccttgtaaaaaaattcccccacttcccctccttttatttccaacccaaaatttgaaaaaggtgtttttataaaaaaaaagcgcgcccggcggaaaaaaaatttccttttttttgtggggggccccttcaaataattagggggccccctccacaaaaaaaaaagggtgggcccattttgtttaaaaaccccccaaaaaaagagaaccccctccccttatattcgccccgggggggnnnnnnaacaaaaccagcggcccccgcggtttcccccggaaaaatntataaaaaataaaggggggcgccccacaccaccacgagtgtcaccaccccccccacggacacggnntccccgtaaaannnnnttttttaaccccacaccaaaaccnnnnnnnnnaanntnttttttatattctcttttctccaaaaaaaaaatattttttaaaaaaaaacacaccccccnccgaagcctntttttttttttggggaataattattgtgtaaaggagggagctcctaaaacaccggggggcgcgcgccacaaaa

SEQ ID NO: 90822 - DNA, 1045 bp, Zea mays
  misc_feature: Ceres CLONE 1578883
  misc_feature: Encodes the peptide sequence at SEQ ID NO. 90823
gagctcaccgcggtggcggccgctctagaactagtggatcccccgggctgcaggaattcgtctcacccctagaaaaagtctctctagtactggatcagtccctcttccttttccctctcctcagtccctgtctgctgctgctagacagcacaaactgcggtccggtgcgctctcctcggcggtggagttggagctgcagtgcaggggaagaaccgaagaagcgagctagagccgcaagaatgataggcgccaaggccaacgccgccggcccgtgcccggagtatgcggaggtcgaccccaccggccggtacggacggttcagcgacgttcttggcaagggcgcgtccaagattgtgtaccgggcgttcgactagtaccaggggatggaggtgtcccccccaacccagtcgaagctgcacgactttcctgcagagccccgaggacctggagcggctctactgcgagatccacctttctcaagacgcttcaagcaccgcaacatcattgaagttcctacacctcctggggtcgatggtccccgcccgcaacattcaacttcatcaaccgaatatgttcaccctccgggcacccctccccccaattaccgggcaatagggccacccggagggtgaaacaatttgggggccggtgaaaacacacttggggccaaggcaaaaatccctccagccgggcccggccggttaccctggccatttaggccccaaattcccgccccattcattcccccccgggtgaacctccaaggtgtgaaaaaccatccttccgttgtaacgcgcaaccccgggaagaaggtccaagaatttgggggaaaccctcgtgttttccccgccctctcctccgccaatgccccacatgccgttccatttgtgtatagaacccccgaaattcacgggcgcccgaaggtgttccaaggagggaatacaaccggccggggggaatctcctctctttggaaacgcccgcccccaaattgtaacctttgtgtcaccctccgctgaggcccacccctgtgatactacaaataa

SEQ ID NO: 90823 - protein, 44 aa, Zea mays
  misc_feature: Ceres CLONE 1578883
MIGAKANAAGPCPEYAEVDPTGRYGRFSDVLGKGASKIVYRAFD

SEQ ID NO: 90824 - DNA, 905 bp, Zea mays
  misc_feature: Ceres CLONE 1578884
  misc_feature: Encodes the peptide sequence at SEQ ID NO. 90825
ggagctccccgcggtggcggccgctctagaactagtggatcccccgggctgcaggaattcgtctcacccctagaaaaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgcccacgtcagcaactgctcgtactacctgcaagacaggtccctgtcggcgcggggaccgcctggccatcaacgactgcctggagctgctgtcccccaacgatggacgagctccgcgccagcaccggcgaacttggcgtccccccccggaaggggggccgcttcggcgggcctgtcccagggcgccagggccgccaaatattggaccacttgaagaaaggggctttcggggggcctcaacaaccaagtaaccctggccccaaaggggttcgcggtaccaaaaacagggggggcccctgtggggcccttaaattgaagccgaacctttcacaccacttgttcccccgttgggggaaaaaacccctctggggccttggcgccaaaaaaatttgcccggggggcgggggcctccataagggccccccccccccccccgggggaacccctttttccgggggtaacggggaatattgggaaaagggg

SEQ ID NO: 90825 - protein, 154 aa, Zea mays
  misc_feature: Ceres CLONE 1578884
MPPIPKRGEHLLVLLIVACAATAATAAGTVPFYPSAESAAAAHCDGTLYPELCLSTLADIPDLHKKPLPDVICAAVNRTEDVVVAHVSNCSYYLQDRSLSARGPPGHQRLPGAAVPQRWTSSAPAPANLASPPGRGAASAGLSQGARAAKYWTT

SEQ ID NO: 90826 - DNA, 1040 bp, Zea mays
  misc_feature: Ceres CLONE 1578885
  misc_feature: Encodes the peptide sequence at SEQ ID NO. 90827
  misc_feature (370)..(370): n is a, c, t, g, unknown, or other
ctggagctccccgcggtggcggccgctctagaactagtggatcccccgggctgcaggaattcgtctcacccctagaaaaagataaccaagaacaaaccattgttggacgcgttcccctcctgcacgcaacctcatctcgtcctccagatccaggatggccgtcctccttgagaccttgcctccccgagtgctctcggtgagctactttgtttcgatttatcaggaaatccgtttgcttcatgttgtgcaggctcatatctgattgctggattcggcaaacccgcgttggatcctgtatcggttagtccttgcctgcaagggtacttgtgttttgttttggtggtcgagcatcgcatgttctgcttctggnatcagatctggagaaatcgcgaagtcctccttctgtccgtccgaagcggatctgaggcgacgatagatggagggcggcgggatctctcgggcctgcatcctggctccacctcaatgaaagaggtccctggccccgaaatttattggaccctttccaaaattttttggtaaatcctttaaaaattcccccccgggaaaaagggcaaggtaaccctccccccttgtaaaaaaagaaaaaaaaagggggcccccctcagaggggggaggcccttcccccatttggggtggcgccccccctgggggggcccggtaaaaaaaaaaaaaatattttttttgggcccgcggggggaggaaaacccccggggggggtttttttttttttggcccccgggtttccccccccccccttttttgcccgggttctctaaggtggtgtccccccccccggtggggggcccccacccccccctttttttttctccccccgggggttatttaaaaaaaaaatggtggcccccccccctccccggagaaaaaatttttttcaaacaatattttgtggcgccccgccccctttaaaaaaaaaattttattttccgctggagaaaaaaaaaaaaccccccccaatagaaaagaagacgctttttgttccccccccccccccttttttt

SEQ ID NO: 90827 - protein, 35 aa, Zea mays; identical to SEQ ID NO: 7877
  misc_feature: Ceres CLONE 1578885

SEQ ID NO: 90828 - DNA, 959 bp, Zea mays
  misc_feature: Ceres CLONE 1578888
  misc_feature: Translation starting site: 265
  misc_feature: SWISSPROT Homolog: EC 1.14.99.7 Squalene monooxygenase
caaaagctggagctccccgcggtggcggccgcttcagaactagtggatcccccgggctgctgcaattcgtctcacccctagaaaaactcgtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccaggcgcctccgggtggaagggaaacccgcgccggatgcaggctgcgcggtcggtgacggcgcgggtcccgacggcgggacggacgtcatcatcgtcggcgccggagtggctggatctgcgctggcgtacacgctcggaaaggatggccgccgggtgcatgtcatcgagagggatctgacagaacctgacagaattgtggggcgagctgttgccacctggaggttacttggaaataattgaattaggcctccaagattgtgggggaaaaaattgaggccaaccgggggcgtgggttacgccatattccaaagatggagaaaacccaaagcttggcttatcccttaaaaaaattcccattcccgaaggtgcctggggaagagcccttcacaaaggggagggttttttcccaaggatggcggccataaaacgggggccttttgcccctgtggcatattggaacagggggacggtttcccccactcctctggaaaaaaaggggtactgttaaaagagggggcaataaaaaaaacacaggccgggggagaaaaactaaaaagcttattggcgccccttg

SEQ ID NO: 90829 - DNA, 989 bp, Zea mays
  misc_feature: Ceres CLONE 1578889
  misc_feature: Encodes the peptide sequence at SEQ ID NO. 90830
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (64)..(64): n is a, c, t, g, unknown, or other
tcctcccctcggtgctcttatcccataatctccccaaaactttcccctnnnnnnnnnntgggtnttgttcaaaactggagctccccgcggtggcggccgctctagaactagtggatcccccgggctgcaggaattcgtctcacccctagaaaaattattgtgaactgtgccgactgaaacgggcagacccgttttgggtgactaccggaaatccattactacctgtgaaatttatgtcatctggtgttggaaatgatggagcaagtgtacctcaaattgtggagaagactttccaactttcccgagcagatagagaaacagttcagagacaagaatatgatctccaggtttggtgcatccttataaatgacaaagtccagttcaggatgcaatggcctcaatatgcagaattgcaagtgaacggtattcctgtacgagtaatgaccaggcctggttctcagttactagggataaatgggcgggatgatgggccactggtaaccacatgcagtagagaagggatcaacaaaattagcttatctagagtggatgctcgaaccttttgctttggagttcgaattgttaggaggaggactgttcctcaggtattaaatttgatcccaaaggaaggtgaaggggagtcttttgaggatgctcttgctcgtgttcgtcgctgtcttggaggtggaggtgctacggacaatgctgatagtgatagcgacctggaagtggttactgaatctgttacagtcaaccttcgttgccctaatagcggatccagattgaggattgctgggaagttcaagccttgtgttcacatggggctgttttgatccttgaaacttttggggaattgaataaccgctcacgctaggtggcaatgccccaatatgttttaaagaattactcttctcgaagaaccttgatgatcgatcccttatttcaacccgggattacatcctcgggttgcaccaattgccaatgaaagc

SEQ ID NO: 90830 - protein, 199 aa, Zea mays
  misc_feature: Ceres CLONE 1578889
MSSGVGNDGASVPQIVEKTFQLSRADRETVQRQEYDLQVWCILINDKVQFRMQWPQYAELQVNGIPVRVMTRPGSQLLGINGRDDGPLVTTCSREGINKISLSRVDARTFCFGVRIVRRRTVPQVLNLIPKEGEGESFEDALARVRRCLGGGGATDNADSDSDLEVVTESVTVNLRCPNSGSRLRIAGKFKPCVHMGLF

SEQ ID NO: 90831 - DNA, 977 bp, Zea mays
  misc_feature: Ceres CLONE 1578891
  misc_feature: Encodes the peptide sequence at SEQ ID NO. 90832
  misc_feature (642)..(642): n is a, c, t, g, unknown, or other
ggagctccccgcggtggcggccgctctagaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgttcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgacatcgagaggcggtgcacgtcgcctccatccgtcattgtcatcggccgttgcatctcgggcgttgcagctgcccgtgccctctccaattcttcatttaaggtgactgttttggaacnaaaaatcctatgggcgggcgcttcatacgggatacccgttgggatgcccattgaaatgggagcctcctgcttaccgggcgtgggcatggaaatcccctggccccctgaaaaacttccttgggggtggggttacccgccaagcggaggaaaccccgttccggttgaacctggtttaaaacgctgtcccccttgataaaggggggaaacgggccccaaggaaccccgcaaaaatgtggaaaactcccgaagaatttttaaaaaccgggaaattgccctaataagaaaaacaaaacgccccccacggagatttttttttgtggaaagacccccccctt

SEQ ID NO: 90832 - protein, 49 aa, Zea mays
  misc_feature: Ceres CLONE 1578891
MPIEMGASCLPGVGMEIPWPPEKLPWGWGYPPSGGNPVPVEPGLKRCPP

SEQ ID NO: 90833 - DNA, 944 bp, Zea mays
  misc_feature: Ceres CLONE 1578893
  misc_feature: Encodes the peptide sequence at SEQ ID NO. 90834
ggagctccccgcggtggcggccgctctagaactagtggatcccccgggctgcaggaattcgtctcacccctagaaaaaagttgtaccttgcgactaggtgagccgccgacgcctgggctccacgccgcatccacgtgaccgcgcctccgagctccatagccccgggccgccggcgccgggccttggtgatctcgtccgcctcccagcatcgaccggacctgcccgcagcccgcgcccaggccatcgcgccgccgacccgagcttcgccaggcgcctaggccgctcgccccgtctcccgcccgcccggtcggcaggacgactgggcggagctcctccccgcggaggcggggacggcggacccgcccccaggccgagtcgccgagctccgccccgcgcgggcgcccccctgcccagtcccagccgccccgctcctgtcccgggcaggctcagctccgccctgttccggcctctgtacagcatccaggaacgacgactctagaccagatggcaggcctcgaacggcctcgccgccgccctccgccagacaccgtcggcttgctccgcggacacagcgccgcagtctactacgcctgcttccacccctccctccctctcctcttatccggcgcggccgacagggagctcaagtcctgcgacacagcaagccagcgttacgcttccgctgtgtgggctcatgctgggtcggcgggagtgtattctgacactgctggtgcgagacttggccatagagtatcagccaggggaggcatggcactgcaaatgctcggtgattgcagaagctggcctttcaaggagcactactacagtcgaacaaatacgttccttgcagcaaatgtcactagtgagtgctcttttaccttgccactgaatctgctatgcagctcgcttttgacgtggaccacaatgggccaccgaaacgcaaa

SEQ ID NO: 90834 - protein, 146 aa, Zea mays
  misc_feature: Ceres CLONE 1578893
MAGLERPRRRPPPDTVGLLRGHSAAVYYACFHPSLPLLLSGAADRELKSCDTASQRYASAVWAHAGSAGVYSDTAGARLGHRVSARGGMALQMLGDCRSWPFKEHYYSRTNTFLAANVTSECSFTLPLNLLCSSLLTWTTMGHRNA

SEQ ID NO: 90835 - DNA, 960 bp, Zea mays
  misc_feature: Ceres CLONE 1578897
  misc_feature: Encodes the peptide sequence at SEQ ID NO. 90836
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (19)..(19): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (42)..(42): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (67)..(67): n is a, c, t, g, unknown, or other
  misc_feature (73)..(73): n is a, c, t, g, unknown, or other
  misc_feature (444)..(444): n is a, c, t, g, unknown, or other
  misc_feature (720)..(720): n is a, c, t, g, unknown, or other
  misc_feature (820)..(820): n is a, c, t, g, unknown, or other
  misc_feature (842)..(842): n is a, c, t, g, unknown, or other
  misc_feature (843)..(843): n is a, c, t, g, unknown, or other
  misc_feature (850)..(850): n is a, c, t, g, unknown, or other
  misc_feature (851)..(851): n is a, c, t, g, unknown, or other
  misc_feature (853)..(853): n is a, c, t, g, unknown, or other
  misc_feature (887)..(887): n is a, c, t, g, unknown, or other
  misc_feature (889)..(889): n is a, c, t, g, unknown, or other
  misc_feature (890)..(890): n is a, c, t, g, unknown, or other
  misc_feature (892)..(892): n is a, c, t, g, unknown, or other
  misc_feature (914)..(914): n is a, c, t, g, unknown, or other
nnttgcgttngaagagggncnngcnttnacgccanncnccancaaatataagngnnnnnnnnnattntttttncattgctggagctccccgcggtggcggccgctctagaactagtggatcccccgggctgcaggaattcgtctcacccctagaaaaaacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaaggtgccgattgcgggccgtcgcgggagaaacccgcccaaggaangaagccggctgggggaaaaaatttcgaattaccagggccgggagggggagcccccccttaaatggaactttgaatccccccacataggtccgtgtaccgggccccttaaagggggaggggtttttttttccccccccccgggaaaacccttcttttttttttaccaaaaatattgccccccaaaaaatgtaattaacccccccccctcgtgtgaaaaataaaaaaacgcccctagaaggggggtttttcccccccccccgggggggcggagaccancttagggcgagagaaaaaaaagacccccctcccctcgctccctcatatttacccccccctcccttctctgtttaaaataaaggaggagggggggggggcnccccccccccccccccccaccnnccaaaanncnaaaataaaagaaataaataaaatttttatttttncnncntaccccccgcccccccaccccncccatatcattatttggttgcgggggggggaggagaagaaaaatag

SEQ ID NO: 90836 - protein, 148 aa, Zea mays
  misc_feature: Ceres CLONE 1578897
  misc_feature (76)..(76): Xaa is any aa, unknown, or other
MAPALSGTLGASSVAALRPCAGRRAPSAASSVAPRGSGVVRCSRGLRWDAHRSRGRLLRVKVPIAGRRGRNPPKEXSRLGEKISNYQGREGEPPLKWNFESPHIGPCTGPLKGGGVFFSPPPGKPFFFFYQKYCPPKNVINPPPSCEK

SEQ ID NO: 90837 - DNA, 937 bp, Zea mays
  misc_feature: Ceres CLONE 1578898
  misc_feature: Encodes the peptide sequence at SEQ ID NO. 90838
  misc_feature (666)..(666): n is a, c, t, g, unknown, or other
ctccccgcggtggcggccgctctagaactagtggatcccccgggctgcaggaattcgtctcacccctagaaaaaaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaaggacaacctcatcaacaagctggtgtccgacgccgacatcccggagccgccgctgttcacggcatcgcacagctgggaagacaccccggagcagagcgtgcggctgaccaagcccgacctgtcggcggcggatcgggtccaggatgccgtgggctgcctcccgggcgcgctggatgccgcgctggccgccgacgcgcgcggcatcaggcgctggaccgtccgcgacttctccgacgcgtacaggtccggcgaggtgacgcctgtccagtgggcggcaaggtcctcccggcngtgagggaaactcgggccttggcgtgagcaatttggcctcttattaaggtggaaccccaacaacattttggggaagcccgaggaatcccccctcagttccaaaaagggggccccctttcccccctgaacagggttttgggggccttaaagcaaaaataaatgcctgccctaccttaccaggggggaaaccggtggtttggcccccccccccctcttaaaccaacccggggtggtccgcaaattcccccccgggggggccccccccggagag

SEQ ID NO: 90838 - protein, 160 aa, Zea mays
  misc_feature: Ceres CLONE 1578898
MGLFSSPAKVYKPAADVDLGPGSDELYISPNVKAPRVAGLLVKIFVWILEMPIVGQIVLYILKKDNLINKLVSDADIPEPPLFTASHSWEDTPEQSVRLTKPDLSAADRVQDAVGCLPGALDAALAADARGIRRWTVRDFSDAYRSGEVTPVQWAARSSR

SEQ ID NO: 90839 - DNA, 980 bp, Zea mays
  misc_feature: Ceres CLONE 1578902
  misc_feature: Encodes the peptide sequence at SEQ ID NO. 90840
ctccccgcggtggcggccgctctagaactagtggatcccccgggctgcaggaattcgtctcacccctagaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgcctggctgtccgcggacccggaggcgttcgcgcggaacagggcgctggaggtgatccaccggcggtgggcgatgctgggggcgctgggctgcatcacccccggagtgctggaaaaaggggtgcccgtggacttcaaggagcccgtgtgggtcaaagcccgcgcccatatcttctccgagggcggggctggactacctggggcaacccccaaccgggggcacgcgcagagcattcctggccgtggctcggcttccaatgtcattcctcatggggccttcgtctagggggctccggcataaacggccctcgaagggcgtcggcgaagggcaaaaacctctaccccgggcgggcagtaatttcgacccccgggtctttccccgaagaccccgtctactttccccaagctcaagggccaggtaaatcaaaaacggccgcctccccatggttccccatggttgggttctttggcccgggccatgtttacgggaaaggggaccctcgaaaaaacgtggtaacacccttgaagaaccggttggcaaaaagtctggggtttaccccccatatttcg

SEQ ID NO: 90840 - protein, 180 aa, Zea mays
  misc_feature: Ceres CLONE 1578902
  misc_feature (69)..(179): Pfam Name: Chloroa_b-bind Pfam Description: Chlorophyll A-B binding protein
MASTIMAATSRIVAAKTPFLGQGRAAAAAANASPLRDVAAAAAGGRITMGNDLWYGPDRVKYLGPFSAQTPSYLTGEFPGDYGWDTAWLSADPEAFARNRALEVIHRRWAMLGALGCITPGVLEKGVPVDFKEPVWVKARAHIFSEGGAGLPGATPNRGHAQSIPGRGSASNVIPHGAFV

SEQ ID NO: 90841 - DNA, 1154 bp, Zea mays
  misc_feature: Ceres CLONE 1578904
  misc_feature: Encodes the peptide sequence at SEQ ID NO. 90842
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (906)..(906): n is a, c, t, g, unknown, or other
gtgttcttctcctccttcgctaacccctccacacttccatagtgaattccattnnnnncctaannntttacaaagctggagctccccgcggtggcggccgctctagaactagtggatcccccgggctgcaggaattcgtctcacccctagaaaaactctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaagactcccatttcgcttcggcggtcgagctccatgtcaacaagctgctccaggccaggcctatcaatctcaaaccccaccggaggccggcatgcgtgtcggcgtccctgtcgtctgagcgcgaggcggaatactactcgcagaagccgcccacgccgctgctggacaccattcaactacccccgtccacatgaagaaaccctgtctgttgaaggagctggcggcaagctgggccgaagaagctcccggttcccacgttataccttcccaacgtcctccaaaaaaccgggcggcccaaccttcggggttccaagccctctcggcggtgggtggggaaaccttcaacccggtttggcgcccttggataccataacgttctttttatataagtcgtgccgcgataatggaaaccgtctatctccccttcttggggaacacaattccaggccccaacacatttgcgagaaccccggctaaaagtataaccctggacaagggggcnccgtctccctaacaaataatgccgcaaaaaaaatagcggtcaaaaaaacaaacgggcccttgggtgggggctttccccacaaacccctccccaaaagcgtaattcacaaaattcttttggacagggggccaaaatctccccccaacaatttccccaggattcttagaaagggggggggcccggacactcaagggtcgggaaaaaaaatgggccccgtgttattggtaagaggcccttagaggcggggg

SEQ ID NO: 90842 - protein, 81 aa, Zea mays
  misc_feature: Ceres CLONE 1578904
MALSTFSVPRGFLGVPAQDSHFASAVELHVNKLLQARPINLKPHRRPACVSASLSSEREAEYYSQKPPTPLLDTIQLPPST

SEQ ID NO: 90843 - DNA, 902 bp, Zea mays
  misc_feature: Ceres CLONE 1578905
  misc_feature: Encodes the peptide sequence at SEQ ID NO. 90844
  misc_feature (588)..(588): n is a, c, t, g, unknown, or other
ctccccgcggtggcggccgctctagaactagtggatcccccgggctgcaggaattcgtctcacccctagaaaaatttccccctcctctcattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccagcagctgtccgaccacttcggctcgctcgagcgggggctcgcggcgcgctccgacgcgctccgcgtccgccgcagggccttcgacgcgcgcacccaccgcgcgctcgactcgctccaccgccgggaggctccatcgacgcctccgtcttgcgcgcgctcgaccacctttcactcatntccgccttcgcctcggcgccgccggcggtttcttcaaaggcccccgcacctccgatttcgactccaagggcctccccaaaaccctgccccccctttgcccccgaatgacctcccccccttcctgggcttccggggggccccccccagggaggggaacccttgggggccaaattccccccggccctaaaccttgggtgggacccggccaatttttttggaaccctttccaaaaattttcccctttacacccggggggggcgggaacccccccaacacggggtggggccgggggttcctcccggggggcccgcggc

SEQ ID NO: 90844 - protein, 175 aa, Zea mays
  misc_feature: Ceres CLONE 1578905
  misc_feature (114)..(114): Xaa is any aa, unknown, or other
MASPAAAAAAAPPPAAKEKEKDAEEAPVTGDMVSAGFAELERQQQLLATCTRLYQQLSDHFGSLERGLAARSDALRVRRRAFDARTHRALDSLHRREAPSTPPSCARSTTFHSXPPSPRRRRRFLQRPPHLRFRLQGPPQNPAPPLPPNDLPPFLGFRGAPPREGNPWGPNSPRP

SEQ ID NO: 90845 - DNA, 896 bp, Zea mays
  misc_feature: Ceres CLONE 1578907
  misc_feature: Encodes the peptide sequence at SEQ ID NO. 90846
tggagctcaccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaagccgtgctccgcacctacgaacacgtcttctcctcccgccccgcgctcctggtgtccgacatcatcatgtacggcgccaccgactcgtgcttcgcgccctacggcgaccacttccgcaaggcgcggatactggtcaccgtgcacctgctcaacgccagaaggtgcggttccacggccccgcggaaataataaagtggccccgcccccctcaaagggtgggccccgccgcccccccggcgtgaggccctgtacttgagcaagctc

SEQ ID NO: 90846 - protein, 189 aa, Zea mays
  misc_feature: Ceres CLONE 1578907
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLRTYEHVFSSRPALLVSDIIMYGATDSCFAPYGDHFRKARILVTVHLLNARRCGSTAPRK

SEQ ID NO: 90847 - DNA, 972 bp, Zea mays
  misc_feature: Ceres CLONE 1578909
  misc_feature: Translation starting site: 323
  misc_feature (689)..(689): n is a, c, t, g, unknown, or other
  misc_feature (830)..(830): n is a, c, t, g, unknown, or other
ctccccgcggtggcggccgctctagaactagtggatcccccgggctgcaggaattcgtctcacccctagaaaaactgaaatccttctccccctgcacgcacctgcagacctgctctctcgcgcgcatctcccgtgcccctcactgtttagtggcgacgactgggcgacagtcgccgccgccgcccgctaggggccgtgcccctggtctccatcttcgggcgcttcgcccaccagatatgagcagctggcaattcgattttgaggccattatttgataacccgggacaagtgcactgttacctgaccattttagcttgttcagatggctacacagttgccatgcttcacacagctcagtccaccgtcttgtagttggataaaagatgtcgggaactgcaaggctacgcctgatagggtagccagaagtgcccgagctttgggccactgtcacttccggtgctgtgcaggcccccgtagtgcaaactctttcaagaagaaagactctttcgagaagaaagactctttcctcgaacttcatccggaggtatctctgctccgtggcgagaagagtgccgaagttgtgccaatgaaaggttcctctgatgggggtctgttagagggactgggggtgccgccggaccgaaatgattacagtgaggctaagatcaaggtagttggagttggaggcngggggtcgaatgcagtcaatcggatgattgagagctccatgaacggcgttgagttttggatcgtggacactgatgtgcaggcccataggatgtctcctgtgctcccccacatagactgcagattggacaggatttgactcnaggcctgggccctgggggtaaccctgaattttggatgaatgagcaaaagaaagcgcgagtccatcaggaagctctttgggtgctgactggttttgtgaccgctggaaatggtggagaaactgaactgtagggccccctggat

SEQ ID NO: 90848 - DNA, 873 bp, Zea mays
  misc_feature: Ceres CLONE 1578913
  misc_feature: Encodes the peptide sequence at SEQ ID NO. 90849
  misc_feature (658)..(658): n is a, c, t, g, unknown, or other
  misc_feature (809)..(809): n is a, c, t, g, unknown, or other
ggagctccccgcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgntcagattactcgtggtattgagaaacagctaaagcactaggtgaagaactacggaagttgtctaaggaggttgagatagtgagcttgcagatgttgctgcagttagtgctggcacaactatgaaaatggtacatgatagcagaggcatganccaggtcggtcggaatggcgtgtcacccttgaaagagggaagagtctgagaccttccctaggtt

SEQ ID NO: 90849 - protein, 160 aa, Zea mays
  misc_feature: Ceres CLONE 1578913
  misc_feature (148)..(148): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELEDPVENIGAKLVRQAAAKTNDLAGDGTTTSVVLAQGLIAEGVKVVAAGANPXQITRGIEKQLKH

SEQ ID NO: 90850 - DNA, 899 bp, Zea mays
  misc_feature: Ceres CLONE 1578914
  misc_feature: Encodes the peptide sequence at SEQ ID NO. 90851
ctggagctccccgcggtggcggccgctctagaactagtggatcccccgggctgcaggaattcgtctcacccctagaaaaaaccttcacccaccgcccggcgcccgccatgtattcggccaaccactggggcggctcgttcgagatcgccgatggggcggcggaggatgaccacagccgcaacatggacctggaccgcggcgcgctgtcggcgcggcagcaccacgagctggacgagacgcagcagagctggctgctaggcccgccggaggccaagaagaaggacaagtacgtggacctcggttgtgtcgtcgtcaagcgcaagctcctctggtgggccttgtggtgcgtcgtcgccgctttcgtcctcatcggcctccccatcatcatcgccaagtccatcccgcacaagaagccaggcccgccgccgccagatcagtacacagaggcgctgcacaaggcgctcctcttcttcaacgcccagaaatccggccaccttcccaagaacaatggcatcaagtggcgcgggaactctggcctgtcagacggctccgacgccaaggacgtcaagggtggcctcgtcggcggctactacgacgctggcgacaacatcaagttccacttcccgatggccttctccatgacgctgctgagctggtcggtgatcgagtacagcgccaagtacatgccatggggggagatgaccatgtcagggagctccatcagtggggcaccgactatcggctactcaccttcactcctctgctgcaccatcgacaatttatacccccaggtggtggccgcttagatcacggaagccggcgggacgacattactgctgaaccggccgaaggaatgtgttccctgcccctcattgtcgtgacctccgccctgttttgga

SEQ ID NO: 90851 - protein, 232 aa, Zea mays
  misc_feature: Ceres CLONE 1578914
  misc_feature: SWISSPROT Homolog: EC 3.2.1.4 Cellulase
MYSANHWGGSFEIADGAAEDDHSRNMDLDRGALSARQHHELDETQQSWLLGPPEAKKKDKYVDLGCVVVKRKLLWWALWCVVAAFVLIGLPIIIAKSIPHKKPGPPPPDQYTEALHKALLFFNAQKSGHLPKNNGIKWRGNSGLSDGSDAKDVKGGLVGGYYDAGDNIKFHFPMAFSMTLLSWSVIEYSAKYMPWGEMTMSGSSISGAPTIGYSPSLLCCTIDNLYPQVVAA

SEQ ID NO: 90852 - DNA, 943 bp, Zea mays
  misc_feature: Ceres CLONE 1578917
  misc_feature: Encodes the peptide sequence at SEQ ID NO. 90853
  misc_feature (669)..(669): n is a, c, t, g, unknown, or other
  misc_feature (787)..(787): n is a, c, t, g, unknown, or other
  misc_feature (793)..(793): n is a, c, t, g, unknown, or other
  misc_feature (859)..(859): n is a, c, t, g, unknown, or other
  misc_feature (870)..(870): n is a, c, t, g, unknown, or other
  misc_feature (901)..(901): n is a, c, t, g, unknown, or other
ggagctccccgcggtggcggccgctctagaactagtggatcccccgggctgcaggaattcgtctcacccctagaaaaagtctcgctacggctctctactgcccataccgctaccactgtacgtgcctgctgaccgccgagcgccgagcaatccttggagccggccgatcccggcgtggttcggtggtggcactctattaccgcaactgctgtctgtacctcagagctgagcagcagcgtggcaagtgccacctgctgcacggccatcgtctgcaactgcatcgctcgctctctcctttcactgggaacatctatcagctcgcgctcattggccatctttggcttccatggagaggctcattgccggcctacttggcttcctattggttgcatcggtaggaagccatgcagctcgtgctccggatcagtactggaagtctgctcttcccgacactcccatgccgacctccctgctccaactcctagacgccgctccagccggcgacggcacgaccgtcaacgtcagctggcgcggtgtccacgtcgatgctgggcacggtaagcccgggggtacgacggttgacgtacgcaagggcggcgtcggcgtcaacgttgaccctggcacgagcggcaagcccggcggcacgacggttggcgtcaggtaaggccngagtcggcgtttacgtcaacccgggctacggaaagccggcggcaccacagtggtcgtcggtacggtggcgttggcgtaacatcaacccgggcagcccggagcacaacggtcgcgtcgnctaggncggaatggcgtctacgtcatcccggcaaaccggcggtggtgcaggtacaccgttgcgttgtcaatngcgcgtggacntgccctcatcctgggcccgcaagcgggcgcnacacgtcagctttgaagggcggggtggcgtcacgtgacccgg

SEQ ID NO: 90853 - protein, 105 aa, Zea mays
  misc_feature: Ceres CLONE 1578917
MERLIAGLLGFLLVASVGSHAARAPDQYWKSALPDTPMPTSLLQLLDAAPAGDGTTVNVSWRGVHVDAGHGKPGGTTVDVRKGGVGVNVDPGTSGKPGGTTVGVR

SEQ ID NO: 90854 - DNA, 986 bp, Zea mays
  misc_feature: Ceres CLONE 1578921
  misc_feature: Encodes the peptide sequence at SEQ ID NO. 90855
ctggagctccccgcggtggcggccgctctagaactagtggatcccccgggctgcaggaattcgtctcacccctagaaaaagttgcgtggtgggggacgaggccagagcgccccaaaaccaaaaaccccagaaccccgacctagggttacgccatcgccatgggatctgttgcctccgccgctgtgccaccacctcctcctcaatcagcgctgcctcaggcgggcgcgccgccctacgggcccgggctcgccgggatcctcccgcagatgtcgaagggggaggagaagaaggatgagaaggtggactacctcaacctcccctgccccgtgcccttcgaggagatccagcgcgaggctctcagtttgtccccttatccctccagttttaactccataaccagctagcgcgtgtgcagtgctgcggcattgtgtagttttcactcggtatgcactgcccttatgatgctgtttggttcgggtaaattgtttcgtgatcggtttacaccgctatcaaataacgtttagttgttgtttgggttcggccaaaatgttatcggcctcccacgggatcggatacaaggccttcacaacatcgtttaccaccgcttctaccaggcgtatccaattacaaccggcccgtttttcctccccccccgtgcagtgttcaaggaaatcattgcccccaaaacatatgcccccccccaatttcttttttattgcggttaccctttccgaaagccaaaccaaaacggcccccgggatacccgggggaaaaattggtttatccggagaagattaaaaatgccttggaagaaaaaaaaattttggggggggggctttactttttagggggggtctcaaatggggaaagaaaaattcgggggggtccgctttaattgtcataaaaagggccccccacaatatggtgtcttaaaaatactcgtcgcgcccttgtgttgggcaacaaaatttctgctccatgtttct

SEQ ID NO: 90855 - protein, 81 aa, Zea mays
  misc_feature: Ceres CLONE 1578921
MGSVASAAVPPPPPQSALPQAGAPPYGPGLAGILPQMSKGEEKKDEKVDYLNLPCPVPFEEIQREALSLSPYPSSFNSITS

SEQ ID NO: 90856 - DNA, 1015 bp, Zea mays
  misc_feature: Ceres CLONE 1578924
  misc_feature: Encodes the peptide sequence at SEQ ID NO. 90857
  misc_feature (817)..(817): n is a, c, t, g, unknown, or other
ctccccgcggtggcggccgctctagaactagtggatcccccgggctgcaggaattcgtctcacccctagaaaaactgccaaatcaaatccccaaaccccgggccactgctccgctcctcctccttgccgccgtgcggttgagcgccgaccacctagcccgacgccaccctatggctatggaggtccgcctcagggttccgccgccgcacgggagcgccccacggagccagcatgcgaccggcggcaaggggcatccggtgcttgtgcaagcaggggacgcgctgccgctgccgatgcggatcacgaacctcatcttctcggcgctgttctccgcgtcgctggtgtacctgatgctgcggtggcgggagatgatccgctcctccacgccgctccacgtggtctccctcgccgagatcttcgccatctgcgggcctcgtgccggccgccatctacctcctcagcttccttgaaggatggccttcgtggaattccggtcgcctcccatagcgggcaactaggggggatttcctttttggactcccccccctcgtaaagggggcggggctcccctttttttcccggggcccggggggcccccccgtggggtggttgctttgggggaactcccccccccccgccccccgggttaaaaatagtcgcggggggggaggacaaagggttattcttggggtgcggggggctagggggctatggtaaaattcccctgcctcctccattggggggggaaaacccggccgcggaatatatggccccccggtgcccctcaggaaataagggggtgagggggccctcttcnagaatatttgtgggggagaaaaattacattgttccccccccctctggtggttgtaaataggggcggttttctccgccccccatcccaaaaactcggggtgggttttcccccccccccgcggggtgttttgataccctcttttcttgggggcgggttggccctcacccaaggccccgtgagggggtggccccccctctc

SEQ ID NO: 90857 - protein, 97 aa, Zea mays
  misc_feature: Ceres CLONE 1578924
  misc_feature: SWISSPROT Homolog: EC 1.1.1.34 Hydroxymethylglutaryl-CoA reductase (NADPH)
MEVRLRVPPPHGSAPRSQHATGGKGHPVLVQAGDALPLPMRITNLIFSALFSASLVYLMLRWREMIRSSTPLHVVSLAEIFAICGPRAGRHLPPQLP

SEQ ID NO: 90858 - DNA, 1003 bp, Zea mays
  misc_feature: Ceres CLONE 1578925
  misc_feature: Encodes the peptide sequence at SEQ ID NO. 90859
gctctaagactagtggatcccccgggctgcaggaattcgtcacacccctagaaaaaactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcaagcgaggatgggcggcggcaacggtgaaaccacccagctgggggagccactgctggcgaagaaggcgatggcgtatcgccctaggtgcccaggctgccgggtggaccgcctcaacgcggagcgagagggtgtcttcccctctcagggactcttcctcttctggctcgtcaccattaactgcaccctgccgatccagtctctggtccccttcttgtacttcatgataaggggaccgcatatgggctaaccaacacaagaactcgggattttatggtgggttttgttgggcgcctccttatttggggggggaagggcagctttctccaaacttatgggggaatcccgggcctgataagcatgggaagggaaacccgttttccggacctgtaccccttattggcaataatttaacctccaaaaaccaaggtttgggacctaaactcaaaactgtgcgggtggggattaatccccagtagggcccggcttggaaaaccaggtgggaggtttccccggccccatttagggctttgggcttaacaataatgtggccgaaaaaaaatacaaaccttccgggcttgtggcatatgttttctttccccacccaagggatttgggcccctttattgggcccccctattgggtgggttctcctcccgccacctcggtaataactctccaggttttctccctccaacactcccattttggagaggcgcccaaacctctcgcccgggggtggagtaataaaacacttgg

SEQ ID NO: 90859 - protein, 79 aa, Zea mays
  misc_feature: Ceres CLONE 1578925
MGGGNGETTQLGEPLLAKKAMAYRPRCPGCRVDRLNAEREGVFPSQGLFLFWLVTINCTLPIQSLVPFLYFMIRGPHMG

SEQ ID NO: 90860 - DNA, 759 bp, Zea mays
  misc_feature: Ceres CLONE 1578926
ctctccgcggtggcggccgctctagaactagtggatcccccgggctgcaggaattcgtctcacccctagaaaaaaacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcaaaaaattccgagattttacttggatacaagtggaaacaccccaaagtttttggggccgaaaaacttcccaaaccctgggggaatctcaaattttgaaacccccgggggggaaatatttgggggcaaaaaaaaaccccccaatttttttcctcccccccccaccggcggggaaaaaacccccccaaaaaaaaaaaaaaaacacccttttttttttgccgccctttcacggggggggggcgccccccctccccggagggggggttttattcccccccccccccggtgtaggaagaagaaatgtctctgttggtttgtcgccgcataaaacccaccaaaagaaggagaaatgttttttttttttttttccctgcatcacaaaccccaccgcaccattgttttggggtcggggggtgggggctacttattttttttggataaacaaaaaaaaagtacccacctccctctttttttttttgtggggcccga

SEQ ID NO: 90861 - DNA, 1311 bp, Zea mays
  misc_feature: Ceres CLONE 1578927
  misc_feature (52)..(52): n is a, c, t, g, unknown, or other
  misc_feature (54)..(54): n is a, c, t, g, unknown, or other
cgcccttcgcgtgctgcctcacaacctcccctacctgagaagctaaggtgtntnttccttttttcaaactggagctccccgcggtggcggccgctctagaatagtggatcccccgggctgcaggaattcgtctcacccctagaaaaaaaccgacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacacttagttcctctcgtgctacttgaggtacatataccgcagaaaaattccaagaattttacttgattacagtgggaacacccagcatttttgtgcgaaatacttgcctacctcgcgaacccagttgctagcggggtgaatttggccaagaactcaatttctctcaaccccccccccacaaaactgggccttggttctcctggcttcccctgtaagtcttttgcacaccaattgaggttctccccaatctcccttttctgggaacttcgtcccaaacattctcttttggggctgtggtccacggcttcacaaattcacccccctcgccataaaaaccttgtaccaaaaagggtggggaagggccccccgatctttcgaactgagcagaccgtaaatgtttggttggaaaatgcctttaactatgctttgaatttttatgagactccaaaaactttgggcataaacaagagctcacccctttctggctcctacagaggtgtcatgtgaaacacctggtctacccgacaacggtattttctctttagcgacacaaatgaaatcacaaagtcccgtgttatattctttaacaccgtgaggcgtgatacgaattgggcgattcgcccctcgatagctctattctttcgcgcgttatcctccacccaagaggaaccatcaccccccgctcgttcgacccctgctacggagcgacatgacgcgcgcgcctcttgagggtggggagcagaggcgcctgaaacttatatgcgagtcgcgccaccacaggggcgttttggagatacgcacacacccccattatgtatgtgggtgagatcgcctcttgtatccactctccgagctcccttgtgcacgttctgacatgctctccgcggggaaatatacatacctatatcgcccggtgaagacagccccactcatcagcgagaatgtacgccgcccgagaaaatatcgtcccgcccccgccgatggtacgcgctggcgtgacacttgg

SEQ ID NO: 90862 - DNA, 1099 bp, Zea mays
  misc_feature: Ceres CLONE 1578929
  misc_feature (1099)..(1099): n is a, c, t, g, unknown, or other
ggagctccccgcggtggcggccgctctagactagtggatcccccgggctgcaggaattcgtctcacccctagaaaaaaacctcctctgcctgccgcttctcctgctgcgggcgggcactgctgcaagtactagaggaggacatccgcttccattactgcgcctgcggacgatcggaggaaccagtagcggaagcttccattttcggcgggcgcaataaatttcccgcatggctcggagggccgcgtcctcgtccgtctcccgctgcctcctggagagggcccctgccggcgcgccgcccgctgacccctctgcgccgcgcaggacagtcgctgcagatgggatgcacaggcctgtgcccagtgtccttcagaggttggagcctgccgcagcaattgtaggacccccccctggccctcgggggggggtaaccacacaaagctcccccattaatggggaaccttgtttaatcccccctccgggaagacctttcccaagccctggaacccccgctcccgggggggggcaattgccccagggggggctggaggggggcacttcaaaagaatttttaccccgccacaaaaaccccccggcctcctaaagggttttttaaataacaagggggctagggcccgaaaaaataaaccccgcccataaagaagaggccccgcgagctccccaatgggggcgttttccgcccttttttttttttaaagaagcccccccttggacaaactcgcggttggcgctctttgtgagaacaggtggggtatacacggcggcgccccctttatattatatgcccctgcgctcagaagagagaaaccacaccgggtgggggggcgcccctttattgtgggatccacaacctggtgggggaggcacacataaaataacaactgggtgtctccttctccccccgcgatcagagaatccccccccgagggatgtattgcttccctcctgtcacaaatagaggtgtgggtgtgtgatatgggcaaatacccccggtgggtaggagctatcttctcctcccttaccaattacccgaggatgaggagtgcctctctcctccttgtcatgctgagaagattatgn

SEQ ID NO: 90863 - DNA, 1333 bp, Zea mays
  misc_feature: Ceres CLONE 1578931
  misc_feature: Encodes the peptide sequence at SEQ ID NO. 90864
  misc_feature (1185)..(1185): n is a, c, t, g, unknown, or other
ttcccccctctggttccgcgtgttttgtcctctcccccctttatttcccctttctttttttttaaatctggagctccccgcggtggcggccgctctagaactagtggatcccccgtggctgcagtgaattcgtctcacccctagaaaaacgaccgcttggcgcttcatcactcgttccctttcgaaagcccgcgcacgcacgtcggtcgtcccgagcaggacctcgatcggccgagatgggcgacgccgaacgggcttgcgcggattcgagacgaccgggaagaagaagcaggacaacggcgtgtggtattacgacatgtcggcgcctgtgctccctcaaaccatcgacgagctgcactcgcttgcagcggaagcggtcgggcccccagcacggccccaaggggtcggcgcccaccccgcccatcatggggggggggccctttccgcccttccgcgggtcccgaatttctctaggatagaacccccccaccaatcctgatttctgtcccacctctggcgttctttgggcgttctcttcacccctggtatacccggggcctattgattggtccaggggcgcaccccggggccgctaatggggcattgggtcccccgcccccggggcgtgccccccttctatcccctattggggggcataattttaggcttactcccattcccagttgagtgccccccggacattgtgtcgtgtggttgtgtaaaaacgccccctctcgtttgttgttttactcccttgtggcggtctgtaaaataccctttcctctcaccaccgcatgttgtttacttttatcgtagctccgctcgcccatcttttattatccatatatagatggtggtggttgtgtccccatcactcaacatttcccctcgctggctctcattatgtgaaatttaacattctttgttttgcgcggttgcctttataatttcgcggtgcgggtgggcgctccctcccagagtggaaccaaaacacacgcctgttgttcataagtgtcataagaccatgtccctcttcctccacttatgcgataccaccatgtgtcttgtggggtggaattacgagtgctccccactcctcctctctgtcttgaattttaggacgccacacgaagcacgaatcttctctgtctgttgatatattacgagtggaggaaggggtgtcgncctcgatcattatactccgttttaccgtttatgtgatacgatatgtgttccttctctctccatccatacttatccctccgcccactgctggcggatatctgctcgtctgtatttccatatgctttatggcgggcgctcctccccctcc

SEQ ID NO: 90864 - protein, 60 aa, Zea mays
  misc_feature: Ceres CLONE 1578931
MSAPVLPQTIDELHSLAAEAVGPPARPQGVGAHPAHHGGGALSALPRVPNFSRIEPPHQS

SEQ ID NO: 90865 - DNA, 1015 bp, Zea mays
  misc_feature: Ceres CLONE 1578934
  misc_feature: Encodes the peptide sequence at SEQ ID NO. 90866
ggccgctctagaactagtggatcccccgggctgcaggaattcgtctcacccctagaaaaactctcgatccggaaacctctcaaaccctagccgcctcctgcaagtttcagagctcaagaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagaacaagcttgatgcgcagcctgagcttttcatccaccttgtcccacacaagggcacgaaaactgtcttccatcattgaaaacggcccccccttaaccaaatccgaacctttcaaaaaccctcggtaaccatccccaaggcccgggaaaaaagagttcctgggaaagcctttgttgcccggccctgattttgcccataatttggccctttttggggattggttttctaactcggccaaaccccgtccccccaaaaaaattttgtgtctgcgccccccacgccccaatcgtatataccgatccctttaccgtggtggggagcccccaatgccgggggggcgcctcgttccccttttttcccccccgtaaaaccctccccggggagactactttttgccccggggggcccctcaagaattcccctccgttctccttttagggcaggagagcaccggggacatcactcttggggaggggtcgcccctcaagggagcgcgggtaaagaaacaacctctggagttttatggagggtgactcccttctcctcggggatgcgcatataaccctctataacaggaatttttcttccttctatacccgggggataaaataaatcctcccacaaaaacaccgtctacattttttcgtaggggcccatcaaaaactcaataaaatgcgcgggggtgtcttcttggtggcccctgcaacaaacatcctcttgggg

SEQ ID NO: 90866 - protein, 80 aa, Zea mays
  misc_feature: Ceres CLONE 1578934
MASETETFAFQAEINQLLSLIINTFYSNKEIFLRELISNSSDALDKIRFESLTDKNKLDAQPELFIHLVPHKGTKTVFHH

SEQ ID NO: 90867 - DNA, 1013 bp, Zea mays
  misc_feature: Ceres CLONE 1578936
  misc_feature (790)..(790): n is a, c, t, g, unknown, or other
atagctggagctccccgcggtggcggccgctctagaactagtggatcccccgggctgcaggaattcgtctcacccctagaaaaaacccggaccccggtctgcgtttgtccctgcgggctgcggccctgcctcttctcttctcccgttcccctcgccgcgtgagctctctctctctctctcctctgtggtgacgactgggcgcccgcacccccggcagccgccgccgcccagtccccgtcgggcccttcggcaggtcttcttcggccccttcgccggcgacgagccgcaccaggcgtacatgtgtacacccaggcccttaactgcgcccgcccctgcgactggttttcctgctggtttgtgtggatttggctgccggaggattggtgcagcctttaggatcacggtagattcgctgtgaaatccgaaaggtgctcagggcatgttggggggaccagcgcatgaatactgggctaagaatcgggaaacctcattaaagcactgcccctggatttgaccccgcgccgaagaagaacccttcttgtaaacagggaactgccggtaatcaaccccccccgcggggggggggggggcccaaaagggggaaacacggggagggggccccgggatatatttttttcccaaagaaaaacacaaaccccggggggggttccgaagaaattttgtgacacagaacacggggccccccaaaatagggggggccccaaaaagggggggggaaaataaaacacgggggacccccctttgggggggaatcaggggggagagtggnattttatttggcgcggcccccctcccccgcgggtttattattatggggggggggtgggtgaaaccctcctcccccccccccggggggtggtggagaggactcccggggggagggggggggggaggggtcccaaaaaaaaaataccccccacacatattccggggggggggggggtttgaacccccccccaaaggaggaggcggcccttccccccccaatattt

SEQ ID NO: 90868 - DNA, 1198 bp, Zea mays
  misc_feature: Ceres CLONE 1578937
  misc_feature (55)..(55): n is a, c, t, g, unknown, or other
  misc_feature (1087)..(1087): n is a, c, t, g, unknown, or other
  misc_feature (1093)..(1093): n is a, c, t, g, unknown, or other
tccggccctcgccgcattgtcgcgtcctgcctccccttctttgcctggctgggcngggtggggtttttcaaaactggagctccccgcggtggcggccgctctagaactagtggatcccccgggctgcaggaattcgtctcacccctagaaaaacccggaccccggtctgcgtttgtccctgcgggctgcggccctgcctcttctcttctcccgttcccctcgccgcgtgagctctctctctctctctcctctgtggtgacgactgggcggccggacccccggcagccgccgccgccctgtctccgtcgggcccttcggcaggtcttcttcggcgccttcgccggcgacgagccgctcctggcgtacatgtgtacacccaggcccttatctgctcccgtgcctgcgactggtctccctgctggtttgtgtggatttggctggcggaggattggtgcatggtttaggatcacagtagattagctgggacacccgaagggtgcgcaggtcacgttgggggaccaggtcatgacacgagggtgacactggggaatcccatcacgactcccgccctgattcgcacccccgcttgattaggcacccttcggtgaacctcgccgctgcccacatccaaccccccttgctaagtttttgttggggttcggttaagggtagggtcacggttgggagggggcccgggggggtactggcgtctcgcctgggtagaaaccccgtttactggtctcccccccgcctcgcctggttaccccccgctcctatctccgcgacaggcgtcggcgtctgcgtagctaatggtgtaggtgagcgtgccctccccctcacggatggggtttcgctggttaaatccactatgttgggggggccagcttgcgtgctttatggagatacgagcggtttgtcggacacgccgcagagcatatagagctcagtatgtgcttctccctattttgcacatggtggccacccacgcccgcgaggaaaatgatgatggataatgagggtgtgcagcatgcacgaggttgttttgatattgtgtatgtggcgcgccgaaacatgctacagtaggggnatgtgnccgcggggtttagagattttccctccacagtgttgtggcgacacgcccgccagtctctcgagaaaaaatttttgcgtagagtgtgttggttctccccacactcat

SEQ ID NO: 90869 - DNA, 941 bp, Zea mays
  misc_feature: Ceres CLONE 1578939
  misc_feature: Translation starting site: 159
  misc_feature: SWISSPROT Homolog: EC 1.4.1.2 Glutamate dehydrogenase
  misc_feature (811)..(811): n is a, c, t, g, unknown, or other
  misc_feature (941)..(941): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaagctaccagtgtcggtgagaagatgtcctcatctttgatcttggaggtggtacctttgatgtctccctcctcacattngagaagggaatcttgaggtcaggccacagctggtgaccccatcttggtggggaggacttggacacaggatggtcaacacttcgtccaggggtcaggagaagaacagaggatttcctgggcacccccgggn

SEQ ID NO: 90870 - DNA, 906 bp, Zea mays
  misc_feature: Ceres CLONE 1578940
  misc_feature: Encodes the peptide sequence at SEQ ID NO. 90871
  misc_feature (399)..(399): n is a, c, t, g, unknown, or other
ccccgcggtggcggccgctctagaactagtggatcccccgggctgcaggaattcgtctcacccctagaaaaagctcctgcctcgcctcaccaccattagagcgcgcgcgccaagctcgtggtgaggttttcgagatgaaggttatcgagaagatcctggaggcggcgggggatggccggacggcgttctcgttcgagtacttccctcccaagacggaggagggggtcgagaacctgttcgagcggatggaccgcatggtggcgcacggcccctccttctgcgacatcacctggggcgccgggggatccaccgctgaccttaccctcgaaatcgccaaccgtatgcagaacatggtgtgtgtggaaaccatgatgcacctgacatgtacaaacatgccantagagaagattgaccatgcctttggaaacatcaaatccaatgggattcaaaatgttttgggcctcagaggggatcctccacatgggcaagacaaatttgtgcaagttgaaagcggatttgcttgtgctcctgatttggtgcagcatattgtagcaagtccgggattatttttggcttaactgtactggttttccgaaggccccctgatgccatcaaggtgagggaggggcctccttggaacctttacaatgatcttcgctccttaaaaaaaaggtgaaccggggcctaaccttttgttcacaacttttcttaaaacccaaccctttctcaagttggggaaaaccggccccaaatgggttttcttgtccacttgtcccgggaaaagcccaaaaaaaccccaaagtttcccgccaaaaaggggtttccaaaaaaaaaacccttgaaaaacccgcccccaactctctaaaaaaaatgggggggtgtgaaaaaagagacccccccgggaga

SEQ ID NO: 90871 - protein, 147 aa, Zea mays
  misc_feature: Ceres CLONE 1578940
  misc_feature (6)..(147): Pfam Name: MTHFR Pfam Description: Methylenetetrahydrofolate reductase
  misc_feature: SWISSPROT Homolog: EC 1.5.1.20 Methylenetetrahydrofolate reductase (NAD(P)H)
  misc_feature (89)..(89): Xaa is any aa, unknown, or other
MKVIEKILEAAGDGRTAFSFEYFPPKTEEGVENLFERMDRMVAHGPSFCDITWGAGGSTADLTLEIANRMQNMVCVETMMHLTCTNMPXEKIDHAFGNIKSNGIQNVLGLRGDPPHGQDKFVQVESGFACAPDLVQHIVASPGLFLA

SEQ ID NO: 90872 - DNA, 888 bp, Zea mays
  misc_feature: Ceres CLONE 1578943
  misc_feature: SWISSPROT Homolog: EC 2.7.11.1 Non-specific serine/threonine protein kinase
ccccgcggtggcggccgctctagaactagtggatcccccgggctgcaggaattcgtctcacccctagaaaaacgacgccgccaactgtgggctctccggcgaaatcccgccggagctcgggaggctgcagaatctggacacgcttttcttgcaggtgaacggcctcaccggcagcataccgtcggagctgggctacctcaggagcctcagttctttggacctgtcgaacaatgcgctcaccggtgagataccggcgagtttctccgagctcaagaacctgacgctgcttaacctgttccggaacaagctgcgcggcgacatccccggcttcgtcggcgacctgcccagcctcgaagtgctgcagctgtgggagaataacttcaccggcggtgtgccacgccgcctcggccgcaacggccgcctccagctgctcgatctctcgtcgaacaagctcaccggcacgcttccgccggagctctgtgcggggggcaagctgcagacgctaatcgccctcgggaacttcttgttcggtgccatcccagactcactcggccagtgcaagtccttgagccgtgtccgtctcggggagaactacctgaatggctcaattccgaagggtctattcgaattgccgaagctgactcaagttgagttgcaagataacctcctcactggcaatttcccggctgtgatcggcgctgcggctcctaaccttggtgagattagcctgtccacaaccagcttacgggtgcattgcctgcatctcttgggaaactctctggtgttcagaaattgctgcttgatcagaacccgttctctggtgccattacctcggaagattggccgatgcagcagctctccaagctgacctttgcagcacaaggttgg

SEQ ID NO: 90873 - DNA, 1196 bp, Zea mays
  misc_feature: Ceres CLONE 1578944
  misc_feature (57)..(57): n is a, c, t, g, unknown, or other
  misc_feature (331)..(331): n is a, c, t, g, unknown, or other
gggtggggggtttccttaacggcaggtatcacacggaaatcgtgaaactaataaatnttttttttttttttttaagctggagctccccgcggtggcggccgctctagaactagtggatcccccgggctgcaggaattcgtctcacccctagaaaaaactcccatcccagatcaggattagccgaccacccgccgaaggccagagagaaatatctcatcttctctccaccggatcggttctatcgagagcgagggagaaagggaggtggtgcgtcgaggggggccgagattttgccggtttggagccaaataggggtatgagctgcttcgancaccgccgccgctccgacgtcgcccgccgccaggactgcctcctcgtcttcgtcttcttcctctcgattcccctactcccaggagttttaatctaggagtaattaatggggataacaaatccctggaaaaaggggttcgccttccccccctcgggggccctttttgagctttctgtgtcccctcttgtatggaaacccccccctttttcctccgtcttcccccacggtgaaattccggggggtttggtttggagatcccaatgggccccaataatatggaaggccccttttgtgccccccaaacctttcgaaaaagggggggggacacagaggacttccctatctgtggatgttggaaattgcgggggggggggcgactcttcaggaggggttaataaaatgctaagcggccgtgctgcctcttctctacaaatctttccctctcctttagagggtgtgcagatgctgtcttgtgagtaaactttgcggcaataaacttttattttggcggtgggtgggcgcctcctcttaaccacccgcatacccctccttctttgtggggtgtctcacaccttagttgcctatcggggggttcccccctgatgtgtgtcacatcctaggggtgctggtttatccagaatatatttccttgtgggggccactccaagtaaaatgttttccccgcccgcgggtgtgagtgtcccaccccccgccgtggggcgagtattacccggcgctctgtcggggtaggtgggctcctctgagatgtcccgtccctctctctccttcgtcacggggggtaggatatgcccgccccctatacatagactcgaatttaagtggtagctgtcgcctcctccggtaa

SEQ ID NO: 90874 - DNA, 905 bp, Zea mays
  misc_feature: Ceres CLONE 1578947
  misc_feature: Encodes the peptide sequence at SEQ ID NO. 90875
  misc_feature (835)..(835): n is a, c, t, g, unknown, or other
ctccccgcggtggcggccgctctagaactagtggatcccccgggctgcaggaattcgtctcacccctagaaaaagcctgcttcagctccctccctggcctctccctctcgttgccataaaagattccaagcttgcccggcccgccgatcctactgccattaaagtcggcaagcggcgtcggcggcagcagcctgaaaccaggggaaaccgaaccaccacggtcaactatctatctatctgcaatctccatccatctcctcccacacccactgaccaaccacagcacagcagcctcaagatgctttacatggtgtagccggcaagaaccttccctcccgggcgcaaaggggctctctctcctttaatttccttcaagaggggatagatagcccctctttcccccacctgcatcttccctccggttgcgcgctgtccctcttgttggttcttggcatcgatcgtcggttttcgcgccgcctgcggaaatggcggcggggctgctgctcaagatggtcggcttctgcttctgggcgctcttctggctcgccggctccgccaccgtgagcacgaccacccccgccctcgccggcggcggcgaggcggtggtcgtggacgcccggtcagccatcgccgtcacggacgacgacttcgtctgcgccacattggactggtggccgccggagaaatgcgactacggcacctgcagctggggcctcgcctccctcctcaacctgtatctctctaacaaaatcctggtgattgcccgtcaaagcgttctcctcctctgaagctcccggctgggccggctctctgcaagacatgctgatatacggcnaccggcgacactcgccagtccccctgcgccccgtttcgtgaagaacccgtcagcccatgtttcgggttcc

SEQ ID NO: 90875 - protein, 100 aa, Zea mays
  misc_feature: Ceres CLONE 1578947
MAAGLLLKMVGFCFWALFWLAGSATVSTTTPALAGGGEAVVVDARSAIAVTDDDFVCATLDWWPPEKCDYGTCSWGLASLLNLYLSNKILVIARQSVLLL

SEQ ID NO: 90876 - DNA, 902 bp, Zea mays
  misc_feature: Ceres CLONE 1578949
  misc_feature: Encodes the peptide sequence at SEQ ID NO. 90877
ctccccgcggtggcggccgctctggaactagtggatcccccaggctgcccgaattcgtgtcaccgcctgaaactgaccgactgatcacgatcgagatgtttcgtcggcttctacttgcaggtgatggggaagtgcaaccccgggggatgcggcactcttcggtttcctcgacagccgtgcgtgaccgtccagaaatggtacctccccgggatgcaccccaagtccttgcaagacatcactgcaggtgcccgatggctggatctagctgccggagatcaccaccctcttggacttgcacatgaaggtcccgcctcgtatgggcgatgacctcttgcccgccagctgggacttcgtcaccaaactccccttgtccaatgtcatcaaagaggacaagaaagattggatgactgacgaggacttgcactggggagaccctcacccgcgtgaaccccctgatcatgaagctgtcctctctgagtctccctgcggaaaatgcacccttgttgccatcaagtactgcgaccagactagcacgtgcgggaggcgcacatcgcggagtagcctcgagggcctctccgtgtaaaatgcgccggacagcatacgggtgtgggtactggacgtacacaaccactacatggctgtcctgatctacgtccacagcctgaacgacaacttcatctagggaaacatgtaccgcctgttactgcgcggggaccgctcgctcgaaaccagtggaccgcccagatgagcctccgcgaactcgggaacagatcacgggccgcgaatagcacggggtataagccgaagaccccccacgggcaggcgctgtaaatttggtggtgaccctcgcacaaggccttccctgaacctataagacttccggctggccccaaggaaattcg

SEQ ID NO: 90877 - protein, 94 aa, Zea mays
  misc_feature: Ceres CLONE 1578949
  misc_feature: SWISSPROT Homolog: EC 1.13.11.12 Lipoxygenase
MKVPPRMGDDLLPASWDFVTKLPLSNVIKEDKKDWMTDEDLHWGDPHPREPPDHEAVLSESPCGKCTLVAIKYCDQTSTCGRRTSRSSLEGLSV

SEQ ID NO: 90878 - DNA, 960 bp, Zea mays
  misc_feature: Ceres CLONE 1578950
  misc_feature: Translation starting site: 333
  misc_feature: Pfam Name: AP_endonuc_2 Pfam Description: Xylose isomerase-like TIM barrel
  misc_feature: SWISSPROT Homolog: EC 5.3.1.5 Xylose isomerase
  misc_feature (354)..(354): n is a, c, t, g, unknown, or other
acccgcggtggcggccgctctagaactagtggatcccccgggctgcaggaattcgtctcacccctagaaaaagccgagttcagcagcactctcctccgccctcttccaggtctagcagagattggggacgcgtgggcatcggagattgcctcgaccgcgcgtgctgaattgtgttctcagggagcgcgtttcctggtcaactaaggccggcatgaagggctgctcagagcgcttgctgtttctgctgctgctgctgctggcatcgtcgtcgttactgtccgctgtgattgccgcgcagcagacttgccccgccgacctcgacagcaaatgcgatggtggcgcgtctgatgatgnattgggagggggagttcttccccggcgtcccgaatatcaagtatgagggtccaacaagcaagaaccctcttgcttataagtggtataacaaggaggaagtgattctcggtaagaagatgaaggattggatgcgcttcagtgttgcgttctggcacacgttccgcggtactggcgctgatcctttcggtgctcttacaaagactggcctttgggaggatggcacaaattcttgggcatggcttaaaagaagatgagagctcactttgagttcatggagaagttgggaggtgacaaattggtgcttcctgacagggatattgccccggaggggaaaacccttgaaaaaacaaattccaacttggaatgaaaaaacccagccgggcaaagccactggcggggggaaaccaattttaagccctttggggggtaccccacagcctttttggctcccccttataaggagggggcggcctccaagccccagggttaaaaattttcgctttgcgcgccccccaatttaaaaaactcttgggggccccccccacccaggggtgggaaaacattttctcccggggggggaaaaaaagggttcacaaactctttaag

SEQ ID NO: 90879 - DNA, 895 bp, Zea mays
  misc_feature: Ceres CLONE 1578953
  misc_feature: Translation starting site: 331
  misc_feature: SWISSPROT Homolog: EC 3.2.1.23 Beta-galactosidase
  misc_feature (719)..(719): n is a, c, t, g, unknown, or other
  misc_feature (792)..(792): n is a, c, t, g, unknown, or other
ctccccgcggtggcggccgctctagaactagtggatcccccgggctgcaggaattcgtctcacccctagaaaaaggagccgagcagctactcctcccagtcccaggctcactgtcgctcctcccaagaacccgcccaaagaatcctagaaatccaagaaagggagcaaccaaaacaggaggaggtctgcaggaggaggagcaggaggaggtggtgctgaaggggaagatctcacaagtgtgtgaagaccacacagtctcgcgcactcgcaaacccagtgcgcgctgcggtcttcctcttcgcccaccttcttggagcggggaggttggccatgaggaggtggtggccggctgccctgctgggctgcgcagtggcggtgtccgttctggtggccgccgtggaatgcgctgtgacttacgacaagaaggcggtgctgattgatgggcagaggcggattctcttctccggatccatacactaccccaggagcacccctgatatgtgggaagggctgattcagaaagctaaagacggaggcttggatgtcattcagacctatgtcttttggaacggacatgagcctacgcctggaaattactatttcgaggagaggtacgatttagtcaggttcataaagacggtccagaaggctggcctgtttgtacatctccgcatcggtccctacattttgtggcgagtggaacttcggcggcttcccangtttggttgaagtatgtaccgggcatcagcttcaggacagacaacgaacctttcagacggccatgcagggttncactgagaaaattgtggggatgatgaagagcgaaaacctctttgcatcccaagtgggcccattatcctctccagattgaagatgagtatgggcaaaagggcag

SEQ ID NO: 90880 - DNA, 976 bp, Zea mays
  misc_feature: Ceres CLONE 1578954
  misc_feature: Encodes the peptide sequence at SEQ ID NO. 90881
ctggagctccccgcggtggcggccgctctagaactagtggatcccccgggctgcaggaattcgtctcacccctagaaaaaaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctcctccatcgccaccaccgccgtcgcccaccagcacgccgtgccctccgccaccgtccagctccggcggcaagtgccccaagaacgcgctgaaactgggcgtgtgcgccaacgtgctgggcctcgtcaaggtgtccatcggcaaggtgcccaccgactcgtgctgcccgctgctggacggcctcgccgacctggaagccgccctctgcctctgcaccgcgctcaggggcaacgtgctcggaatcaacctcgacgtcccccgtaaggtcaacctgggtcctaactactgggggaaagagacgtcctcagggcttcccggtggccctaaaataaacaaggggcaagtcggtcccaacctcaagtggcaaggaaaattggggaatcctcccccttccccccaagtcccccacgtgatgggcggggcccccccacaatccgaaatgttcctttggggatgccctcccccccaaaaaaaaagggaaacaacggttcccaaaaaaccctttttaaagagggcgctaaaaaaaacggggtctcctccggggtgggggggaccccaggagggggttttgggggggcccctccccccccggagaaaaaaccccccgggaggggccccccccgcgggggggaaaaaacccccccctctttttctgggggggggcaccccccccaaaaagagggcgctctgg

SEQ ID NO: 90881 - protein, 268 aa, Zea mays
  misc_feature: Ceres CLONE 1578954
  misc_feature (63)..(150): Pfam Name: Tryp_alpha_amyl Pfam Description: Protease inhibitor/seed storage/LTP family
MASVTRFPAVALVLLLAASAFLASEVAACGGCPKPTPPPPSPPPPSPTSTPCPPPPSSSGGKCPKNALKLGVCANVLGLVKVSIGKVPTDSCCPLLDGLADLEAALCLCTALRGNVLGINLDVPRKVNLGPNYWGKETSSGLPGGPKINKGQVGPNLKWQGKLGNPPPSPQVPHVMGGAPPQSEMFLWGCPPPQKKRETTVPKKPFLKRALKKTGSPPGWGGPQEGVLGGPLPPRRKNPPGGAPPAGGKKPPPLFLGGGTPPKKRALW

SEQ ID NO: 90882 - DNA, 963 bp, Zea mays
  misc_feature: Ceres CLONE 1578958
  misc_feature: Encodes the peptide sequence at SEQ ID NO. 90883
  misc_feature (400)..(400): n is a, c, t, g, unknown, or other
ccccgcggtggcggccgctctagaactagtggatcccccgggctgcaggaattcgtctcacccctagaaaaccgcaaacccctctcgatcgacacacgcagccgcgacccatcgagacctgacccgatcctcccgaggccgccagccttatcctctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttgggagtacactcngaccgaaaggaaggaatgtcgttttggagagcaagtacggctctcccaagattgttaacgatgggcgttaccgttgcaagaagagttgagctggaagaccctgtggaaaaacattggagctaaattgggcaggcaagccgcacctaaaaccaacgattctggctggaaatgggacaccccctctgggggccctggcccaggggctgaattgctaagggtgttaaaggggggaaacaccgggggctaaacccgggtaaaattaccccgggggttgggaaaaacccctaagcccctttttgaaaaacccccggaattttcccaagggggggtaaaaaaaggggggcttcccaaattttgccgccattttgggggggggcccacctctaataattggtcacactttaccacaaggccccttacaggggggcgggggaaagggggggtttccccccctttgaaggggggaaaaatttcaaaaaatttctctcttggtggggagggagagaaatttttcgcgggtggtccttccctccccctttttttaaacagggggaaaaacccct

SEQ ID NO: 90883 - protein, 94 aa, Zea mays
  misc_feature: Ceres CLONE 1578958
  misc_feature (66)..(66): Xaa is any aa, unknown, or other
MASTFGATSTVGLMAAPTGKNVRLQRRANFRVKAAKELYFNKDGSAIKKLQTGVNKLADLVGSTLXPKGRNVVLESKYGSPKIVNDGRYRCKKS

SEQ ID NO: 90884 - DNA, 991 bp, Zea mays
  misc_feature: Ceres CLONE 1578960
  misc_feature: Encodes the peptide sequence at SEQ ID NO. 90885
  misc_feature (991)..(991): n is a, c, t, g, unknown, or other
ggcctttctagaactagtggatcccccgggcttttcgaattcgtctcacccctagaaaaaagctaggtgcttcggcttcctttctctcccaattggaggcacaccccgcaataaaaaaaaatgagaattcgatgcgacaaacaagctcaaatgcttggtcggtccttttgaaggttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtggggttctctggggtgcaggctgcgcttacagctgcaagcgcggcggtggcctgcggcggcgcccacacctccgcgccggtgagtctctgcgggtaccctgcggggcggatgttccacgtcttttggccgccgtcgaaccccgacccggtgcgctatccggggagcccggttggctcgtgcacgccgcttgggcctgcccccgggttcactgaaaactcttgcctgcacactcctgtatttttggaagggctttctttaaccccgattcaggggcccaaaggcatgatcttgggcccatctgggtccccttcccccttgtgtgttggggcgcccttttatcagtttctcccccgacgcttgttgtgcgccctcccctttttcgccacttgtattttgttgtgggaaacacctccttacacgcggttaccgtcccctgataccaacttgactgtttatgctttttgcgaaaactcccagtgaccttcttcaaatggacggcgcgttttgtccacgggtggcgttctttgtgggtgtaatcccccgggtggggttttaactgcctatgttgccattgagtgctgttagttctgaatccccccccccacacgccggcccatctctttaattgggtgagcgcggaacccgccggaattaagggtttaggtctttatttgtcaccgan

SEQ ID NO: 90885 - protein, 123 aa, Zea mays
  misc_feature: Ceres CLONE 1578960
MFHVFWPPSNPDPVRYPGSPVGSCTPLGPAPGFTENSCLHTPVFLEGLSLTPIQGPKGMILGPSGSPSPLCVGAPFYQFLPRRLLCALPFFATCILLWETPPYTRLPSPDTNLTVYAFCENSQ

SEQ ID NO: 90886 - DNA, 955 bp, Zea mays
  misc_feature: Ceres CLONE 1578965
  misc_feature: Encodes the peptide sequence at SEQ ID NO. 90887
  misc_feature (795)..(795): n is a, c, t, g, unknown, or other
  misc_feature (807)..(807): n is a, c, t, g, unknown, or other
  misc_feature (813)..(813): n is a, c, t, g, unknown, or other
  misc_feature (831)..(831): n is a, c, t, g, unknown, or other
  misc_feature (881)..(881): n is a, c, t, g, unknown, or other
  misc_feature (933)..(933): n is a, c, t, g, unknown, or other
  misc_feature (955)..(955): n is a, c, t, g, unknown, or other
tggagctccccgcggtggcggccgctctagaactagtggatcccccgggctgcaggaattcgtctcacccctagaaaaagtcagaaaaaaaaaaagaataagaagaaaggaatccctcctacgctgaagcgaagagattcgtcgcctcagccgcctctctgctcagatctgcggcggagcctcgccggcggcctgcgccccgcggcgccgccgatccaagatgcctgcggccgtgcagggatgctgctgctggtcgtccctgcgccttctcccccgcgacgacgcgctctcgtccccctccgcctgcgcgcaccgcctgaagccttggtcttggcgtgcccaatcccccacctcgtcctcctaacgcttgtccccgggccgctccccaccctgatctacatgtctctacccttccctcctccatttctacgtctccccgttgctgctctgctcctgctgccacaagagtattcgccttcaatcgttgctccggcgccggtcctttcgtgccgcacggcgacgttgttgccgcttttccctggccgccttctgtcgggatcgcgatgtgtctgggatcggattcccaaggtcgggatctacgctggctgcggggtcagcatccagtaaccgcaaacggggggttgtaccttcttgcgggcggttggctgtatgcactcctgcggtcttctgcaaagggctaaaccccgtcaccttttatgggacggtgggttccctgcggtgctcgaagggaacccccgccagtgacctgccaccaccccgcccgggcatcgcgcntcgcgccacaanaacacntgccccctggttgatcancgctgcgcgacccatgcgcgggcaccaccgccccgcaaggaaggccgggncccacctccgctgtgaccctccgacccgtgccgatttccttttgtcgcaatncctggaagaaccccgcaagccn

SEQ ID NO: 90887 - protein, 75 aa, Zea mays
  misc_feature: Ceres CLONE 1578965
MSLPFPPPFLRLPVAALLLLPQEYSPSIVAPAPVLSCRTATLLPLFPGRLLSGSRCVWDRIPKVGIYAGCGVSIQ

SEQ ID NO: 90888 - DNA, 889 bp, Zea mays
  misc_feature: Ceres CLONE 1578966
  misc_feature: Encodes the peptide sequence at SEQ ID NO. 90889
  misc_feature (582)..(582): n is a, c, t, g, unknown, or other
ctggagctccccgcggtggcggccgctctagaactagtggatcccccgggctgcaggaattcgtctcacccctagaaaaagcgcacaagcctttttccgagatcggcgaaacaaatcgctgtaaaacccagcctgctaatcgccccactaggaggagtaggaggactctccgaggtcctagcggggtaggcaggtgtccgaaacggatcaccaaaccccgccggcgcagccgagagatccgaagtcgccgcgatccatggccgcctcgacggcggcggcgcggcgtctcctcctcgccctcggcgtgctcgccgcctgcctcggctcggcgccgcactgggccgtcgcgctccgctcgctcggcgtcgggggcgccaaggcggccgaccgggacgccgccgtggacctcgacgcgtgcaacttcaccgccttcctccagacttcgccggagtcgttcgcggtcgtcgagttcttcgcacactggtgtcctgcctgcagaaactacaagcctcactatgagaagattgcaaaacttgttcatggcacagatgctgcacatccagcgactgttgcgataaaacnagttgattgtgcatcaaaggtgaacgtggatctttgcaactaatctcgtgttgaacgttgcccttacatggtgtgggggtgcggcaacaaaattcattttgggttcattggaaaccaaagccagggtaaaggcgattggaaactcatttgatgatggaacaaccggcaatccgctttcgggaatgggaaaaattaaaaaaaaggggaaactccctccatttttgaaaaaacaaaggtttacaaaataaaagtatgccccccaaaaaaaacccttcgttatcccggaaaagaattgggtcaaacccat

SEQ ID NO: 90889 - protein, 122 aa, Zea mays
  misc_feature: Ceres CLONE 1578966
  misc_feature: SWISSPROT Homolog: EC 5.3.4.1 Protein disulfide-isomerase
  misc_feature (109)..(109): Xaa is any aa, unknown, or other
MAASTAAARRLLLALGVLAACLGSAPHWAVALRSLGVGGAKAADRDAAVDLDACNFTAFLQTSPESFAVVEFFAHWCPACRNYKPHYEKIAKLVHGTDAAHPATVAIKXVDCASKVNVDLCN

SEQ ID NO: 90890 - DNA, 887 bp, Zea mays
  misc_feature: Ceres CLONE 1578967
  misc_feature: Encodes the peptide sequence at SEQ ID NO. 90891
  misc_feature (742)..(742): n is a, c, t, g, unknown, or other
  misc_feature (792)..(792): n is a, c, t, g, unknown, or other
  misc_feature (816)..(816): n is a, c, t, g, unknown, or other
ctggagctcaccgcggtggcggccgctctagaactagtggatcccccgggctgcaggaattcgtctcacccctagaaaaactccccctcttatctctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattccgtagaggtctcagccgctgtcgaggacgaggtggaggaggaggtcggggagtacgttgagccgcccgaggaggccaaggtctacgtcggaaacctgccctacgacgtcgacagcgagcgcctcgctcagctcttcgaccaggccggcgtcgtcgaggtcgcagaggtcatttacaacagagaaacagatcaaagtcgtgggtttgggtttgtcactatgagcactgtcgaagaagctgagaaggctgtggagatgttccatcgctatgatgtcaatggaaggcttctgactgtaataangcagctcctagaagctctcgtgtggacagacctccagacaatctgggccntctctcagaattatgttgcaaccntgcttggcaagtgaatgatctagattggtggagtggtcagcgagcatggaaagtagttgatgcagagtgtc

SEQ ID NO: 90891 - protein, 228 aa, Zea mays
  misc_feature: Ceres CLONE 1578967
  misc_feature (127)..(198): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (200)..(200): Xaa is any aa, unknown, or other
  misc_feature (217)..(217): Xaa is any aa, unknown, or other
  misc_feature (225)..(225): Xaa is any aa, unknown, or other
MASSVAVSLRALAAAPLPKSSPATSCPFFVLLAPALPRRLLRLRSARRLPLAPLAASDSAFESSVGVNYAEPDDSEKDKEVELFGSGDDEGAGELVDDHSVEVSAAVEDEVEEEVGEYVEPPEEAKVYVGNLPYDVDSERLAQLFDQAGVVEVAEVIYNRETDQSRGFGFVTMSTVEEAEKAVEMFHRYDVNGRLLTVIXQLLEALVWTDLQTIWAXSQNYVATXLGK

SEQ ID NO: 90892 - DNA, 937 bp, Zea mays
  misc_feature: Ceres CLONE 1578970
  misc_feature: Encodes the peptide sequence at SEQ ID NO. 90893
ggagctccccgcggtggcggccgctctagaactagtggatcccccgggctgcaggaattcgtctcacccctagaaaaagacagcatcactgccgtgtagtgtagctagagcccgtgcactggtccggattcgcagagcaaaacggaaatgatcacggtggcagcaccggaggcgcagccgcaggtggcggcggcggcggcggttgcggcgccggaggagaccgtgttccggtcgaagctgccggacatcgacatccccacccacctgccgctccacgactactgcttctcgagggcggcggaggcggcgggcgcgccgtgcctcatcgcggcggccacggggaggacctacacgtacgccgagacgcgcctcctgtgccgcaaggacgcggcgtgcctccaccggctcggcgtcgcccagggcgaccgcgtcatggtcctgctccagaactccgtcgagttcgtgctcgccttcttcggcgcgtccttcctcggcgccgtcaccacagccgccaacccgttctgcacgccgcaagagatccacaagcaattcagcgcctccggcgcgaaggtcgtcgtcacccactccgcctacatcgccaaactccggcacgaccgccttcccgaagatcggcgtgagaccggcattgcctcaccgtcctcaccatcgacggggaaccggccgacaccccagaaggctgcctgggcgttctgggaactgctccacgtccgggaatggaaacgccctcccggaaagtgtcatcttccccggaagaaccccggggcgcttgccgttccactcgggaaccacaggggctgccccaagggcagtctggctgaaccccggggcggctaagtcaccaaacggtgccccatcaggtggtacggaacaaacaccctacctggtaattcgggggaagggcgaagtcccccctcct

SEQ ID NO: 90893 - protein, 235 aa, Zea mays
  misc_feature: Ceres CLONE 1578970
  misc_feature: SWISSPROT Homolog: EC 6.2.1.12 4-coumarate--CoA ligase
MITVAAPEAQPQVAAAAAVAAPEETVFRSKLPDIDIPTHLPLHDYCFSRAAEAAGAPCLIAAATGRTYTYAETRLLCRKDAACLHRLGVAQGDRVMVLLQNSVEFVLAFFGASFLGAVTTAANPFCTPQEIHKQFSASGAKVVVTHSAYIAKLRHDRLPEDRRETGIASPSSPSTGNRPTPQKAAWAFWELLHVREWKRPPGKCHLPRKNPGALAVPLGNHRGCPKGSLAEPRGG

SEQ ID NO: 90894 - DNA, 908 bp, Zea mays
  misc_feature: Ceres CLONE 1578971
  misc_feature: Encodes the peptide sequence at SEQ ID NO. 90895
  misc_feature (205)..(205): n is a, c, t, g, unknown, or other
  misc_feature (216)..(216): n is a, c, t, g, unknown, or other
  misc_feature (217)..(217): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (791)..(791): n is a, c, t, g, unknown, or other
  misc_feature (792)..(792): n is a, c, t, g, unknown, or other
  misc_feature (801)..(801): n is a, c, t, g, unknown, or other
  misc_feature (802)..(802): n is a, c, t, g, unknown, or other
  misc_feature (809)..(809): n is a, c, t, g, unknown, or other
  misc_feature (908)..(908): n is a, c, t, g, unknown, or other
ggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttgngcgggaaccgnnagcgcgtccccggcgggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgttcaagaaccccaaggcgcccgtgttcccgcgcctggcgcagggcacgtcccacgacgagatgacggtgacgtggaccagcggctacgccatcgatgaggcgtacccgttcgtggagtgggcgcctgccgccgnnnnnnnnngnngggggggtnncccccgnaaaactgggcgggcgcccgcggggacgctcaccttcaccgcggcagcatgtgctgcgagccggccgcaccgttcggttgaaggtacccggggttcttcn

SEQ ID NO: 90895 - protein, 208 aa, Zea mays
  misc_feature: Ceres CLONE 1578971
  misc_feature (166)..(166): Xaa is any aa, unknown, or other
  misc_feature (167)..(167): Xaa is any aa, unknown, or other
  misc_feature (168)..(168): Xaa is any aa, unknown, or other
  misc_feature (169)..(169): Xaa is any aa, unknown, or other
  misc_feature (170)..(170): Xaa is any aa, unknown, or other
  misc_feature (173)..(173): Xaa is any aa, unknown, or other
MQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPKAPVFPRLAQGTSHDEMTVTWTSGYAIDEAYPFVEWAPAAXXXXXGGXPRKTGRAPAGTLTFTAAACAASRPHRSVEGTRGSS

SEQ ID NO: 90896 - DNA, 1311 bp, Zea mays
  misc_feature: Ceres CLONE 1578974
  misc_feature (56)..(56): n is a, c, t, g, unknown, or other
ccttctttggcgtctctcgccactggttctcttttggtttggccggcccgggccantttgctttttttctctaagctggagctccccgcggtggcggccgctctagaactagtggatcccccgggctgcaggaattcgtctcacccctagaaaaatccgcgcttgattagcggcagccactctctctctctcgcactcttggtgtccgagtcccttgggcgttagctctgcctcactcctcagtttctggcttgtcctgccgccgagccgcggagagcgagcttctcgagccggctgcagcggcgggcgtccccgggtgcggtatagacttctgctcatggtggaagcctccgcccggcggcggtctggcaccagccgtctgcggcctaactgcagcgggaggggagccacagcgcccgggtggcctctccgtcgccccttgcggtcgcatggttatgcccccggtttgtgggtcccccccctggtgggtccacctggcaacccgatacttttgggttaagggggggggtcccccctgggcggcccgaagtaccgaagatagggatgtaactttcgttcggaatgtctctcctccgggtttgtctttggcgcgggttatgggcccccccatggagcctatagggcctccggcccccctcggcggggtaacccgtccttccccgcaccctttttccctttttctgaggggtcttggtgggtcacatttggtttgttttaccccccccagcggcggttatttccctcgcgggggtttttacgcgaggtccctggagtcctgtgctcaaggtgggctctctccccaccacgttggttcccgtggatacaccccgtgtgggggcgaaacgtggggggccgcctctcttcgtgggtctcttctccgcccttacatcactctgtggtcccacccctattgtgtgcgtagcggcgctctcttgtatggcgggggcctgagagcaagcacccccttcatcccccccttacatatgcttctctgtttcgcacgaaaataattctcgcgtgattctcttctcaaatccacgaatcaacgctatgccttttgtgtgggacgaccccccccctcctcccgtgtgtgtgcgttgcgctctctcttgtgcatccctttttgctgtctcgccctccacctacgcaataataaaaactctcgtcgtcgcctcgcagtgtttcttctatgccgcttgttttgtgtgtgtgctcgcctattattcgcgtcgtttatcatcctcctcggccccggctttgttgccccttctacagtcggtggatgctctg

SEQ ID NO: 90897 - DNA, 985 bp, Zea mays
  misc_feature: Ceres CLONE 1578975
tcaccgcggtggcggccgctctagaactagtggatcccccgggctgcaggaattcgtctcacccctagaaaaaaccagtatcagtaccagtccaagccccactccccaccccggcccgaacctcgcaagtattttagtcttacttcattcgagccctaccactaccagtggcaggcgagcgagaggcggttgaggaggagcggacggaaccgtcgcctgctgcgtctgcctgcgagatctaggcgagcgcggccatgggtgctcgctgctccaaggttcttctggtctgctgggggctccccactttaaatcgccaatggtcaaaaagggcccccccggaaaaatggcaaccgctccccgggtgttcgccaaataaactttaaaaaacttctccccgcccacccaaaggttttcccccgaaaaatattgggggtgggaaaccctgggaaaaaggccccccactttgtgttttttcggggggaacactttttttaattcttgggcgcgatcgggtcccctttttaagagaccttttgccccgacccccctcttggtggggggaacttccccacggtttttcttttttaagaaaataactagaggtctctttttgggggccccctcccttttttttggttcctgtgcgtcgccccacatattggtaaatggtggtgtcgtcggcagctaaaaaaaataaaggtttgaaaaaatctccccttttttggtgcaatatttttttgtggccccgcacaaatagctccctggggaaaggaaaaagccctcctcccctgggggtgaggaaaaaaaaaccacctcttacattgtggggtccatatgggttaagatggggcgccccctctcttttttttctgcccaccccctctggggatacccctccttcctttttttgagaggggggggggggtctctttagttagcgttcgcgtcgctcaatgaaaggtggggtctttcttacgagaatggg

SEQ ID NO: 90898 - DNA, 828 bp, Zea mays
  misc_feature: Ceres CLONE 1578979
  misc_feature: Encodes the peptide sequence at SEQ ID NO. 90899
  misc_feature (490)..(490): n is a, c, t, g, unknown, or other
ctccccgcggtggcggccgctctagaactagtggatcccccgggctgcaggaattcgtctcacccctagaaaaagctgcctctcgcctcgcggcctccgcttcttcctcctcccgctgctgctcctgtttttgtttttgtcgatttttgtcgctggagcgtggatttttcgaggaatatttcgggattttggggctatttttcggggacttttttttttggggagggaggattttcgttattttttttgggaggcgccgcccgtaactaaacgagggagatggggagagcgtgcgtgagctccaatggcgactgctcgtgtcgggtggcttattaggaccactaccagcaggcgggcgcatgcggggtgctgcttgcatggacgcctagccacgggaatccagtgttgggcatgcgcctgcgcctatggcggcggcagcaccggttattggcgggcgcaaccactagaggagactgtgagcttccagcantccactgccagtcccgggcgcagactgcggataggggcaactctagctccgtcctggtgccgcctcttgctacggcgagcggacgcggctctatggccctcgttgccgtgcttataaatgtgccaaataaacgagggagcccgcgcaggtacgggccggacgggagcctgatcctcccgctcattggcaccgcgatctttgtgttccggtcccttgtcggccgccttggcggcctggttcttccccccggcctccccggggggcccccccataatggttggcaggggaacggccactttacttctccccccccgccccccatttgcccaggttttttt

SEQ ID NO: 90899 - protein, 139 aa, Zea mays
  misc_feature: Ceres CLONE 1578979
  misc_feature (27)..(27): Xaa is any aa, unknown, or other
MRLRLWRRQHRLLAGATTRGDCELPAXHCQSRAQTADRGNSSSVLVPPLATASGRGSMALVAVLINVPNKRGSPRRYGPDGSLILPLIGTAIFVFRSLVGRLGGLVLPPGLPGGPPHNGWQGNGHFTSPPPPPICPGFF

SEQ ID NO: 90900 - DNA, 1115 bp, Zea mays
  misc_feature: Ceres CLONE 1578981
  misc_feature (251)..(251): n is a, c, t, g, unknown, or other
  misc_feature (824)..(824): n is a, c, t, g, unknown, or other
tggagctccccgcggtggcggccgctctagaactagtggatcccccgggctgcaggaattcgtctcacccctagaaaaaattttgttccgtcgcttcaacggcacggaagagaatcgctacccagccaatcgaagtcttctcttgccctgctttatctcatatcctgttgcgcgagattcttggcgattctgctactgatttttatttttattttgctagttcttgaaatttcttgcacgagtgtcagtanccaactgctgataacaacatcctatcgttcctgtagcccctttccgtgaccttgccaaagaatttgctcttctctgtgcgtgtgccattttcttccgctacagctcaaggatccgctactctgctgtttttggaaaatcgccatccccccccctgggccgttaaccaccacttcccgggggggcagggaccccgttgctcccccacgaagcgggattggggacggggaccaagaacaacccagggtgcccccccgtttccacgaagttcgacggggcccctcctttccccgggcgggggtgttttaaccctcttccccccccccttttgttgggggcgcggggcttcaatggggcgctctccggggggcccccaatgaaagggggtgctcccggttccctctcccccccctgggggcctccggctactaggaataggtggtgtgttgcgccgcggtcgctctccctctcataggagagcgccctctcccatattaaaaccgtggttcccctggggcggggtattaaaaccccgggaggcgctcgggggcgcccctctccccttcccggagaanaccccggggtaccttgtggcccaaaaaccccctttgtgtaaatatagtggcggtgatagaaagaagcgccccctccccaagttcttgtcgctccggctccattatcaacaaatctcggcgctgtacagattgtatggttttccccttactctcttctgtgcgcggcggtgtgggtttttttacgggatcacactctcgtgcggggtgagtgacataccccctctggcggtgttattatacacaagtgttgttgacgcacataccacgtgggacaatagaggggtgcctttt

SEQ ID NO: 90901 - DNA, 943 bp, Zea mays
  misc_feature: Ceres CLONE 1578984
  misc_feature: Encodes the peptide sequence at SEQ ID NO. 90902
aaactggagctctttgcggaggtggccgcgtcagaatagtggatcccccgggctgctttcattcgtctgacccctagaaaaaagacacacaacacacaatcccctgcaactgtaagtcgtcttcttccccaagcctaaaaccaacaacagtttggcagatcgcccggctcgatcgatcgcagccatggtgctctccaaggccgtctccgagagtgacatgtccgtgcactccacgttcgcgtcgcgctacgtccgctcgtctctcccaaggtaccgcatgccggagaactccatccccaaggaggcggcgtaccagatcatcaacgacgagctcatgctcgacgggaacccgcgcctcaacctggcgtccttcgtcaccacctggatggagcccgagtgcgacaagctcatcatggccgccatcaacaagaactacgtcgacatggacgagtaccccgtcaccaccgagctccagaaccggtgcgtgaacatgatcgcgcatctcttcaacgcgccgttgggcgagtcccagacggcggtgggcgtcggcacggtggggctcgcggaggccatcatgcttgccgggctggggcttaagcgccagtgggcagaacaagcgcagggccgagggcaagcccgttcgacaagcccaactttgttaccggggcccaaggccaggtaccaacagttccgtttcatttgggcccccatatccaaaagggttgggtacgaaatttcggctctaaaccattcgggcgcggacggcccttttaagtccctgccggtgttccggggagaatatcccgggggtccttcaaggtgggaacccgggaggggaaaaccgccggagggttatccaccgatggacccccaaaaaaacgtgggtgatggggggaaataaaacacatgaggggcgccagttttggggagctccgtacagagg

SEQ ID NO: 90902 - protein, 238 aa, Zea mays
  misc_feature: Ceres CLONE 1578984
  misc_feature (33)..(238): Pfam Name: Pyridoxal_deC Pfam Description: Pyridoxal-dependent decarboxylase conserved domain
  misc_feature: SWISSPROT Homolog: EC 4.1.1.15 Glutamate decarboxylase
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESQTAVGVGTVGLAEAIMLAGLGLKRQWAEQAQGRGQARSTSPTLLPGPKARYQQFRFIWAPISKRVGYEISALNHSGADGPFKSLPVFRGEYPGGPSRWEPGRGKPPEGYPPMDPQKNVGDGGK

SEQ ID NO: 90903 - DNA, 890 bp, Zea mays
  misc_feature: Ceres CLONE 1578985
  misc_feature: Translation starting site: 202
  misc_feature: SWISSPROT Homolog: EC 1.4.1.2 Glutamate dehydrogenase
aaagctggagctccccgcggtggcggccgctctagaactagtggatcccccgggctgcaggaattcgtctcacccctagaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagagtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcctaccttggttccaccatcaagaacgcagtggtgactgtgccggcctacttcaacgactcgcagaggcaggccaccaaggacgccggtgtcattgcgggcctcaatgtgatgcgtatcatcaacgtagccactgctgctgctattgcctacggtcttgacaagaaggcaccagctcccgaggagaaaaacggctcatcttcaacctgggtggtggcaacggttgaagtgtcgcttctccccatcgaggaaggcgatctccaggtggagggccctggcgggca

SEQ ID NO: 90904 - DNA, 983 bp, Zea mays
  misc_feature: Ceres CLONE 1578986
  misc_feature: Encodes the peptide sequence at SEQ ID NO. 90905
ggagctccccgcggtggcggccgctctagaactagtggatcccccgggctgcaggaattcgtctcacccctagaaaaaattcttctagaacctacccagctctcggggaccttctctcccagcccgagatccctccccaccgagatcccgcgccgccatggtgtcgtgacggcggcggaggcggcgtcatggagcgggagcccaagtcccccgacgaccgccctgagcccgctgcggcggcggcgcagccgcagccgctggagtggcggtttgcgcaggtcttcggcgagcgcgccgcgggagaagatgtgcaagatgtggacataatctctgcaattgagtttgacaaatctgggaatcatcttgctactggagatagaggtggacgtgtggttttgttcgaaagaacagacattgctgataatgcttgtcgaagagaacttgagaggcaagaatatcttgtttctaggcatcctgagttccgttacaagaccgaatttcagagtcatgaacctgagtttgactacctaaaaagtttggaaatagaagagaagattaacaagatcaagtggtgccaaacaaccaacaatgcactctttctcttgtctacaaatgacaaaacaatcaagtattggaaggttcaagagaaaaaggtgaaacgggtttcagtgatgaatttggacacctcccatagttcagacaatggttcaacttcagtgccgggtaccagtagttgcagagctcttcttccaaatggtggatgcacaggaaaaaatgtcagtccaaaccacaatatgtcatttccctccaggagatgcacatcgctgcgttgtgcctgtgggggttacaggcaaggaatttactcatgttgcggagagcaaacgtgtttatgcccatgcccatgactaccattattattcccattcaaaatatggcgatgggaaaacgtcctttccagcagatgactcgcgaataacctcttg

SEQ ID NO: 90905 - protein, 238 aa, Zea mays
  misc_feature: Ceres CLONE 1578986
MEREPKSPDDRPEPAAAAAQPQPLEWRFAQVFGERAAGEDVQDVDIISAIEFDKSGNHLATGDRGGRVVLFERTDIADNACRRELERQEYLVSRHPEFRYKTEFQSHEPEFDYLKSLEIEEKINKIKWCQTTNNALFLLSTNDKTIKYWKVQEKKVKRVSVMNLDTSHSSDNGSTSVPGTSSCRALLPNGGCTGKNVSPNHNMSFPSRRCTSLRCACGGYRQGIYSCCGEQTCLCPCP

SEQ ID NO: 90906 - DNA, 941 bp, Zea mays
  misc_feature: Ceres CLONE 1578987
  misc_feature: Translation starting site: 476
  misc_feature: SWISSPROT Homolog: EC 2.1.1.103 Phosphoethanolamine N-methyltransferase
  misc_feature (701)..(701): n is a, c, t, g, unknown, or other
  misc_feature (755)..(755): n is a, c, t, g, unknown, or other
  misc_feature (861)..(861): n is a, c, t, g, unknown, or other
  misc_feature (886)..(886): n is a, c, t, g, unknown, or other
ctggagctccccgcggtggcggccgctctagaactagtggatcccccgggctgcaggaattcgtctcacccctagaaaaaaccgctctttcccgttcatccatcacaccatccccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtggctgaatangacgctttactggagatctggcaaagaagctgggcacgttctggctctagactncattgaaagtgtgattagaggacccaaagctaatgggcatcacaagaccataaccctcagtgtgctgatgtgacatcttacgacttgaagatgaagattactcggntgatctgaattttcaaactgctatnaatgtactttccgatgagaagtcaaaagctggggggaaatggtaaatgggctagg

SEQ ID NO: 90907 - DNA, 905 bp, Zea mays
  misc_feature: Ceres CLONE 1578988
  misc_feature: Encodes the peptide sequence at SEQ ID NO. 90908
  misc_feature (762)..(762): n is a, c, t, g, unknown, or other
  misc_feature (826)..(826): n is a, c, t, g, unknown, or other
ctccccgcggtggcggccgctctagaactagtggatcccccgggctgcaggaattcgtctcacccctagaaaaaatgcaacgccttccacacttgaagcagccaagctaagtgaggtgagcttagccatgccgacggcttcctctgcccaccgctcactcctcctctgcctctgcctggctctgctctccaacccggtcgccgcctcgccctcgccccgcggcctccgcttctccgccaaggacatcgcggcggtggaggccgcgctgccgcgacacggcagcagggcgtcgtcgtcgtccaagaccaccttcttcgaggtcgaccgcccgctccgcccgcccaggggcagctcggggccctgctccacgctgctgctctcgcactccttcgcgttcacgctcaccaagccgcccgtcaccgcggcctactcgccgccgccgtgcctgtccggctccgacgcgccgccggtctcgctcgccgtgctcgagtggcgcgccgagtgccgcggcgcgcagtacgaccgcaccttcggcgtgtggctcggcggcgccgagctcctgcgcggcagcaccgcggagccgcgccccggcggggtggtctggtcggtctccaatgacgtcacccgctacgcggccctcctcgcggccggcaacgccacgctcgctgtctacctcggcaacctcatcgacgacacctacgacggcgtctaccacgccaacctcacgctccacctctacttttcgcgcagcgtgcagccgtncgccagcgccgccgccgacgatgccgtcgtcccggtctccagaagctgccgctcaacgacgganctgtgggtcgtcgtcagaaacaccacgacgtgcagtccgcgcgcgtgtcggtgcgcgcaacgcgtacgccgccgtcctg

SEQ ID NO: 90908 - protein, 259 aa, Zea mays
  misc_feature: Ceres CLONE 1578988
  misc_feature: SWISSPROT Homolog: EC 3.5.1.52 Peptide-N(4)-(N-acetyl-beta-glucosaminyl)asparagine amidase
  misc_feature (212)..(212): Xaa is any aa, unknown, or other
  misc_feature (233)..(233): Xaa is any aa, unknown, or other
MPTASSAHRSLLLCLCLALLSNPVAASPSPRGLRFSAKDIAAVEAALPRHGSRASSSSKTTFFEVDRPLRPPRGSSGPCSTLLLSHSFAFTLTKPPVTAAYSPPPCLSGSDAPPVSLAVLEWRAECRGAQYDRTFGVWLGGAELLRGSTAEPRPGGVVWSVSNDVTRYAALLAAGNATLAVYLGNLIDDTYDGVYHANLTLHLYFSRSVQPXASAAADDAVVPVSRSCRSTTXLWVVVRNTTTCSPRACRCAQRVRRRP

SEQ ID NO: 90909 - DNA, 932 bp, Zea mays
  misc_feature: Ceres CLONE 1578990
  misc_feature: Encodes the peptide sequence at SEQ ID NO. 90910
  misc_feature (828)..(828): n is a, c, t, g, unknown, or other
ctggagctccccgcggtggcggccgctctagaactagtggatcccccgggctgcaggaattcgtctcacccctagaaaaagccccaccctccttcctcagctccgttgcgcaccgccaccgccggccggccagccgccggagcaccgaaagacccccgttctttcctgtaaaaaaaaacccgccgcctttagctagctaaccggtcgtcctcttcaccccctagctttgctagctctagctaggaacgaaagaaattaaaggataactgagattgctgattggtggtccgggtacggtgttcttgagtcgtgaagcgacagtacagtggctagggtcgtgccgcccctgcagtctccggggttgcgtgcaggatggtcgtcagggatcgggagtgaggaggcatcagctctcgcggtcgtggagcctaaatgtaccgcaacaacgactcggcactctcctgcttctacctcttcctcctctggttcttcttcttgaagtagacaccaccagttcgccaggtagttagcagcccagttgcgactggggatcggtggcgggctgccgcttgcgagttgtaagctttggagggaggggagcaggagcaggagatgcagctgggtctgaacgtggccgaggcgccgccgccggtggagattgaggcgagcgactcggggtcgtccgtgctgaacgcgtcggaagctgcgtcggcggggcggcgccccgcgccggcggaggaggatctagctcaacgccggccgtgctggaatttaacatcctcttccgaaccatatcgaccggccgggcgcgaaaaaggacaggacaccatnccattggctccttcttggcaacggcacaaggaaaagcggagactcgggaccccggaagtttttccggccgggcccgggtcctcgggcccgtacacccgggtttg

SEQ ID NO: 90910 - protein, 107 aa, Zea mays
  misc_feature: Ceres CLONE 1578990
  misc_feature (73)..(73): Xaa is any aa, unknown, or other
MQLGLNVAEAPPPVEIEASDSGSSVLNASEAASAGRRPAPAEEDLAQRRPCWNLTSSSEPYRPAGREKGQDTXPLAPSWQRHKEKRRLGTPEVFPAGPGSSGPYTRV

SEQ ID NO: 90911 - DNA, 911 bp, Zea mays
  misc_feature: Ceres CLONE 1578991
  misc_feature: Encodes the peptide sequence at SEQ ID NO. 90912
  misc_feature (404)..(404): n is a, c, t, g, unknown, or other
  misc_feature (911)..(911): n is a, c, t, g, unknown, or other
tggagctcaccgcggtggcggccgctctagaactagtggatcccccgggctgcaggaattcgtctcacccctagaaaaagaccgggcggcctcctccccgaaccctagcccccctacaaccaccgcgtcctgcctcctctgggcggctccgccccagatccagcacagcaggttaaaaagggggcgggcaggcgttggatggacgggccgaagcggtcgcagctgcgggtgcgcctccgcgtcacggcgcgccggcgtggtgccgatggcgacggcgccgggggcgctgccgggcctggggggcgtaagcgccggatggaggcccccgtccgcaactccgtcgccaagctgcagcgccgcgagatcgggggccgccagctcgccgcgtcgcggtttccaccccnccgccgccgtgcccgagcgcttccggaacatgcagctccaggaggagttcgatacatatgatgaaaatgctcacctctttgtgaagctgcagtttcttaaaagaagatcccaaatgatttgagattgttgcagcaaaggatatcatatttgcgccttgctaattctgggcttttgtgccgcttttggaccgagtgacaaacaaggcccatagcccttcttgaatttgagcccagatgaaaggattcgcgatctggtttttacacaagaacaatgaattctcccattacgggtttcaggttcaggccggttggacaaattcgggacagttaaattgcgtaaaaaccgcccatttgattatcccagaacggaatccggtttaatggaagggtttcccccccctctaatacatatgccctcaaaatggcctggaattgaggaaagttgcaccaagggaaaatggaaaaaatctcacaaattccacgcgcggaaggcgatatttatgggtn

SEQ ID NO: 90912 - protein, 88 aa, Zea mays
  misc_feature: Ceres CLONE 1578991
  misc_feature (69)..(69): Xaa is any aa, unknown, or other
MDGPKRSQLRVRLRVTARRRGADGDGAGGAAGPGGRKRRMEAPVRNSVAKLQRREIGGRQLAASRFPPXRRRARALPEHAAPGGVRYI

SEQ ID NO: 90913 - DNA, 922 bp, Zea mays
  misc_feature: Ceres CLONE 1578995
  misc_feature: Encodes the peptide sequence at SEQ ID NO. 90914
  misc_feature (229)..(229): n is a, c, t, g, unknown, or other
ggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcgaggaccgcgagcgcgtccccgncggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgttcaagaaccccaaggcgcccgtgttcccgcgcctggcgcatggcacgtcccacgacgagatgacggtgacgtggaccagcggctacgccatcgatgaagcgtacccgttcgtggagtgggcgcctgtcccctggttttttgtgggggtgggtttttccccggattaccgtgtcgtggcccccccctgggacgcctcaccttcaactgcggtaaccatgtgctggcgaatccggctctccaccctccccggtgggaaggaaccccggggttccctct

SEQ ID NO: 90914 - protein, 257 aa, Zea mays
  misc_feature: Ceres CLONE 1578995
  misc_feature (27)..(27): Xaa is any aa, unknown, or other
MAVALLAALVASAAMFMLARTASASPXEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPKAPVFPRLAHGTSHDEMTVTWTSGYAIDEAYPFVEWAPVPWFFVGVGFSPDYRVVAPPWDASPSTAVTMCWRIRLSTLPGGKEPRGSL

SEQ ID NO: 90915 - DNA, 1069 bp, Zea mays
  misc_feature: Ceres CLONE 1579000
tccccgcggtggcggccgctctagaactagtggatcccccgggctgcaggaattcgtctcacccctagaaaaaacccgcgatctccgcgaccgcaagcagctcggcaggcaggcctccaccgctccaccacctccactcggtctacgtgctccgtcaccaaacccacccgggccaacgccgaagcaaccccccctccgtcctccccagatccggcgccgcctccgccctcacttacactagcacgcacgggggacacgtcgcctcccccgcgcgatctgatgcaggcgcacgcggtggccagcggcgatgcggtggaagctttaactcctccgtctacaagcgcgtgccgtccagggaaaccgccatggaaaccgtactcgagacgccaattgagaaaaacggacggcggccggcaccgggggggggggccgtcttgggcccattgtcgtttcccgcatggtctgttgtccccacgctttcacttcgtttcctcttttggaataccactttcccgggggtgggtgggaaacaaacccccttgggagggtcattcctcccgccgaaaccttgggcttttccccggggaaaaaactcttttgcttgaaaggggcctccggggggagaagtaatctctggtttcgggggaagggaagactttttttgttgtgggggtgggcctctttttaaggcggggtttcccctctgcccaaaaatggggtattttggggtgcgaaacacccccttggcgtttctcccaacttccatgtggcgccctgccctctaaataattaatattgggggcgtttccactaaaaaggcgcctctccccccaaaatattctttggagaggagtatggccccccttgaaaaaaatttcttggcgtgagaaacacgggaattgggattgtggggttcccccattaacctttctcctttatatttaacgcgggggtttccccctctctaaaggggaggggaccttattgggtgccgtctgtgtctatttgcaacccgcccccggaaatatatgtaaccacccctggtgggacaccccgtcaagaattttgg

SEQ ID NO: 90916 - DNA, 1017 bp, Zea mays
  misc_feature: Ceres CLONE 1579002
  misc_feature: Encodes the peptide sequence at SEQ ID NO. 90917
ctccccgcggtggcggccgctctagaactagtggatcccccgggctgcaggaattcgtctcacccctagaaaaaattttctcctcttcccagccatggccccgcgggcaggctccctggtgctgctcgtccgtggtctggaagcttcgattggtgggcgccatcgtctcctacctccgtctgaaacaccacatcgagctcccatcgtcgcgcccctccttgctcctctgctggccgtcgctgctccctggtgctcggactcgccagtcatcgccccagccgagatccctcctcagtatcgctcgcccaatccgaggggcactggacatgttttgggacatgggaggttcaggcagcgatggggttcgtttaaatttgatcacgtgatgcggaggacaagacccgagttgatctcaaaaatgatgttgggggaccgaacctaaggctaaatgatcctgattgaagtgccagaatggggagatgcttcccaaagtggtccgcccatctaacaacacttaactagtggttattccaccggttgaaaattttggttcctggtgggggatgggtgccaaacgggcccggtgggggctccgcccttcctttttttttaacaggggtggaatgaacccaaaaatttttaaaaatggtccaatgtatgggggggaatttaaaaccttttttccctttggggttcccaaaggtgaaaaccaaacccctaaggatggggcacttttcttctcccccaaaacggaaagttcccccgctggaatttttttccaaccgggtttggggaaaaaatgatatcacacccccccatatattcccctttggggaacccgacgggaacccccgacctttcaaaaaaggagttttagataaatcccggcctggcggcgtgcttatacggtgatgtggggcccatccccttgagggaattgccccaaagacccaaaaaaccccaccgcccgtgcctttttgggaatgtctcccaataaaaggggctctttcctgaacc

SEQ ID NO: 90917 - protein, 115 aa, Zea mays
  misc_feature: Ceres CLONE 1579002
MAPRAGSLVLLVRGLEASIGGRHRLLPPSETPHRAPIVAPLLAPLLAVAAPWCSDSPVIAPAEIPPQYRSPNPRGTGHVLGHGRFRQRWGSFKFDHVMRRTRPELISKMMLGDRT

SEQ ID NO: 90918 - DNA, 1333 bp, Zea mays
  misc_feature: Ceres CLONE 1579004
  misc_feature (41)..(41): n is a, c, t, g, unknown, or other
  misc_feature (45)..(45): n is a, c, t, g, unknown, or other
  misc_feature (69)..(69): n is a, c, t, g, unknown, or other
  misc_feature (1004)..(1004): n is a, c, t, g, unknown, or other
  misc_feature (1262)..(1262): n is a, c, t, g, unknown, or other
  misc_feature (1278)..(1278): n is a, c, t, g, unknown, or other
ttttctgtgtgcctcttgttttcgttctccgtcttctcctntttnttctttttttcgcttttctctttnttggagctccccgcggtggcggccgctctagaactagtggatcccccgggctgcaggaattcgtctcacccctagaaaaaacctgcccgacttccgactagccagtccatccggcagcgagcataggtctgagatgggttccgtagacgctgcgatctcggtgccggcgcccgcggcggaagagaatgctgtggaggagaatgccatggtgttccggtccaagcttcccgacatcgtgatcgacagaaaaatggtttcttcacacttactgccttcgggaaaatgggccatgggcgctgagcaagcgtgtcttattaacggggctgatgggcgccgtcatacacgttcgcgggtatgcgaagtccccgtccccggtgcggcgcgttttgggcttcccccccttggggtccccccaaggggcgaccttgttgattgagtctggctcccctaaccggcccccgagtttttccttttcccttccctggggggccccccctgcgttggggggctcatcttacctctccgtggtcataccccggtgtttgataccccctcctacgaaggttcccacccttccttggcggtaagggtgggcccggtccctccgagcgctccaccgcgtggaacttggggttccctgccgcccctttcgtaataaaagtggctgcgggtgtgtgtcctcccgggcggaaaacttaggtgggctttctctccgtggttttctcccccttcacacacgggtggttctcttcgtgtgtatttttactcccgcgttgtcatgccccctcaagtcctttatttttgggttcccaataagtgattctggggagacgttcctatattgttcggttcactttgcgcgccccctgattgtcgaactggtggaattggtgctttgggatctgcttacctcctcttgccggggggacaccacnccacacggctgtttgtgcccttgggacgcgagtcgactgcactgtgtttttcctccgagagtaatcctctccgccgtccacgaggagttctctttctcctttgcttatgtgcttcctcgagtgtgttatatacactatcgatacaccggttttatctcgcggttgtacgtggtgctctcttttacgtgctcagtctgcgcctcgcctgtgtaccgtgtttttttctacccgtgtattgtctcacgtatagaagactcngtccctgatatcggtnataacaccacgtgtgcggtgtgacttcacatccttatttagggcctcaatgtatc

SEQ ID NO: 90919 - DNA, 1058 bp, Zea mays
  misc_feature: Ceres CLONE 1579008
  misc_feature: Encodes the peptide sequence at SEQ ID NO. 90920
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (28)..(28): n is a, c, t, g, unknown, or other
  misc_feature (29)..(29): n is a, c, t, g, unknown, or other
  misc_feature (36)..(36): n is a, c, t, g, unknown, or other
  misc_feature (42)..(42): n is a, c, t, g, unknown, or other
  misc_feature (54)..(54): n is a, c, t, g, unknown, or other
  misc_feature (55)..(55): n is a, c, t, g, unknown, or other
  misc_feature (69)..(69): n is a, c, t, g, unknown, or other
ccacgaggaccnnnaagttcccagccanncgggccncttccnccccttttgtgnnttggggggggttgntcaaaactggaactccccgcggtggcggccgcttcacaacagtggatcccccgggctgctcccaatcgtggcacccctagaaaaaagcaaaagctgctcatcaccgatggcctcggctaacacaagcaagcaagcaagtcactgagtagctagcagtatataccaccataaaaacaacacacacacacgtgcgctaataagctaagcttaaggtagctcctctctatctccgtctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgccccccacaaagaacgacggagcggcggcggtggcggccagggaccccgacaagccccttgagcctgctggccgtcgccgcccattgaagctccccatcatcggggcacccggcacccggaagggggggaacagccccttaacgtggtcccctcgaccggggttttggccaccccagggtaacgggcccccgggaaccgggaaaggcggtggtcacggccccttgggcgggcacggtggcaccagaaaccggtgggggggggccccccggatagccccggccccgttcagcccccaaaggggccggggggctcgcgcaaaccctatgggagacggaagatgtttgtgttacatatccgggggatgaggagcgcacctggggggggggcgcaaatgtaatacaacggtaacgggggggcgacccccaacacacgggggtctctcccggcccccgattgggggggcaacacatcccgccgagaaggggggtgggaaaacaccggcggtacccggaggggacacgcgggtctgatacgccgacgaagaggaggcggaggcgcaatgtagcgctgcaaagggagagaaa

SEQ ID NO: 90920 - protein, 170 aa, Zea mays
  misc_feature: Ceres CLONE 1579008
MAAQLHHALYELLHEAAAAQRALLLAIPFSLLLLPLLLRYLAASASASAPPTKNDGAAAVAARDPDKPLEPAGRRRPLKLPIIGAPGTRKGGNSPLTWSPRPGFWPPQGNGPPGTGKGGGHGPLGGHGGTRNRWGGAPRIAPAPFSPQRGRGARANPMGDGRCLCYISGG

SEQ ID NO: 90921 - DNA, 1332 bp, Zea mays
  misc_feature: Ceres CLONE 1579009
  misc_feature (62)..(62): n is a, c, t, g, unknown, or other
cttccgcgggccttctgtgttggggtggcattagcacttctatttaaaacatatatgtgtgntttaaagctggactccccgcggtggcggccgctctagaactagtggatcccccgggctgcaggaattcgtctcacccctagaaaaaagcacaagctgctcatcaccgatggacacggctaacacaagcaagcaagcaagtgcctgagtagctagcagtattataccaccataaaaacaacacacacacacggtgcgctaataagctaagcttaaggtagctcctctctatctccgtctagctcggacggacgactttgccatggcttctcaactgcatcacgcactatacgatctgttgcaccaaccagcagctgcgcaggcgtgtgccgctgcccgctacccccttctccctgctgcttctgcagttcctgttccgcttacctcggggagaccccgtaggcgttggcccccggtataaaaaacaaccgacctgctgtggtggcggccaccaaccccgaaaagctctagaccctggggttctaaggcgaccatggaaggcttccgatacaccgggttccttgcaccttgtatgggggaacattttccttaattccaccccccgtcggtcggctcccccacctagggtgacgggcctcaagacgtatatgaccttgttgctgaaattcgcttctcccccttttctttaatgtcgcggcgggttacattagttgacccgctaggtgttaagtgagttaagggtacatgggacttgcccacatgcggttaaacggaaccatacggcccggtttctcttcgtcattgtcggatatcaccgcacgggaataatatatgatataccggtcccccatagtgtatattccccaccccgctagttaaaccgagaagatggtagaatctcgcaatatctcgcgtacgtgcagaactatattactcactacagagagagtggagacgaaataccccactcagaacaaacgagtagtcgctagaaatatgctcgtggagccaccatatgtgagataaccatgtaacaatcaaatcaggcacaaatcacaacgcgtatgcccgcgccctctattacggcggcctccactcatgctgatagcctgagaatttattggtcgcaaacaagtaatatcttagcatcacactggtgagaatatttgtattatacccaacaagcgcgggtagacatagtgctcgtggagcgctcgcgtgttgttgttccccagtgctataggtcagtgtacgtcacgaacaaattagatgtgctattaaaacataatgtacataagcctacaagcgccg

SEQ ID NO: 90922 - DNA, 990 bp, Zea mays
  misc_feature: Ceres CLONE 1579011
  misc_feature: Encodes the peptide sequence at SEQ ID NO. 90923
ggagctccccgcggtggcggccgctctagaactagtggatcccccgggctgcaggaattcgtctcacccctagaaaaaaacctttttccccttcacagccccgtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaccacggatctgctgcagaagttgtcgctggattcgcagcccaaggcggcgggtgcgacagagcctgctgctgctgccgctgccgccaaggaaggtgctggtgacaaaccaggcggctgagtgtggccatcccggcagaccggtctatcacgccgggcctcaagaacttaagggatcccaaccgggttcttcttcccacggtattactttgggaggctaccaacagttcctggaacgagggggaatgatttccccaaatttccaaattccaaatgggggggagaattggcccccccaagggttggggaaatttttggggaatgggggtatgcccccttaaggggggataattttccgggccctttctccagtttccacaggtttaaagggcaaaatatttgggcccaccacttttcccgttttccacccgcgtgtttttcccccccaccaccaaattcttcttcaccctaaagaaaaccccccggttttctcaaattcgataaaaagcccccgcataaagaatccccc

SEQ ID NO: 90923 - protein, 75 aa, Zea mays
  misc_feature: Ceres CLONE 1579011
MAAVATPPAPAPAAPAPAPAPAAAPAPVTVAPAADQTTDLLQKLSLDSQPKAAGATEPAAAAAAAKEGAGDKPGG

SEQ ID NO: 90924 - DNA, 982 bp, Zea mays
  misc_feature: Ceres CLONE 1579012
  misc_feature: Encodes the peptide sequence at SEQ ID NO. 90925
ctccccgcggtggcggccgctctagaactagtggatcccccgggctgcaggaattcgtctcacccctagaaaaaaagaagagcacgcccactcctccggctcttgttctcaacatgcatcctctcccatgcttctggcaccgggagagaccgagaaaccacaccccattgtaggaatggggggcaacggcgccctcctggatagcgacacatttatctggtgcgcgactatcgcagatcttggcggaaaccacctggatgaggggaagctcatggtggcgcacgaccagcagcccgtggggaagatcgagggctcaaatctccgcctcggccatgtggctcccgtcgcctccgcttaagacgcgtacggcgtcaacgttgagcttgactaagaggcccccccccgagtctaggcaagcagcgagtggatcctagactgcttcgcccacgtcagctacatatacggagtcaccacggggatctgatgctcgtctcagtgacgcaccaaagacggacccgcgctccaggatcagctgctgatgcatctcatcgctagaatcttaggcactcggcagatacaggcacgagtctccatctgaggaaaccatgcttgttgataatggtgctcatcctcaccctcctgcaggggtactcggggaatacgcttgacagatcctcgaagccgtctcgaatctgatatactcccgtagccagacccttcctgccgatggcagtgcaccattacgacctgttgaagacctgaatcacggtcttcctgatcggccgggactaatcacgggggcgacccaagcccttcagggcatcccaagtctatgtgagggaagcgtggactcccccaaaaggcggttccaatacccccggacttggaggggatggctgtatcttatccttaaacccccaagaatgggcctcttccgtggaaagaagaatcacgtccgtggagtctcccccatatgcatgta

SEQ ID NO: 90925 - protein, 60 aa, Zea mays
  misc_feature: Ceres CLONE 1579012
  misc_feature: SWISSPROT Homolog: EC 4.3.1.5 Phenylalanine ammonia-lyase
MGGNGALLDSDTFIWCATIADLGGNHLDEGKLMVAHDQQPVGKIEGSNLRLGHVAPVASA

SEQ ID NO: 90926 - DNA, 954 bp, Zea mays
  misc_feature: Ceres CLONE 1579013
  misc_feature: Encodes the peptide sequence at SEQ ID NO. 90927
  misc_feature (793)..(793): n is a, c, t, g, unknown, or other
  misc_feature (800)..(800): n is a, c, t, g, unknown, or other
  misc_feature (947)..(947): n is a, c, t, g, unknown, or other
ggagctcaccgcggtggcggccgctctagaactagtggatcccccgggctgcaggaattcgtctcacccctagaaaaaattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccgggcaaactatcaccctcgaggtggagtcttcagacaccatcgacaacgtcaaggccaagatccaggacagggnaggcatncccccagacagcagcggctcatctttgcctgaaagcagcttgaggacgggcgcacgctgggcgactacaacatccagaaggagagcaccctccacttggtgctgcgcctcaggggaagcatgcagatcttcgtgaagaccctgactncagaatt

SEQ ID NO: 90927 - protein, 232 aa, Zea mays
  misc_feature: Ceres CLONE 1579013
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (186)..(186): Xaa is any aa, unknown, or other
  misc_feature (188)..(188): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGQTITLEVESSDTIDNVKAKIQDRXGXPPDSSGSSLPESSLRTGARWATTTSRRRAPSTWCCASGEACRSS

SEQ ID NO: 90928 - DNA, 837 bp, Zea mays
  misc_feature: Ceres CLONE 1579014
  misc_feature: Encodes the peptide sequence at SEQ ID NO. 90929
  misc_feature (362)..(362): n is a, c, t, g, unknown, or other
  misc_feature (555)..(555): n is a, c, t, g, unknown, or other
agctccccgcggtggcggccgctctagaactagtggatcccccgggctgcaggaattcgtctcacccctagaaaaaacctgcacacccgctctagctgtttgcttcgacccaccaaaatcccgcacccccaggaacgaagctgccgggcaaccaccttcatccacgcgagggcccccttgacccaccaatccaccattgctcgctataagactccgtggtgccgcacggctccgccgccggcgaggcctcatctcggtttactataagagtataagtacgtctccgcaacaagctaatcttttttttgccccctccttccacgtccccaccctgccgtcgtcgctactcgcatagagattcncgcggccgtgtcttgctcgcgcctgcccccttccttccttgtcgtgccagcgcccagatctctcgctcgccggcgctcgggccagatctgggtggggggctcggaggcggagccgggcgcaggtttggtttgacccaaggggcgaggaggataagggattataacccggacgccatggatctggcggttggcngcgggatgcggccgtcggcgtcgaacactcccctgtcggaatcggatgactttgagctcacgcggctgctcagtaaagccgcggatcaacgtcgagcggcagcgctccttcgacgaccactctctcagcgacgtctcgcacctccgcggataccgggaggggtggccttccaacggatgtactcccctgggggccgcctggggctccctcgttggaaacccgggccccctccggggtgaactcctttgagacccccccctattttcgggggaaacccgggga

SEQ ID NO: 90929 - protein, 85 aa, Zea mays
  misc_feature: Ceres CLONE 1579014
  misc_feature (7)..(7): Xaa is any aa, unknown, or other
MDLAVGXGMRPSASNTPLSESDDFELTRLLSKAADQRRAAALLRRPLSQRRLAPPRIPGGVAFQRMYSPGGRLGLPRWKPGPPPG

SEQ ID NO: 90930 - DNA, 968 bp, Zea mays
  misc_feature: Ceres CLONE 1579016
  misc_feature: Translation starting site: 248
  misc_feature: SWISSPROT Homolog: EC 1.1.1.22 UDP-glucose 6-dehydrogenase
  misc_feature (640)..(640): n is a, c, t, g, unknown, or other
  misc_feature (652)..(652): n is a, c, t, g, unknown, or other
  misc_feature (653)..(653): n is a, c, t, g, unknown, or other
  misc_feature (738)..(738): n is a, c, t, g, unknown, or other
  misc_feature (850)..(850): n is a, c, t, g, unknown, or other
  misc_feature (968)..(968): n is a, c, t, g, unknown, or other
tggagctccccgcggtggcggccgctctagaactagtggatcccccgggctgcaggaattcgtctcacccctagaaaaagcacacagacacacaaacacaagtcgtcgtaggcagcgagcgtctctcctctctcacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtctccaagtctgacaagattgttgttgagaagtccactgtccctgtncagaccgctganngctatgagaagatcttgacccacaacagcaagggcatcaactaccagatcctttccaacccagagttccttggcgagggcactgncacttgaggacctgtttcagcctgacagaatgcttatcggtggcccgggagacccttgaggccaagaagggcgtccagctctccaggatgtgtacgctcactggggtcccgnaggacagatcctcaccaccaacctggggtctgctgagctctccagctcgcggccaacgcgttcctggcacagagatctcttctgtgaacgcatttccgcctctggagggcacgggtgn

SEQ ID NO: 90931 - DNA, 1016 bp, Zea mays
  misc_feature: Ceres CLONE 1579017
  misc_feature: Translation starting site: 194
  misc_feature (670)..(670): n is a, c, t, g, unknown, or other
ctggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggggcaagaaccaggtcgccatgaaccccatcaacaccccctttgatgccaagcgtctcattgccagggagtttagtgatgcctctgtccagagtgataattagctggtggcccttcagggccattcctgggcccgggtgaaaagccattgatagtttgttcacccaagggggagggaaaaacagtttgcagccgaaaaaatctccccccagggtccccccaaaaaaggcgggaaaaaccccgaaaccttaccttgggcaccccaaaaaaaaaaggctgtttgtccggggcccgggcttttttttangaaactccaaggggggggccccaaagaaagccgggggggagattgctgggcccctatgtggccggggttatctaaaagaggcccccccccccgccctatttccccaagggccctgaaaaaaaaaagacccaaccggccgggaaaaaaaaagctccctcctcttctcccggggggggggggccctcttgtgctccccccccttcttttagagaagaatatttttttggaaaggccccgggggggacccccccttgggggggagggctttccaccggggggggcccctcttttccggtataaaaaaaaaaaaaaaaaattttctcccccccggggttcggcgggggga

SEQ ID NO: 90932 - DNA, 917 bp, Zea mays
  misc_feature: Ceres CLONE 1579018
  misc_feature: Encodes the peptide sequence at SEQ ID NO. 90933
  misc_feature (802)..(802): n is a, c, t, g, unknown, or other
tagtggatcccccgggctgcaggaattcgtctcacccctagaaaaagaacggcggccgtaacaataacggtcctaaggtagcgaaattccttgtcgggtaagttccgacccgcacgaaaggcgtaacgatctgggcactgtctcggagagaggctcggtgaaatagacatgtctgtgaagatgcggactacctgcacctggacagaaagaccctatgaagctttactgttccctgggattggctttgggcttttcctgcgcagcttaggtggaaggcgaagaaggcccccttccgggggggcccgagccatcagtgagataccactctggaagagctcggattctaaccttgtgtcagacccgcgggccaccccacagtctcgggtagacagtttctatggggcgtaggcctcccaaaaggtaaccgaggcgtgcaaaggtttcctcgggccagacggacattgggcctcgagtgccaaggcagaagggagcttgactgcaggactcacccgtcgagcagaaaccaaagtccgcctttagtgatcccacggtggccaatgggaagggcccaccactctacggattaaagttacctctagggataaccatggtgaatcttcccccaagaggccacattcgaaggggaaggttgtggcaccctcgatggccggctttttcgcaccctggaagccgtaaggtggattccaggggtgggggcggttcccccaataaattctggaccgtgaacggggtgtcatacaccccctgggacgttccggccctactccggggtggggggggntgaaaaattagaaatgaacattttcccctttacataaaagaccgggtatagaaccccccccggggtggacgccttttcgtggcggcccaaaaaatacttggcctcccatgttgtg

SEQ ID NO: 90933 - protein, 79 aa, Zea mays
  misc_feature: Ceres CLONE 1579018
MSVKMRTTCTWTERPYEALLFPGIGFGLFLRSLGGRRRRPPSGGARAISEIPLWKSSDSNLVSDPRATPQSRVDSFYGA

SEQ ID NO: 90934 - DNA, 891 bp, Zea mays
  misc_feature: Ceres CLONE 1579021
  misc_feature: Encodes the peptide sequence at SEQ ID NO. 90935
  misc_feature (813)..(813): n is a, c, t, g, unknown, or other
ctccccgcggtggcggccgctctagaactagtggatcccccgggctgcaggaattcgtctcacccctagaaaaaatccccccagacgaccaccctcctcctcctcccccacccacctcgccggaaccctagcgccgaccgcctgccgtgcccatcgacggcgatcgcattgctgcgccccgatggcgacccgcgcctccaagaattgcctctgcgcgggcagctcttcgttcgatgaccccgacgtggtcgaggtgtctccggcaaccgccgcggctgcagggtgggcctccggccaccacaagaggaagcggagccaggttgtaccgcaagaagtgattgaaatcgatgatgatgatcctgatggagtcatacttattggtgataaagcacaggtggaaaagaataagcaaactgctgtatgtcccatggattgctcaaagcatgccaagagtggttgggttcaggacatccctggtccaagcacatatgcttcaaaatataccagttcctgggttggacctgaaagtgtttcaagacgaggcagtttacaactattctgatggctacccctttgatggatttgaagaagactatgcttatgatgaagatgagtttgacgatgatggttatgacactccactcattgaaagtgagtatcaatttgggtttgtctgccaaagttgataaactcaatgttctacatggtctggagggctctttaccgtggaagcagaagactgctattgagattgcaaataggaccaaacctagtaaagctgtagatgattaaatcgaagaaaataccaggccntcaaacgatttgatacggttgatgatcataggggatccttattatcaaagccagaatccagaaaggctcaagccggaa

SEQ ID NO: 90935 - protein, 126 aa, Zea mays
  misc_feature: Ceres CLONE 1579021
MATRASKNCLCAGSSSFDDPDVVEVSPATAAAAGWASGHHKRKRSQVVPQEVIEIDDDDPDGVILIGDKAQVEKNKQTAVCPMDCSKHAKSGWVQDIPGPSTYASKYTSSWVGPESVSRRGSLQLF

SEQ ID NO: 90936 - DNA, 969 bp, Zea mays
  misc_feature: Ceres CLONE 1579022
  misc_feature: Translation starting site: 169
  misc_feature: SWISSPROT Homolog: EC 2.7.7.27 Glucose-1-phosphate adenylyltransferase
  misc_feature (646)..(646): n is a, c, t, g, unknown, or other
  misc_feature (930)..(930): n is a, c, t, g, unknown, or other
ctccccgcggtggcggccgctctagaactagtggatcccccgggctgcaggaattcgtctcacccctagaaaaactcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatcctttcggaggaattatgctgatcctaatgaagtcgctgccgtcattttgggtggtggtaccgggactcagcttttccctctcacaagcacaagggccacccctgctgttcctattggaggatgttacaggcttattgatatccccatgagcaactgtttcaacagtggcataaacaagatatttgttatgactcagttcaactcagcttctcttaaccgtcacattcatcgtacctatcttgggtggggggatncaactcactgatggatctgttgaggtgctggctgcaacacaaatgcctggggtaggctgctgggtgggtccagggcacagcagacgccgttagaaaattatctgggtacttggaggattatacaagcataaagctatagaacacattttgattttgtccagagatcactctatcgtatgaattacatggagcttgtgcaaaacatggcgatgacatgcagacataacttatcatgcgctcccggttgaaagagcgagcatctgacttaggattagttaagtcgnaagttcaggccgtgtattcatttcttgaaaaaccaggga

SEQ ID NO: 90937 - DNA, 1172 bp, Zea mays
  misc_feature: Ceres CLONE 1579023
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
cggcggtcgcttttcttccccccccccctcggatgcgttcttcccacccannnnnnctnnnntttaaagctggagctccccgcggtggcggccgctctagaactagtggatcccccgggctgcaggaattcgtctcacccctagaaaaaacgtctcagaaccctcgcgaatcgtcatttccgctctctgccacgccggagcccccactgcccaccacccgttcccgcggcctcgccctttgcgtggctgaagaagcgaaagatgctcggggcctctaagcgatccctcagtgccgccaccaccgcccgcagacgcgtgggttgcggagatgtctccaccatctctgccgacgccggcccctcaatgccgccccgacccagctacaatggaccgccgggggttcaccaaccccacaagaggcggccctctgagtttgtggcccccaaggttgaaggaacctttttccccccccggcctcaaactgatggggggggggcccttccggggggacgctttttattcagggtgggcgagcaagttgaattccacggaaccccccagcgtgaaaaaggccttgacctccccgggttcaagggctaaacaggggtcccgggacttttatccggctcccaccccctggttttctttccctaggggaatttttttcttttcccaaaacctggttcaaccttaagccctcggtgggagcccctccttgatataaattttgcgcggttccccggtgattggttacggtgaattccgcgagactcttcttaaaaaaataaaggccccccccccacccttgagattttgtcccctctccgtttcctggtccacgtggtataaaggggcacatagttcacctctcttccccgttttttggcgggctaggggtgtatcacataaaaccacgaggcctctatggttcctcccgcgtgggagccattcaccgctaacccgtggtaattccgcccgtcttccccgtacgcttctgcggtgagaatcacctaaaatcggcgttgggaaacaaaatctgttgtggcttgtgtggggggtgggtttctctctccccgttctggtgttttaaaagatggggggcgtctgtcagaaagccataatcgcctaaacttattttggggagaaaaaaaaacttgttgtcccaccacaaa

SEQ ID NO: 90938 - DNA, 915 bp, Zea mays
  misc_feature: Ceres CLONE 1579024
tggagctccccgcggtggcggccgctctagaactagtggatcccccgggctgcaggaattcgtctcacccctagaaaaaaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataagtgggagcctccgggcgcaagtgaaataccactacttttaacgttattttacttattccgtgggtcggaagcggggcaccgcccctccttttggctccaaggcccggcctcgccgggccgatccgggcggaagacattgtcaggtggggagttccgctggggcggcacatctgttaaaagataacgcaagtgtcctaagatgagctcaacgagaacagaaatctcgtgtggaacaaaagggtaaaagctcgtttgattctgatttccagtacgaatacgaaccgtgaaagcgtggcctatcgatgctttagaccttcggagtttgaagctagaggtgtctgaaaagttaccacagggataactggctttgtggcagccaagcgttcatagcgacgttgctttttgatccttcaatgtcggctctccctatcattgtggagcagaattcacaagtgttggattgttcacccaccaataggaacgtgagctgggttagaaactccaacctccccccgtgcgtgaccctgacggcgcattccgccgattcctcgtccacctgacaaaacccccccccctaggggctggactccctccatttctatccctgcagctgggttaactatccccccccccccgaggaattgccctctcccttttatctatccccc

SEQ ID NO: 90939 - DNA, 924 bp, Zea mays
  misc_feature: Ceres CLONE 1579026
  misc_feature: Encodes the peptide sequence at SEQ ID NO. 90940
tggagctccccgcggtggcggccgctctagaactagtggatcccccgggctgcaggaattcgtctcacccctagaaaaaattctacccaaattccccactccacgccgccgccgccgccgccgccatgggaagaaaagacacctcgtcctcctccgcggccaccggcggcgggaaaaaggagaaacctatgtcggtgtccgccatgctcgcctccatggacgctcccgcggccaaggccaagtcttccaaggccaaggccaaggccaagccttccaaggcgccggcgtcctcctacatgggcgacatcgacctgcccccctccgacgacgaggacgaggaggaggcccggctcgccgccgccgcctagcccaagccggcccgcgccgccgtcgtcgatctcagcgccggcgccgcgccgtcgcacaaggacgccaagaagaaggacaagcgcgaggccgtggcggccgctgccgccgaggccgccaggcaggaggcgctccgggacgaccgcgacgccttctccgtcgtgatcggcgcgcgcgtcccgggctcctccgccgacgacggcgccgtcgacgactacgtcagggacgtcgtgctcgagaacttctccgtctccgcgcgcgggaaaggagctgctcaaaggcgcctccctccggatctcgcactgccgcatgtacggcctcctcgggccccacgggatgggcaagtcccaccctgctcaagctgctgggcctggggcccaggtccccgtgccacggaaaattcaactcctggctcgtcaaagcaggaaatacttcgggaaagaaacccttcggcccttgtaggggggtgggtcccccccttacaaagaactcccctggcctccccaaaccaataaaggccagggtttggggtttcccatatggccccgtaagacaaac

SEQ ID NO: 90940 - protein, 80 aa, Zea mays
  misc_feature: Ceres CLONE 1579026
MGRKDTSSSSAATGGGKKEKPMSVSAMLASMDAPAAKAKSSKAKAKAKPSKAPASSYMGDIDLPPSDDEDEEEARLAAAA

SEQ ID NO: 90941 - DNA, 1333 bp, Zea mays
  misc_feature: Ceres CLONE 1579027
  misc_feature: Encodes the peptide sequence at SEQ ID NO. 90942
  misc_feature (47)..(47): n is a, c, t, g, unknown, or other
  misc_feature (68)..(68): n is a, c, t, g, unknown, or other
  misc_feature (814)..(814): n is a, c, t, g, unknown, or other
tcctcccgtgttttttcgcccccctttccccccccccctctttgatntttctttttattagttttccntatctggtactcaccgcggtggcggccgctctagactagtggatcccccgggctgcaggaattcgtctcaccccctataaaaaaagcaaaaacagttgactctgaactcgcattgcaagccccttcctgacgaaaatggcagcacttgttcctctgctgctcgcccacctactcctctgcgtccatggcgccaccgttacctcggtcgccacgccgccgcctctcccggtcctgcccgtcccgttctacgcgtagttccggtggtagctctccgaagaatggcggctctttccttcaccttcgggcccaattaccttcacggactcctagtggggcaccggcccacgctgacccctccgtgtccgcttcctccggactcaagtcggtgccttgggcggggattaattgcccaccgccggcctccggcctttttcttgcttctttcccaaaccaccaacgatggttttttgtcggtggggccggccggcactgaaccaattacttctgtgggccgaccttcccctgcgcgccggtctgggttttgagggacctcccccctctacgaattttggctctatagccttcagctcaccctttggtgggttattgcgcggctgtgtgtcttggtaaacatacttcgccccgcgggcggaatccctccttataaaccactttgttttttctcttgggtacacccctcttctcgcctattacacgacgtgtgcgtttattttatcttgtcgggncgtgcaagtttattgtcccatacgaatgcgtgggctttgtaaccctagttggttgtttgttcgttacaacacttcgtttcctgaatcgctaacggccgctatagtgcggcacactagagacagtaggggggtcccgtatatcccatagggcccgttcacgaccgcctcactctacaagcccagatgtcgccgcgctggaccaatagagggcgctcaatcgactgtatacgcccggcgagatatcctctctcacacctgcttcagtgttaatgtgggagcgctgttacaaaacgagaagcgggcgcgtggacgctttatattgtgccctttctttttttagaacgctgtaaaacagtatgtcgcatgtcgtatcgataacggcgcggtgtgcgtgtgatgttacgctggtttcgcgcacattcgcgccggaccatctatccccaccactcgttctgtgatgctatgattcgctaaatatataatgaggtcatagcgcgggatatctggctcggtggcggg

SEQ ID NO: 90942 - protein, 39 aa, Zea mays
  misc_feature: Ceres CLONE 1579027
MAALVPLLLAHLLLCVHGATVTSVATPPPLPVLPVPFYA

SEQ ID NO: 90943 - DNA, 1008 bp, Zea mays
  misc_feature: Ceres CLONE 1579028
  misc_feature: Encodes the peptide sequence at SEQ ID NO. 90944
ctccccgcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctcctagccccgcattgaggcctggaacagtgacaccctgccaatctacgaccccggtctcgatgatgttgtgaagcagtgcacgggcaggaacctcttcttcagcactgatgttgagaagcacgtcgctgaggctgacattatctttgtctcggtgaacacccccaccaaagacccgggggcttggaactggcaaggctgccgaacttcacctactgggaagagcgcctgcccgcatgaattgcggatgtcttccaagtctgacaaagatggttgtttgaaaaattcccctgtcccctgtcaaagacccgctgaagcttttggaaaaagatttttgaccccccaaacaggaaggggcttcaacttcccagaatccttttcaaacccaaagatttctttgggggaggggaccggccatttaagaacctgtttcaaccctgaacaattggtttattggggggccggggaaaacccctgaggggcaagaaggcccttcccagctctctaggatggtgtacgcccagtggggtccccaagaaaggatccccccacccacaccgggggcccggatagctctccaagtttgttccaaacggtttctgggaaaaagaatctcctttgtgaacccatctcgaccccctgaaggcccggcgtcttatattatggg

SEQ ID NO: 90944 - protein, 35 aa, Zea mays
  misc_feature: Ceres CLONE 1579028
  misc_feature: SWISSPROT Homolog: EC 1.1.1.22 UDP-glucose 6-dehydrogenase
MVKICCIGAGYVGGPTMAVIALKCPDIEVVVVDIS

SEQ ID NO: 90945 - DNA, 1333 bp, Zea mays
  misc_feature: Ceres CLONE 1579034
  misc_feature (62)..(62): n is a, c, t, g, unknown, or other
  misc_feature (871)..(871): n is a, c, t, g, unknown, or other
  misc_feature (1111)..(1111): n is a, c, t, g, unknown, or other
cccttttttctcgtggtcgtttctctctctctctcatttttcgtctcggatatataagtatnttaagtggagctccccgcggtggcggccgctctagaatagtggatcccccgggctgcaggaattcgtctcacccctagaaaaaatccccctcaattggcggcacccagtccccacctgttgcacgcgatcccttcggcacaccgcctcctagcccagatttgttcgcccctcgccctctccaaacttggtgattcacagagtctgcctagctgcctaggcaccggcgtccggatcttctgctccgctggtcacctataaaaggctctccagtgttgacttggagcgtcagcgtcccccggtagcccttttctccgattcctcactgccccccccccctagattgtgtccatccggtatcacccatcgttaaggcgggggtctacccttttcttcgttttcggtggcaccccccccggcaggttggttttggggatacacccccctctcattttatacacaccccccgccccccttcgaaacccccgtagctttttggattcactggtaaacagccccttttgtgttttaaccatgggtgtgccgaagtccggaatgtgcattcccccccgttcgattacctccacctcacttcttttccgtagggatatatctgattgcgacctctgatcaaaaacctgatatttaacgctcggtggtgtacaaccggactttggattccctgtctggcgcggttgagtactattttcgcttgacccattaatattacgtgccgtgcctttcttttcgcactcgttccccccctgtcaaatagagacgtatctactctatcacccattcacctcgggangacggcgatatcctcccgaggtgttgttatacctcctgcgtttctcactgatatcgaaatgatatacctcctctctcgagtatgtcacgcggcgggaaggatatatgccgctatctgatgtgtgtacacaccacacactcgtacgttgtttctactctctatagcgaattgcatatgattattcgccacgtcccgctcgggtttggtgcgttgcgctctcgtcgacatatcgctgtcccncgcgatagttaatgcgtctctaggatagctggcactcagactcctattgacccctctcatttatgcccttgccgcgattttccatatatgttgcagtatgcgggttacgcagacgcgcatgattatgcgttgtgaggtatggtatgtcgtctccttcgccgccgcgcttataattttttacataacatctctgtgtctctgacagcgccgcacacgaatgtc

SEQ ID NO: 90946 - DNA, 960 bp, Zea mays
  misc_feature: Ceres CLONE 1579036
  misc_feature: Translation starting site: 195
agctccccgcggtggcggccgctctagaactagtggatcccccgggctgcaggaattcgtctcacccctagaaaaaccctcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtcagtggggtttattcggatgacaataaccttcagcttgaggccaccacacagtttcgcaagttgctatctatagagaggagccctcccattgaagaagtatcaaatcaggtgtagttccaagatttgtgcagttgctcacaagagaggatttgccccagctgcagttcgaagcagcatgggctctcacaaatattgcttctggcacttcagaaaatacaaaggttgttattgatcatggggctgttcctatatttgtgaagcttcttgggtctggtagtgatgatgttcgtgagcaggctgtgtgggctttgggcaatggtgctggcgattctccgaatgtcgtgaccttgtccttgccatgttgcattgatgcctctgctagcccagttgaatgagcatgcgaagctctccatgttgaggaatgcccctggactcttccaacttttgcaggggaagccccggcatctttgatcagactaagctgctctgcagcacttgcagaactatcattcaacgatgagaaggtctcctgatgcatgcg

SEQ ID NO: 90947 - DNA, 957 bp, Zea mays
  misc_feature: Ceres CLONE 1579040
  misc_feature: Translation starting site: 151
  misc_feature: SWISSPROT Homolog: EC 1.1.1.49 Glucose-6-phosphate 1-dehydrogenase
  misc_feature (724)..(724): n is a, c, t, g, unknown, or other
  misc_feature (770)..(770): n is a, c, t, g, unknown, or other
  misc_feature (778)..(778): n is a, c, t, g, unknown, or other
  misc_feature (802)..(802): n is a, c, t, g, unknown, or other
  misc_feature (814)..(814): n is a, c, t, g, unknown, or other
ggagctccccgcggtggcggccgctctagaactagtggatcccccgggctgcaggaattcgtctcacccctagaaaaaaccccatcctcgtcttctccaattccaaagtaagaaagccacacgcgaggccgaccgaggaagtccaatctcatggcgctctcctgcatgaggtgccccgcgggcgccggcgccgcctccgcccgacgcgccgcagcgcagccgttggccgcggaggctgcggtctccttcgccagatgccgcggcttcgggaggtccgccaccgctgcgacttccgcctggttttggcgcaaccatgccgttgcctcacagggagtgaaagctcccatggatgctgatgtcaagaatgctgtcatacctcctacctcaccaaaggtggaaagtggctctccttcagaaatcactctggatgaatttgaagacttgagcgctctatgcaagaatgatgattctactgttagcatcacagtagttggagcatctggtgaccttgccaagaagaagatatttcctgccctttttgctctctactatgaagattgccttcccaagcatttcaccatctttggctatgcacggagcaagatgacagatgctgaactgaggaacatggttagcaaaacactgacttgcagaatagataaaaggggaaattgtagcgagaaaatggaagagttcctcaaagatgcttctatcattcaggccnatatgattcagaagagcatttcatagatctagaccagaagctaaangcacatgnagggtccagagtttcttaccgccntttctacttgtncatacctcctaaataatttttgaatgtgtaaaatgtgcagcaatcagcatcttcggtgaatgggtggacacgagtaatgttgagaagccctccggcgaaactcagatctccgctgcataacaagcgtctgagcagtacctgta

SEQ ID NO: 90948 - DNA, 931 bp, Zea mays
  misc_feature: Ceres CLONE 1579045
  misc_feature: Encodes the peptide sequence at SEQ ID NO. 90949
  misc_feature (887)..(887): n is a, c, t, g, unknown, or other
  misc_feature (902)..(902): n is a, c, t, g, unknown, or other
ctccccgcggtggcggccgctctagaactagtggatcccccgggctgcaggaattcgtctcacccctagaaaaacagcatcactgccgtgtagtgtagctagagcccgtgcactggtccggattcgcagagcaaaacggaaatgatcacggtggcagcaccggaggcgcagccgcaggtggcggcggcggcggcggttgcggcgccggaggagaccgtgttccggtcgaagctgccggacatcgacatccccacccacctgccgctccacgactactgcttctcgagggcggcggaggcggcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatggtcctgctccagaactccgtcgagttcgtgctcgccttcttcggcgcgtccttcctcggcgccgtcaccacggccgccaacccgttctgcacgccgcaggagatccacaagcaattcagcgcctccggcgcgaaggtcgtcgtcacccactccgcctacgtcgccaagctccggcacgacgccttcccgaagatcggcgtggacggcaatgccctcaccgtcctcaccatcgacggcgacgcggccgacaccccggaaggctgcctggcgttctgggagctgctcacgtccggcgacggcgacgccctcccggtagtgtccatctccccggacgacccgttggcgctgcccgtctcgtctggcacacggggctgccccatggcgtcgtgctgacccacggcggcccagtcacgaacgtggcgcatcatgtggacggagcgaacccctactgtacatgncggttggcgacttcncgctctgcgtgctgcctctgttcaatctt

SEQ ID NO: 90949 - protein, 226 aa, Zea mays
  misc_feature: Ceres CLONE 1579045
  misc_feature: SWISSPROT Homolog: EC 6.2.1.12 4-coumarate--CoA ligase
MITVAAPEAQPQVAAAAAVAAPEETVFRSKLPDIDIPTHLPLHDYCFSRAAEAAGAPCLIAAATGRTYTYAETRLLCRKAAACLHGLGVAQGDRVMVLLQNSVEFVLAFFGASFLGAVTTAANPFCTPQEIHKQFSASGAKVVVTHSAYVAKLRHDAFPKIGVDGNALTVLTIDGDAADTPEGCLAFWELLTSGDGDALPVVSISPDDPLALPVSSGTRGCPMASC

SEQ ID NO: 90950 - DNA, 1253 bp, Zea mays
  misc_feature: Ceres CLONE 1579047
  misc_feature (46)..(46): n is a, c, t, g, unknown, or other
  misc_feature (48)..(48): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (63)..(63): n is a, c, t, g, unknown, or other
  misc_feature (1192)..(1192): n is a, c, t, g, unknown, or other
ccctcggtggttgcgtgcgcccaccctctccttccttgttgtgccncntcnntntaggataantttaaagctggagctcaccgcggtggcggccgctctagaatagtggatcccccgggctgcaggaattcgtctcacccctagaaaaaacaccagccgcttgcacttgaaggtggctgtaccttccccggggatctagctgcctgcctctcactcgagagtcacagagaccaccccctagctagggatggccgcagcgacgaaggctctatgctgtcgcctccccggtgtcagaacggaggaatacatttgtccgttggtaccaagtctaaggtggccacagagcagcaccataaaaccctggacctggcgctgttagccaaagggtgcgtagatgctggggccttgcgctagggccttcgtcttcaggtccgccgtaaaggtcggtctggggtgggaaccaaggggggggcttcccacccccctagttatggggtcccaggactttcgggtgtaaaagagagccgtggcacggtgcctatcggggggggcagtctttttttcgcttccaacacttaggcgggcgtgaccacctcggtccggggggagaccggggcaaaagaagtaggggtctccttaaatagggaggaaaggtaggaggggattttgttttggtttcctcgggggtaccggcgaaacctcgtaatgtgtcctttaattgctgcgatcgcagggaactacggtcgcctaaagggattggggtcgtgcgcgggagagagcccttgtcctaccattgtgtgatatgccttacaaatgactctccgtttccggtcctcctattggtttatacggggaagcattccgctctttgttggggtacccaggcgtgttacgaggtatatgcgtttgagtgtaccagcaataacattccattggtggtatcgcaaactctcccgcggttagccgcgtgattgtaatccgatcgcccgcgtgaggcttcgtcttgagcacctcggtgaggcttccaacgggcgggttcccagcgaggcggcgggcggaactagaaggcattccttaactatggggggaggggcgtatctctgtgagtgacgggccttcgcacaaaagtacatttgttgataactcacatgatggcgtacgtattcggcactatagataaagatgtcctccnctgcccgacatgaagaccggtaatctgttgtccgactcgatccctcttctagattatattg

SEQ ID NO: 90951 - DNA, 963 bp, Zea mays
  misc_feature: Ceres CLONE 1579050
  misc_feature: Encodes the peptide sequence at SEQ ID NO. 90952
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (842)..(842): n is a, c, t, g, unknown, or other
  misc_feature (843)..(843): n is a, c, t, g, unknown, or other
  misc_feature (845)..(845): n is a, c, t, g, unknown, or other
  misc_feature (846)..(846): n is a, c, t, g, unknown, or other
  misc_feature (857)..(857): n is a, c, t, g, unknown, or other
  misc_feature (858)..(858): n is a, c, t, g, unknown, or other
acccgcggtggcggccgctctagaactagtggatcccccgggctgcaggaattcgtctcacccctagaaaaaacaagacatcagtgcgtccattccacctgcttggtccatcagcagcgagcgaacagggaaaaaggagaggccgagaagcgctttagcgataagactggtgcacccgtagcggcacggcatggcggccacggcgtactccgtggcgctcctcggcggcgcacgcctgccggccgccctcctccctcggcgcagcagcgtgtgccaccagcagcttcgcctccaagacgcgccgaggctctccctgcaccgtgccagggccgcttccgaggacacgtcggcctccggcggcgacgagctcatcgaagacctcaaggcaaagtgggacgccgttgaggacaagcccaccgtcctcctgtacggcggcggcgccgtcgtggcgctatggttgacgtccgttgttgtcggcgccatcaacgccgtgccgctgctccccaagatcctggagctcgtcggcctcggctacaccggcttggttcgtgtaccgctacctccctctcaagcaaagcaagaaagagctggtcgacgacattgagaccctcaaagaaaagattgctggaacggcggaattagcgctagctctcgtggaaagctttagacccacgacgagaggggcccgtttcctctttgcaaattagatatcaaaccgagggacgtacaatgcagctactgtcgcccatggtgtgtgtgatgcataccctaccctctggtatcttacgaatttaaagaggaaagcattttggcttggccaannnnnannnnnnnnnnaatanntnnaaaataaaatnnaaaaaaaagggggggcgtatttctggcgccaatttcctttgcccccgagatttaaatcccccccccctttgacctccccaacctggaattctttatttttttttt

SEQ ID NO: 90952 - protein, 137 aa, Zea mays
  misc_feature: Ceres CLONE 1579050
MAATAYSVALLGGARLPAALLPRRSSVCHQQLRLQDAPRLSLHRARAASEDTSASGGDELIEDLKAKWDAVEDKPTVLLYGGGAVVALWLTSVVVGAINAVPLLPKILELVGLGYTGLVRVPLPPSQAKQERAGRRH

SEQ ID NO: 90953 - DNA, 966 bp, Zea mays
  misc_feature: Ceres CLONE 1579053
  misc_feature: Encodes the peptide sequence at SEQ ID NO. 90954
gagctccccgcggtggcggccgctctagaactagtggatcccccgggctgcaggaattcgtctcacccctagaaaaaggagctgtgagctgagctgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcggggcccctataacccgggcgccggcttcaccggcgggacgcgcgtctgcgtgtacctcgacccccagggagaggagcacgcgcgcgttaaagaccttcgccattgggacctactccaacggtccgcccggacctgggtcgcggactcccgcgcgagcgtcggcgccatgctggacccctgggacccggagttcggaaagaacgaccgcagccacaagaacccctccgccagctacctcgtccccctggaacaaggatacttccgggtccttctgcaaggggttcgtgggggcccaacacctccccccgatggggggggggaaaaaatccggctttcaccatccgggaaatctggggtggggcctgggagatcctgcgcaaccaaaaaaaaacgggcccctcccaccccgctggaaggactggtcttatcaacctctttccgcgtgggccctccttcctcatg

SEQ ID NO: 90954 - protein, 260 aa, Zea mays
  misc_feature: Ceres CLONE 1579053
  misc_feature: SWISSPROT Homolog: EC 4.2.1.92 Hydroperoxide dehydratase
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGAPITRAPASPAGRASACTSTPRERSTRALKTFAIGTYSNGPPGPGSRTPARASAPCWTPGTRSSERTTAATRTPPPATSSPWNKDTSGSFCKGFVGAQHLPPMGGGKKSGFHHPGNLGWGLGDPAQPKKNGPLPPRWKDWSYQPLSAWALLPH

SEQ ID NO: 90955 - DNA, 977 bp, Zea mays
  misc_feature: Ceres CLONE 1579060
  misc_feature: Translation starting site: 158
  misc_feature: SWISSPROT Homolog: EC 4.1.1.31 Phosphoenolpyruvate carboxylase
  misc_feature (783)..(783): n is a, c, t, g, unknown, or other
  misc_feature (925)..(925): n is a, c, t, g, unknown, or other
tggagctccccgcggtggcggccgctctagaactagtggatcccccgggctgcaggaattcgtctcacccctagaaaaaaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtgtcggccgactatgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaagctcaagaaaggtgggttcgccgacgagggctccgccaccaccgagtccgacatcgaggagacgctcaagcgcctcgtgtccgaagtcggcaagtcccccgaggaggtgttcgaggcgctcaagaaccagaccgtcgacctcgtcttcaccgcgcatcccacgcagtccgcccgccgctcgctcctgcagaaaaacgcaggatccggaattgtctgacccagctgaatgcaaggacatcactgacgacgacnagcaggagctcgatgaggctctgcagagagagatccaagcagccctcagaaccgatgaaatcaggagggcacaccccccccccagacaaatgcgctatgggatgagctcatccatgagactgtatggagggcgtgcctaagntcttgcgccgggtggaacagccctgaagatatcggcatcaatgaccgccttc

SEQ ID NO: 90956 - DNA, 922 bp, Zea mays
  misc_feature: Ceres CLONE 1579062
  misc_feature: Encodes the peptide sequence at SEQ ID NO. 90957
  misc_feature (662)..(662): n is a, c, t, g, unknown, or other
ctggagctccccgcggtggcggccgctctagaactagtggatcccccgggctgcaggaattcgtctcacccctagaaaaaaccaccaccaccggtcaccgaaacgcagcaactgacaggcacctgacggagagctagtcgctctgcagccgagtcgagtcgaactagcgcgcgagcgagcgaggaagaagaagagctagctatactgctgcttcctcgcgcgcagcagcagcagcaaacgaagaaaccagccccatgggcggcagcgcggatgcgaacggcgcggggtcggtgcgggtgccggtgccgccggcgcggccgttcctggacacgttccgcgggaacctcaaggagaccttcttcccggacgacccgttccgcggggtggtgcgggagcgcggggccgggcggcggaccgtggccgcgctgcgctacttcttcccgttcctcgagtgggcgccggcctacgcgctgtccaccttcaagtccgatctgatcgccggcatcaccatcgccagcctcgccatcccgcagggcatcagctacgccaagctcgccaaccttgccgcccgtgctcggactctactcgagcttcgtgccgccgctggtgtacgcgctgatggggagctcaaggactgcgggggggaaaggggggggggtttnttttttttctctggttctccctgtccgggccctctggttcccctgacgataacccccgtgtcccccggggcgttcccttcacggtgtcctctttgtcggggtttgttacgtcctgtttccccctttcttgggaggcctcagctgggggccggttgtttcgatacgcgtgttggctattcctggccggtcctgttttttacgggcgttcgcctgcggaacttgtcctcacccactgcggttgtggtggcgggcactagtta

SEQ ID NO: 90957 - protein, 222 aa, Zea mays
  misc_feature: Ceres CLONE 1579062
  misc_feature (136)..(136): Xaa is any aa, unknown, or other
MGGSADANGAGSVRVPVPPARPFLDTFRGNLKETFFPDDPFRGVVRERGAGRRTVAALRYFFPFLEWAPAYALSTFKSDLIAGITIASLAIPQGISYAKLANLAARARTLLELRAAAGVRADGELKDCGGERGGGXFFFSGSPCPGPLVPLTITPVSPGAFPSRCPLCRGLLRPVSPFLGRPQLGAGCFDTRVGYSWPVLFFTGVRLRNLSSPTAVVVAGTS

SEQ ID NO: 90958 - DNA, 1304 bp, Zea mays
  misc_feature: Ceres CLONE 1579063
  misc_feature: Encodes the peptide sequence at SEQ ID NO. 90959
  misc_feature (1)..(1): n is a, c, t, g, unknown, or other
  misc_feature (1154)..(1154): n is a, c, t, g, unknown, or other
ntttttgatggggaggacaataaaaactaccaccgaggggtgtctttctaccttatggtttttcttttaagctggtgctccccgcggtggcggccgctctagaatagtggatcccccgggctgcaggaattcgtctcacccctagaaaaagtcgaacggaacccagaggaacagagcagacgacgcgaggcgatttctgcgggtttgcttgctccatctgtagaccttaggccgccgccgggcgaccgtgcgcgtgcggtgctcacgccccaccccgctcaggtgaaggcacttcaagatgggcgaggtacacgaagctgacaagaacattgagatctggagggtgaagaagttaatcaaggcacttgatgctgcaatgggcaatggaactagcatgatttctctcatcatgcccccccgtgatcagactccacccgttactaagatgcttggggatgagtacgggaacccccccggggggccagagcagagttatagggacaccccggtggtggctgccattacccccggctcaaaaaaaaggtggaagctttcccgtcgtatttcccccccaattgggttttggggggtccttttctgggacccactctgctccccattgaaggccctggggagaaaaaaaggggtcccccttggaatttcccaggccttttttggggcccctttttatgggcttccacctgggttacccccgggggaattaccaaaggttccccgtcgcttgtgagggcgcccccgagaaatcagggactctctggagtcggctcctctttgtttcacatagtctccctgcgatttctctcctataacctcgctccttgcatagtgcaaccatgttggtgtcccccccccggactgtatgggtgtgaaatatcgttttggactccgcgtgtaacataacttcgagtgaagggagagagtgtcatttctgcttacataagagattacacagtgcggatcgttgttgttcctctctactaaatatataacatatatgcgtgtcgccttgacaagtatcgcgtattttatttcgcacgacctgcctgtctgttttgccaccccccccccgtcacaccttgttgtggtttgcgggcgacaccagcaatatgtttctcttcgcctctactgttgtntgcgtcaacacacatatttgtcctgtaaacaagtccatatttgctagctatgtttggtgtggggcccattatctcctacaatcgcaagatgactgtggggggcggcacttacgatcttggagcgttgggcatgatcacactccacaagtg

SEQ ID NO: 90959 - protein, 149 aa, Zea mays
  misc_feature: Ceres CLONE 1579063
  misc_feature (6)..(113): Pfam Name: eRF1_1 Pfam Description: eRF1 domain 1
MGEVHEADKNIEIWRVKKLIKALDAAMGNGTSMISLIMPPRDQTPPVTKMLGDEYGNPPGGPEQSYRDTPVVAAITPGSKKRWKLSRRISPPIGFWGVLFWDPLCSPLKALGRKKGVPLGISQAFFGAPFYGLPPGLPPGELPKVPRRL

SEQ ID NO: 90960 - DNA, 936 bp, Zea mays
  misc_feature: Ceres CLONE 1579064
  misc_feature: Encodes the peptide sequence at SEQ ID NO. 90961
tggagctccccgcggtggcggccgctctagaactagtggatcccccgggctgcaggaattcgtctcacccctagaaaaagatctctcctcctcccccgtctttcgtctccggttgcgtccccgacgtcctcgcctgcggtgggagggcggggcggaggagctggaggttcctggtagcggctgccgccggccatggagaagaggaagcggatcctggagctgcgggatcggctggaccggacgctggcgatgcccgacctcgcggaggaggcctcgctcagggcgctggtgaagaagcagatcctggcgtcgtccctgcccggctccgatcaaggtgacatcgatctcattgctgaaacgcgggcaaaagaagtctctgagtttcttgaaatgctagacacttcgagggacggacgatcttcctaggtccatgggctgccacagaaggagtggaaggtgaagcaagatacagacccattaagagtgatgtaccgtgagggtccagaggggacaccttttcatacctttactgctgaaagctttgcagatggacctattgacgtttgtacatgggtggcctggggattcacctttttcaaaaatgggtttccccaatacaacccggccaccttttaaaattgatcagccggggctgcttgaaaaaagggaggatgggggaaaaaatttttttggcccgggggtaaggttccctgggcgggtttccaaaaaaggggcttttcctcccttttttgaaccggaattccttaaaaaaaaagcccaattttgggaaaaggaaacctctcccaaactgtgtgggcctcaatttccccaccccgggggttttttggggggagggatttcctcaagtgggggaacactcctcagtataaggtttgtgggggcctttttttgtcccgggtttctccagataaaaag

SEQ ID NO: 90961 - protein, 77 aa, Zea mays
  misc_feature: Ceres CLONE 1579064
MEKRKRILELRDRLDRTLAMPDLAEEASLRALVKKQILASSLPGSDQGDIDLIAETRAKEVSEFLEMLDTSRDGRSS

SEQ ID NO: 90962 - DNA, 931 bp, Zea mays
  misc_feature: Ceres CLONE 1579069
  misc_feature: Encodes the peptide sequence at SEQ ID NO. 90963
acccgcggtggcggccgctctagaactagtggatcccccgggctgcaggaattcgtctcacccctagaaaaaccctagaaaaagagagaaaaaaaactgcggagaggtagcggtggatcgaaaccctaggcgcggtcggcggcgatggcggcggcggcagcagcggcagctgcagcgcctgagtcgtacatcgggagcttgataagcctcatgtcgaagagcgaggtccggtacgagggcgtcctgtacaccatcaacaccgaggagtccagcatcgggctaaaaaacgttcgctcatttggaactgaaggtcgtaagaaggatggccaacagattcctgccagcgacaagatatatgagtacatactctttcgaggaagtgatataaaggatttgcaagtcaaatcatctccaccatctcagtcggcaactttacacaatgatcctgctattattcagtcacattatcctcatccagcttcgctttctacaagtttgccttctgctgcaagcactataggagccaaccctacttcacagaatgctcccatcttgattcagatgccaccgccatttcaaggggatttgcccccttaccagtctggcaacagcctacagtcatgaaactcagcaccttgccatcatctgcaattggactggccttacaatgccacaatggtctgggcaggattttacacccccccacctgggttttttattttgaagcaaccctttttccttggccacccccaatttgggtggtccaagggccgggacctcccggaaaatccgggaattgggactttacccgggggtttccaaatgccggaaatccctctttctccacccggggaaaagaatgttaataaaaccctgggggccccccgtgggccccccccctcttgtttttcccaactttttttcaaagacc

SEQ ID NO: 90963 - protein, 159 aa, Zea mays
  misc_feature: Ceres CLONE 1579069
MAAAAAAAAAAPESYIGSLISLMSKSEVRYEGVLYTINTEESSIGLKNVRSFGTEGRKKDGQQIPASDKIYEYILFRGSDIKDLQVKSSPPSQSATLHNDPAIIQSHYPHPASLSTSLPSAASTIGANPTSQNAPILIQMPPPFQGDLPPYQSGNSLQS

SEQ ID NO: 90964 - DNA, 1070 bp, Zea mays
  misc_feature: Ceres CLONE 1579071
  misc_feature: Encodes the peptide sequence at SEQ ID NO. 90965
  misc_feature (1070)..(1070): n is a, c, t, g, unknown, or other
ccccgcggtggcggccgctctagaactagtggatcccccgggctgcaggaattcgtctcacccctagaaaaagcgcattccgcaacacctgctcctcgcccccttctgctcataggcgacgcctcgggcgctcctaccctgccccgtctccggtccccccgcgccgtcggcgaggcagccggccgtcacagaagcccgatccggaccccgcgagaaatccttgttatacctgatggctatgattgatgatcctctttatccaattgctgtactgattgacgagctcgagaatgaagacatccagttgcgtctaaactccattagaagactttcaacaattgcacgggctcttggacaaaaaagaagcagggaaagactgattccctttcttccccccaaccacgatgatgaagaccaagtggcttcttgcaatgggtgaagaaattggggggggttcaatccccgcatgttgggcggtgaagaaaaatgctcgcggctttggacccccccccttgggagaaaattgttgaacggggggaagaaaaacttgtgtcccgtgggaaaaagcatttggaatctcctggtgcccgttttttggtgccccgaaatggaaaggcacaaccgaacaattgtttcccaacatggtggcccctcccccccttttgtaaaaagagggcctacacaaacctgggggaggaggggggggttttatatagccttcgccgtgtttcggggccaacggtggggtgccttttttccatcctatggcccctaatccaaaagggctctttcggaaacccaccttttaaaaactcgcactggggcggggccttatccttcgggcaaaccctaggtcccgggataaagaattgccctattgctccagaaaagagaacctctcctctaatatttgtgaaaaagtttggcgcctacactttgaacaaaattcctttgaagaaaaaaaaaatgggcactttttggtagagtctccccacgaggctaaaattccgagcgcccttcgtcttgtaagaccccccccccttggaaattttggaaccccaaatgggtcn

SEQ ID NO: 90965 - protein, 68 aa, Zea mays
  misc_feature: Ceres CLONE 1579071
MAMIDDPLYPIAVLIDELENEDIQLRLNSIRRLSTIARALGQKRSRERLIPFLPPNHDDEDQVASCNG

SEQ ID NO: 90966 - DNA, 905 bp, Zea mays
  misc_feature: Ceres CLONE 1579075
  misc_feature (905)..(905): n is a, c, t, g, unknown, or other
ctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaaattgaacttcagcaccgcttcggcgacccccgacaagtacaagagcttcatcgcttctgttcgtgctggcttggtgagcaaagcgggggggctcagcagcgggatccccgtgctggtcgacgaagactacccgctcgcgctcgaatcgtttctaaacatcactcctgtgaaaaaggcagggcgctccgtaagctgaaaatgggatgtatccagagcctacttcgtggctttactagcaagggaccgctccggccctcctcaaggaataaggcccaccgttcccgtcggggattttgtactcgggggcccgtgaggaacaagttcgggccctgtgtccaccgaaccgggtccactcccaggggaaataaacctctttttccgggaaagggaaagggaaagtccctgggggcccccttgggaaaaaaaaaaatcctcaaaagcctctttgcgccgttttcggttccccccgggaaccccccccaaaaagaatttaagggggggtccccccccccgaaaaatagtgggggaaaaacggaaaatttcccccttttttaggggggtataaaccccccttttttgagaaaacacn

SEQ ID NO: 90967 - DNA, 923 bp, Zea mays
  misc_feature: Ceres CLONE 1579079
  misc_feature: Translation starting site: 612
  misc_feature: SWISSPROT Homolog: EC 4.1.1.49 Phosphoenolpyruvate carboxykinase (ATP)
ccccgcggtggcggccgctctagaactagtggatcccccgggctgcaggaattcgtctcacccctagaaaaaacgacagctcggcgccggtgcgcgcgcagaccatcgacgagctgcactcgctgcagcggaagcggtcggcgccaaccacgcccatcaaggacggcgccgcctcgaccttcgccgccgcgctctccgaggaggagcgccacaggcagcagctgcagtccatcagcgcgtcgttggcgtctctgacacgtgaaaccgggccgaaagtggtcaagggcgacccggcccggaggggcgaggcccccgcgacgggtgcaccgccgacgccacaggcgcaccaccagcaccaccaccccgccgcccccaccatcgccgtcagcgacagctccctcaagttcacccatgtcctctacaacctctcgcctgctgagctgtacgagcaggccatcaagtacgagaaggggtcgttcatcacgtctaccggcgcgctggcgacgctgtccggcgccaagaccgggcggtcgcccagggacaagcgcgtcgtcaaggacgaggtcgcggcgcgggacctgtggtggggcaagggctcgcccaacatcgagatggacgagcacacgttcctgaccaacagggagagggccgtggactacctcaactccctggacaaagtgttcgtgaacgacccagtccctcactgggaccccgagaaccggatcaggtccgcatcatctccgccagggcgtaccactcccctctcatgcacaatatgtgcatcccgcccacggacgaagagctggagagcttcggcacgccggaactttcacatctacacgccgggcagttcccctgtaacgctacacgcactaaatgacgtcgtccacagcgtagaatcaactcggcagggagggagaggg

SEQ ID NO: 90968 - DNA, 1333 bp, Zea mays
  misc_feature: Ceres CLONE 1579080
  misc_feature: Encodes the peptide sequence at SEQ ID NO. 90969
  misc_feature (932)..(932): n is a, c, t, g, unknown, or other
cagccgggcgcgagcgggtaggcgaaaatcataaaataatcgatataaaggagaggaagaacgcttaggggtttgcagagctggggctcaccgcggtggcggccgctctaaactagtggatcccccgggctgcattgattcgtctcacccctagaaaaagctattcgtgtcctggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcactgagctgctgatccgcacgctgctcttccagcgcctggtgcgcgagatcgcgcatgactccaagacaggacctccgggttcccgaagccacgccggggctggcgactccagggaggccggccgaaggcctaacctgggccggtactcggtaaaggaacaccaaacctaatgggagcctattcaaagctcaaagcgcgcggtgcgcccgtttaatggcccaaagggagcacttccagagacttcggctcccggcccgggcaaatcccgtggggaggcaaagcaccgccgcccgaatacctcccacatataaaaccacgcccggcgggggagaatccccgcgaaagtataaaaacgcgctcttatgaaggcgagactttccggaaaagtacagacagaagagaaaagggggccaatagtgaagaaactctaataacgcccgccccccccccttctgtgtgttcatctcgcgggtaggggcaaatggttttatgcaacgcatnatgcgactgtgtcgcgaggaagaacgccacgcgcgcggtctagctgtgaaaaaaatgtcgcggacaaagagaagtaccagacctccgctcgtgtatgtcttctttgatcagaccgaccgccagcatagcgtgctgtgggctcccaacgcacgtggagtttttatgtcgacacacccctgcccgccggaggtgatgacacgtgcccccgccgatcactcatcggggaaaagaatttggcagcacttgattcgcgggcgcgcgcaccgcgtcgtgtaatatacttcgtaaacgacattgatgtgtgtggggacgcgctgagcataagcaatgtaggagggatagtaactacgccatccgcatattatcatatcgccacgaatcacaccgaaacgtatgtgtcg

SEQ ID NO: 90969 - protein, 114 aa, Zea mays
  misc_feature: Ceres CLONE 1579080
MARTKQTARKSTGGKAPRKQLATKAARKSAPTTGGVKKPHRYRPGTVALREIRKYQKSTELLIRTLLFQRLVREIAHDSKTGPPGSRSHAGAGDSREAGRRPNLGRYSVKEHQT

SEQ ID NO: 90970 - DNA, 942 bp, Zea mays
  misc_feature: Ceres CLONE 1579082
gagctccccgcggtggcggccgctctagaactagtggatcccccgggctgcaggaattcgtctcacccctagaaaaaagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccgcgccgtctctcgtcgccgctgccccgccgcgcgccgccgtccccgtcgccctccgcctccacgcgcgccaagccgcgcccccctcccgcccccaccgacgactcgctggacaacccggatctggggcccttcctcctgaagcaggcgcgcgacgccatgctgtcgggccgagggcgggcggtatgcacggtccgctgtaactttggctgagcgtattcgccgttgggggtagaagcgatatagtctaggggtctaaaagagcccagctgagcctttaggtttgttttgttgtgaatcgggcaataaaaatggaggagagagcaggaagacgacaaaaggaactatccccacatttttccgcccattgaaagtacaatttctcgcttgaccgctatgcggggatcaaatcgtcttatgaatccggaggaataaatcgctacttaaaaaggtccagcctttagaagaatattttttctcaggggtcacacgttatttatcctacccggttccggcctcccgctttatttcgtgtcgcgatttttacgcacgaaatgctgcgagtagacgagcatgtccgccctgttaacaatggagaaacagacgccacatggctgaccctgatataggccggcaattggggagggaaaagtcgggaagaagcaagagccgagggaggccgaccgagaaag

SEQ ID NO: 90971 - DNA, 1208 bp, Zea mays
  misc_feature: Ceres CLONE 1579083
  misc_feature: Encodes the peptide sequence at SEQ ID NO. 90972
  misc_feature (69)..(69): n is a, c, t, g, unknown, or other
  misc_feature (847)..(847): n is a, c, t, g, unknown, or other
ccctatctccatcgcaatgccggccagatggatgcaatacatttaaccggaataaggcccccttaattnttcagactggagctccccgcggtggcggccgctctagaatagtggatcccccgggctgcatgaattcgtctcacccctagaaaaagagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcacgagcacgatccgacgactgagggagcagactgaagcatgatataggtctttatactattgggggtgttcctgtagttgcctcatggacccgcaggtatgaggggggcctttatcacagtgtgatatgatggaaagtccctgatactgggctttatttttcccaagaaacatggctaccttaataatttgaggggggaggggctcctagggggttttcatagggcttgggcgtgccgttttgaaaaagtgtgccccacttcgggggttaaatcggtgtcctgtgaacatccttgaatacagaaatgcgaataaccatctccgaatttccccagtggtggcgccaagcagactatacctttttctttccggtnttctttaatagagcgttctccaaggtaggggaaatggcccccccccttatctccctgtacgccaggtgtctaaagggggttttgccttggagcacagggattggcgcctccccggcagggttccacactcttttgtaagacgcgcccccttcccgttttcgcacccccggagaaggggggttcgcccaccaggggcgcccacgcgcataaaccccccataaagaccgcctactgtatattgtgtaacacaggtgcaacaggggcgcatgtagacgccgtgccccccgcgtgtggggggaacgaagccggcttttcgttttctcccccgttggacccttatgctaataacccgacgaatggt

SEQ ID NO: 90972 - protein, 92 aa, Zea mays
  misc_feature: Ceres CLONE 1579083
  misc_feature (2)..(91): Pfam Name: Ribosomal_L37ae Pfam Description: Ribosomal L37ae protein family
MTKRTKKAGIVGKYGTRYGASLRKQIKKMEVSQHSKYFCEFCGKFAVKRKAVGIWGCKDCGKVKAGGAYTMNTASAVTVTSTIRRLREQTEA

SEQ ID NO: 90973 - DNA, 1166 bp, Zea mays
  misc_feature: Ceres CLONE 1579085
  misc_feature (1085)..(1085): n is a, c, t, g, unknown, or other
  misc_feature (1166)..(1166): n is a, c, t, g, unknown, or other
cacccgacactaacctttataacattggatatataatcacaacggcccgcagtccccatgaggcaaggtgtgtttaaaactggaactccacccggtggcggcccttttctaacattggatcccccgggctgttttaattcgtctcacccctagaaaaactgcaagcagaggtgtgctctgctgacagattttgaactcaagaggaggcgaggcagaaccgcaatcgcgaccgcgacccgcaggtgacatacatacggtgcgagcgccggcagccggaagcaccggtgacgaagccttccgtgtcatcaagatcgcaggcttttgtttcgtttctcaggcgacgggaatccacccgtggatccgtaagatcctcattcaccgggatgtggcggccatcacgcatggcgggcactatgcacaccacctcttccctccccaggcgcgggcagcctgcgcccggtcccgagatataaaacccgatgccccccccccaaattcccagtttgccatcttatgaaattctccgatcccacaccccctttttatacacaaaagtccccccaataaccccggaggggcacttcgccgttaacaccccagtgaccggccgaaattaaaaaaaaaaaaaccatcattcctaccggctgccggccaatcttccctgtgagaaggaagatattgtgagggacttaatatgggacaccttgtgcccccgctcggttaaacacacccctttcggtgtctgaaaaatattaactcctactctcagcccctctgtctaacacattcccctcaaccccccacacaaaaaattcaccgcacgcaaccatattacaaaccccccaggtaaatcatcctaaaaataggcaactgaagtgtaacttcagttataagagaatccgctgttaggccgggagctaactacgtgcgattgacaatcaaacggtagcacggcaattgatgggccgaggcgcccatcttcttagacccacacattctcctatgcttatattcttatatataaataaaagcaaccggtaagggactcaggacatggtgttcaccaaatatgcccatatttgtantaaattcgcgcagccagtggcgatatagtctctcacaaacaccggcgaaaaacccccacgtacaacgcgtcaacactaaan

SEQ ID NO: 90974 - DNA, 1333 bp, Zea mays
  misc_feature: Ceres CLONE 1579088
  misc_feature: Encodes the peptide sequence at SEQ ID NO. 90975
  misc_feature (985)..(985): n is a, c, t, g, unknown, or other
  misc_feature (986)..(986): n is a, c, t, g, unknown, or other
  misc_feature (1237)..(1237): n is a, c, t, g, unknown, or other
  misc_feature (1275)..(1275): n is a, c, t, g, unknown, or other
  misc_feature (1302)..(1302): n is a, c, t, g, unknown, or other
ttttttttcctttcgttttcggacggttctttaggtctcgtcgtcacgccgaggcacaaccccaaataagatattcgacaagctgcagctcacggcggtggcggccgctctagaactagtggatctcccgggctgcaggaattcgtctcacccctagaaaaagcccgttttctcctgaaaacagaaggctccggcctccggcatccgccaaaaaggggaaaaaaaggagagagaacacacacacacacaaaccccaatcccctgcggcggcgatggacccgtcatcggcgggctccggcggcaactccctcccgtccgtcggccccgacgggcagaagcggcgcgtgtgctacttctacgacccggatgtgggcaactactactacgggcagggccatccgatgaagccgcaccgcatccggatgacgcactcgctgctggcgcgctacggcctcctcaaccagatgcaggtgtaccgccccaacccggcccacgaccgcgaccttctgccgcttccacgccgaaccaactaaccatcaacttccctgcacatccgttcacgctcgagagaacgcaagcagggacctagaatcccgacccatggcttcaaagccgccttcaaatcgtttgggcggaaaggaaacttggcccccgggttcttttccaaaggggggccttccataaaagacctttctcgggcccagaagaaacacaacatgtggacgggggtattggccactacccccggtatctacggaacgcgagggggggagctccactattttcaaaagtgtattctctctacatcactctaactccgtggggcgcctcccaatcccggtaagacaatgatttctcctctctccaacatatgtttccgcaaaaaaaatttctgtggggttttcccgcgggcggggcgggtggagggctccctattgtgtccaaggcatcttatatgcagcgcgatctcgaaattgaaaaactnnatctgtgttccttctatagacgcgcatactatcgcctggcgtggggcgtttagtctatctggcgacatgaaaacatgttatcacaaaatcatcataaattattactcatccgttactgtctctctttaaccttccaaaatattaactattcgcacaaggctcgttgtgcgcttttatgtgatgccctcgatcacacacaacgaataggatgaaagaatactccctctgtgcttacatgtggttgtcacacntatgctaacagcttgaatgaattcaccacgcacagcgncgggcatgagtaaagtgagaaaatganggaacaggagaagaaggtattttatctctgc

SEQ ID NO: 90975 - protein, 86 aa, Zea mays
  misc_feature: Ceres CLONE 1579088
MDPSSAGSGGNSLPSVGPDGQKRRVCYFYDPDVGNYYYGQGHPMKPHRIRMTHSLLARYGLLNQMQVYRPNPAHDRDLLPLPRRTN

SEQ ID NO: 90976 - DNA, 855 bp, Zea mays
  misc_feature: Ceres CLONE 1579090
  misc_feature: Encodes the peptide sequence at SEQ ID NO. 90977
ctggagctccccgcggtggcggccgctctagaactagtggatcccccgggctgcaggaattcgtctcacccctagaaaaaagccgctactccctccctgcctctccacgatctcgcgaaccctgctagatccttgactcgccatgtccaacccctggggcggcatcgttggtgccggcgtgtgggcgctggacgccgagcgcgctgaggaggaggagcgcgacgcagccgcggctcccgtccccgcccccgcccccgccgcgggcttccccagcctccgcgaggccgcagcgggcgccgccggcaagtccaagaagaagaacaaaggaacaacgctctcgctctcggagttcgccgggttcggcccggggcggcggcaagcgccggcgccgccggagcccaggggcctcaccacggcggagatgatgatgctgcccacgggccccagggagcggtccgcggacgagctcgatcggccccgtggcctgggcggcggcttccgctcctacggctccggagaccgtggcggcgggtttgacgacgacggccgccgcgggccgcccggcaggggctcggatctcgacatgccctcccgcgccgacgaggaacgcgactggtccatgagcaagaagtcgttcacgccctcttccgccgactccggctcgcggagccggtacgtggccctccgggagtggcgcgcccgccgtccgtcggccgcgcctgacgacgaatggcgactggttcgccgcgggaaaaaaaccgctggccatcagggcccgtggcgctaacccgagcctcggggttccgccgggggggcgggttttccgcggaacttcgcccgtttttgaaccaatta

SEQ ID NO: 90977 - protein, 214 aa, Zea mays
  misc_feature: Ceres CLONE 1579090
  misc_feature (1)..(214): Pfam Name: eIF-4B Pfam Description: Plant specific eukaryotic initiation factor 4B
MSNPWGGIVGAGVWALDAERAEEEERDAAAAPVPAPAPAAGFPSLREAAAGAAGKSKKKNKGTTLSLSEFAGFGPGRRQAPAPPEPRGLTTAEMMMLPTGPRERSADELDRPRGLGGGFRSYGSGDRGGGFDDDGRRGPPGRGSDLDMPSRADEERDWSMSKKSFTPSSADSGSRSRYVALREWRARRPSAAPDDEWRLVRRGKKTAGHQGPWR

SEQ ID NO: 90978 - DNA, 1030 bp, Zea mays
  misc_feature: Ceres CLONE 1579093
aaagctggagctcaccgcggtggcggccgctctagaactagtggatcccccgggctgcaggaattcgtctcacccctagaaaaaactgcaaccgcagtggtcaaacgtgggaaattgaagcggaggaagatagagagaaaaagaggagaccagagagggagagagattgctgcaggtggaggaggcgctggcggcggtgctgtccgcggcggcgggccacgcggagccgcacgccgtgccgctgcagggcgcgctcgggctcgtcctcgcggaggacgtctgcgcgcccgatccgctccctcccttccgcgcctccatcaaggacggatacgccgtcgtggcctccgatgggccaggggagtatcctgtggtcacggagtccgaggcgggcgactacgccctcggtgtggtcgtcgtccccggcacggtctccttcctcacccccggatggcccgtttcctatgggcgcctaatcccttcctggcacgttggaggacacctatactgttccccctgccccggacccgcatcggtcccaatcacggctttcgcattcctttgggcttggcccttcccaggggaataggtcttttctctctgttgttgcggctcggtttccgcctctgccgtaagggctttccgcgtttttgtctcttcctgccttctggctcccgctccttgttgcttctcccttgtccggttaatctcccgccccacccgttcggccatataggtggttgtgtttagccgtcgttgtgtacccccctcggtcctccccttcttcttcccactttttctgccgctttttttcttcgtccacgacttctttatttctttgtccgtctcctcctctggcgtttggtttgttatctgcccctcccccttctgcgcgccatacgtgctacttatttattgcgtccccgtctgttttgcaagtgggggtcattcgtggctcctctctctggtcgtcttatttgttccctcctctgtctgtcctgcctcttcctgtttgcgcgcgcctctattcgct

SEQ ID NO: 90979 - DNA, 1323 bp, Zea mays
  misc_feature: Ceres CLONE 1579095
  misc_feature: Encodes the peptide sequence at SEQ ID NO. 90980
  misc_feature (1042)..(1042): n is a, c, t, g, unknown, or other
  misc_feature (1283)..(1283): n is a, c, t, g, unknown, or other
gtggggggtcttgtggggttgggggggtgatgataggtattatacgcacgagccgctgcggtctttttttccaaactggagctccccgcggtggcggccgctctagaactagtggatcccccgggctgcatgaattcgtctcacccctagaaaaatcagccactccgcgagaagttctagtcatcacacacaccaatggcgccctccgctccccggctggtcgccggagctctcgtgatcctggctgctgtagctctggcccgtccaaacgccgagcaacagagccccggtcgctacaatgtcgccgacgcgatcgcgatgggctcaggtcagcatcgtcatcatcaggggcggacaccaccatgccatgtgtcgcctccgcctgtgtcgccgacgccagtgtcctggtcaccaagatcggcgtagagaaacaccagagcaggcaccaattggccctgaaagggtggaggaacggcgcccccccccccccgttgcagcgccaggcactaagagggaaccgacatagatggagcgatatccggcgcgcctcgccaggtattgggtgcaatctaaggggagatccagcgtatgggggagggataaaggaaaaggtgcccgaagaaacgttgcgtaggcagccgccaccccacacggctcccgcggagatgcaccaagtgggaaactagggctacggatgaaagagtaaatgatggtcgttcgtaagggggtgctattgtgtatattatgttatactaataacaatattaggaaaataacaaggaggaaagacatgctatcctgttctagggatggggctttcgcggtgttcccgccgacctatctttgtaaaccgctctaaaacgcctcgccactcataatacgcgagggagcatagttgatatgttatctacggtctgcgtgtccgcgcacctcgacaattataccgccgcgcctcataggagaaaaagaagaccttggcccacgaacgcaagacttttgctgggctgtattcgtgtaatatggtaaggtgtcttctcaagtncttggaaccaatactaggtagacggacagcgacgctcggcgacgcgaagaagtcgatcgaattatcaaacatcccaccatcaacctgcgcgccgtggggcttgagggggtgagagagtgggcgtccccatcggagtggtgtgcattttcgcgtgtgcggggcatggccgcacgacgccgataggcttcagtggtgtggaatgtcattattacgtagcgtacatccttgagcttatcggagncgatcagaccgtagacgaacggcgccatcatgaatgcgcg

SEQ ID NO: 90980 - protein, 76 aa, Zea mays
  misc_feature: Ceres CLONE 1579095
MAPSAPRLVAGALVILAAVALARPNAEQQSPGRYNVADAIAMGSGQHRHHQGRTPPCHVSPPPVSPTPVSWSPRSA

SEQ ID NO: 90981 - DNA, 1059 bp, Zea mays
  misc_feature: Ceres CLONE 1579100
  misc_feature: Encodes the peptide sequence at SEQ ID NO. 90982
  misc_feature (46)..(46): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
aaaaaattcggggtgagcgtttcgttttcgggtgtgacacaaacgntgttgggttatagaacccccttanntnnnccaaagctggagctccccgcggtggcggccgctctagaactagtggatcccccgggctgcaggaattcgtctcacccctagaaaaactcacacaccatcgaaacacaaaccagcagcaggcagagcaacgactagctgccaggcaagccggccggggtgctagcaagagtgcaacaatggccaccgcgctctccttcaaggccttggcactggccgcgctcctctccgtggtcgtcacctctggcgctcgcgccgagcaacagctcaagcgcaacgcaaccaccgcctcgcaggacagatccttgttgtcctacagcagtggctggctgccggccaaggccacctggtacggcgcccccaccggcgccggccccgacgacaacggtggtgcgtgcgggttcaagggcaccaaccagtacccgttctcgtccatgacgtcctgtggcaacgagcccatcttcaaggacggcaagggctgccgctcatgctaccagatacggttgcctgaagaagcaaccacccgggcctgcctccgggcgtgggcgcagaagggtgaatcatcacgggacatgtaacctactaccccgggtgggcccaagtacccacttttggaccctggaagccgggcaccggccgttttcgggggtcccaacggggctccagcctggggggggccttcgaaacggaacaaaaggctttccgggcaccgccccgggggaatccattccgagcaatggcaaggtttcaagggcgggggggggcccgaagtgcaaacctatctcccggggggcctggaaccgaataaacccctatcccgggcgttccctaggaacgggggttacacaaacccaccatggttaaccctgggcgcgcgggcctttattctaatgccacgtgaaaaaacaaagggaatggtggagaccgagggtgtggtaaggggggggaaattctatttgcgaaaaaaaaaatttgggggggcgacgg

SEQ ID NO: 90982 - protein, 132 aa, Zea mays
  misc_feature: Ceres CLONE 1579100
MATALSFKALALAALLSVVVTSGARAEQQLKRNATTASQDRSLLSYSSGWLPAKATWYGAPTGAGPDDNGGACGFKGTNQYPFSSMTSCGNEPIFKDGKGCRSCYQIRLPEEATTRACLRAWAQKGESSRDM

SEQ ID NO: 90983 - DNA, 913 bp, Zea mays
  misc_feature: Ceres CLONE 1579102
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (908)..(908): n is a, c, t, g, unknown, or other
  misc_feature (910)..(910): n is a, c, t, g, unknown, or other
  misc_feature (911)..(911): n is a, c, t, g, unknown, or other
ctccccgcggtggcggccgccctcgaactagtggatcccccgggctgcatgtattcgtctcacccctagaaaaaacggcagtccgcaccgcacacacacgcacaggcagcagcacagcgatctgccttctgctgtgccccgcccccatccagcccagagcagcagcgcgcggtgccggccggcaaccgcagctggtcggtcatcaggtctctgggcctccacctcctccttccccctctcaaccctccccgtgtcgcctcctcccgaatcctcacacgtagccccgcgcgccacctcgctgccggccgccggcacacagatatagagagagagagagagagactgagagagagagagggaggggaagcgaagagaccagaacacgagcgaaaatggtcggacacctccccaagaccaatgccgtggcggagactgaggtcctcctcgacgcctgggacttcaagggccggtccggcccatgggtcaccaccaggcgctagtggcgccgcacaccttgaatcttaggggcggggaataaaagccctggtgaagaaacatgggtattgcccgggaatctgaaagacggtcctggaaggggaccatggaacctgggggttaccgcgaggtcgtgcaaaccttgatgccccaaatatagtgggggacgttccttttgggtctaagacttccttagatcgggatacctagggggaacaaacggttgctaagggctgcgtactacaccagtgagtaattttatcacgagaccgttccagtgctttaggggttggtgggttcgaagaaaaatttaccggagcggataagtcctgatgcttaaacgctcagtgggtctgttgtgtaccctaaactgggaaaaaggtatgagcctctgagatannnnnnnnnnnaananntg

SEQ ID NO: 90984 - DNA, 874 bp, Zea mays
  misc_feature: Ceres CLONE 1579105
  misc_feature: Encodes the peptide sequence at SEQ ID NO. 90985
aaagctggagctccccgcggtggcggccgctctagaatagtggatcccccgggctgcaggaattcgtctcacccctagaaaaaagcaggcccagctccaaccaccgctcgtctcgtctccttcctcccgtctcgtctccgacgacctcgtctttcccccccagccagcctcgcctcaccgactccccgatccggtccctcccttcgccagctatgcacccctcctccggcgcgggggactacgccccttactacccaccttacccctccccggccgcgccgcctcccgccgcctacccgtcggtgtccgccccggcttccgcgcccccgtactcgtcgtaccccgcggacttcgcccccgcgccttcgtaccccgcgtacccgcccgccgacctcccccactacgcgccgccgccggctgcgcccgcgcccccgcagccgtactacccctacgagccggcgccggcgccgccgctgccgccgtccccgcacaacccggtgccctctccgtacccgtcgctggatcgggcggggagctacggctacgggatcggccctggctccgggtacggccaggagctgtacccgcccaagccggccggcggggggggccgacgacagagcgtacgctttacacggcgggcgacccgcccggagccgtacgggtccagggggccccgcacccgaggcccgggctcgggatcccgcgctgttttgatgaactccggggaggtcccattgggctccagctgcccgaatggggggggtggcccgggggggggcttacctggcgccgtgtcacgagagggggggggggaggcgtttttgacctagggggggagagaagtccaggagggggaggttcgggggaggtg

SEQ ID NO: 90985 - protein, 206 aa, Zea mays
  misc_feature: Ceres CLONE 1579105
MHPSSGAGDYAPYYPPYPSPAAPPPAAYPSVSAPASAPPYSSYPADFAPAPSYPAYPPADLPHYAPPPAAPAPPQPYYPYEPAPAPPLPPSPHNPVPSPYPSLDRAGSYGYGIGPGSGYGQELYPPKPAGGGGRRQSVRFTRRATRPEPYGSRGPRTRGPGSGSRAVLMNSGEVPLGSSCPNGGGGPGGGLPGAVSREGGGEAFLT

SEQ ID NO: 90986 - DNA, 855 bp, Zea mays
  misc_feature: Ceres CLONE 1579106
  misc_feature: Encodes the peptide sequence at SEQ ID NO. 90987
  misc_feature (603)..(603): n is a, c, t, g, unknown, or other
aaagctggagctccccgcggtggcggccgctctagaactagtggatcccccgggctgcaggaattcgtctcacccctagaaaaaatccatctatccatcatcaccagctagcacctcctttcccacgactcccgagcgctctgcgtgtggcgcgcggcagcatggcgactgcgaacgggagcagcaaggggtcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggagacaaggccgacgtcgacctcgccgtcaaggccgcccgggaggccttcgacaacgggccctggcccaggatgacgggatacgtaaggccggaccgaccgcgcgcgtgtgtgtctggcttttgtttggcgccaaaacatttttttaatataaaaaaaacacacacacacacaaccccgcacccgcaggagcgtggtcggatcctccacaggttcgcggaactgatcgacgagcacgtggaggagctggcggcgctggacacggtggacgccggcnagctgttcgccgtgggcaaggcgcgggacatcccgggcgccgcgcacctgctgcgctactacgccggcgcccccgacaggtgcacggcgcgacgctcaagatggcccagcgaatgcacggggtccccgcctcaagaagccccttgggcctggtgggggccacatcgtggccctggaactacccccacccaccctggttctttctttcaaggtaaggggcccccgcccctccccccaaggctggcccccgttc

SEQ ID NO: 90987 - protein, 231 aa, Zea mays
  misc_feature: Ceres CLONE 1579106
  misc_feature (5)..(85): SWISSPROT Homolog: EC 1.2.1.3 Aldehyde dehydrogenase (NAD(+))
  misc_feature (119)..(170): SWISSPROT Homolog: EC 1.2.1.39 Phenylacetaldehyde dehydrogenase
  misc_feature (148)..(148): Xaa is any aa, unknown, or other
MATANGSSKGSFEVPKVEVRFTKLFIDGKFVDAVSGKTFETRDPRTGEVIASIAEGDKADVDLAVKAAREAFDNGPWPRMTGYVRPDRPRACVSGFCLAPKHFFNIKKTHTHTTPHPQERGRILHRFAELIDEHVEELAALDTVDAGXLFAVGKARDIPGAAHLLRYYAGAPDRCTARRSRWPSECTGSPPQEAPWAWWGPHRGPGTTPTHPGSFFQGKGPPPLPPRLAPV

SEQ ID NO: 90988 - DNA, 1265 bp, Zea mays
  misc_feature: Ceres CLONE 1579107
  misc_feature: Encodes the peptide sequence at SEQ ID NO. 90989
  misc_feature (68)..(68): n is a, c, t, g, unknown, or other
  misc_feature (71)..(71): n is a, c, t, g, unknown, or other
  misc_feature (77)..(77): n is a, c, t, g, unknown, or other
  misc_feature (78)..(78): n is a, c, t, g, unknown, or other
  misc_feature (1107)..(1107): n is a, c, t, g, unknown, or other
tgtgtggttttggtggggggtcctacctccctgttttgttttaaatgggtgtgtttattaataaattnccngggggnntaacaaactgggactccccgcgggggcggcctttctagaactagtggatcccccggggctgtttcgaattcgtctcacccctagaaaaaaacgcaactagtctccttcaccggtccgtccattcctccgatccgcaggaggattaggagcttaggatcagggaccggaggagcccgacgaccttctcggtccacccgcccggcgatcgaaccatggggctcggcgagggcggggatcaccgagccaccctgccccgcatcagccgaccaggcgaaacatgccgccgccggtggcatcgtccgaagcgggagcatgttgacggcagcggcacacgtgataacggcggtgatcgggtccggcgtggtgtcacaaccacggaacaaccccccagctggggtgtggtggtggggacccggcggacgtggctcggatatcgggggaaaatcacggacggctgcagggccacgcctgcctgcacccgaaaaggctaagcgagtcggcgcgggaaccccggaaagcagcggagacgaaaaaaacggaagaaggcgtgggagcttaggcgcggaagaacccggtgggaaagccggctagcgcccgaggggtggggaaaagcaaaggtcctccgttagggggagatgggtggcaataagtctcactcagtttatgcacggtgcggaacagaggcgggaaccctcccgtgtttgcgcgcgcgggcgcgtaaaggggggaagagaagagtgcccggcgccgtgtgtctcggtgcccacaatcacatcctcggagcgcgccgtacaccagaaaactgtaattcggttgtacaaatagtgccgcccgtaaaagaaaggcacagtatcgccccccagagggggcgaataggtgccgatggtggtgggaaggtccgttgcgtggagcgaggaggggtgcgtgtgacctcgtggagagagcggggcgcccctttgcccggggcacgtaaataaacgccttttagaaaatacgcaaactcataacgcggagccaacttcgggggcngcttgaaaggggagatggtcacgcgactagagcacgagggatcggggtgggtggaagatggagaggactgcaccgaaaagagccacaacatgcgcgatatatgatgagtcgagaaaaaaagagtaggcctacgcacagaggggaccagagcgagcggc

SEQ ID NO: 90989 - protein, 92 aa, Zea mays
  misc_feature: Ceres CLONE 1579107
MLTAAAHVITAVIGSGVVSQPRNNPPAGVWWWGPGGRGSDIGGKSRTAAGPRLPAPEKAKRVGAGTPESSGDEKNGRRRGSLGAEEPGGKAG

SEQ ID NO: 90990 - DNA, 857 bp, Zea mays
  misc_feature: Ceres CLONE 1579110
  misc_feature: Encodes the peptide sequence at SEQ ID NO. 90991
ggagctccccgcggtggcggccgctctagaactagtggatcccccgggctgcaggaattcgtctcacccctagaaaaaacaccgcgcgtccggatttggctgagtagctgactagctgagcgagcaatccatcccttcgcccgccgcaccatggaagccctcgcctcggcgcctcgggcgctcttcccgcgcgcgtgcccagtcgcgacgccggccggcccggcccggcgccgcaccgccgctcctcacatctgcagggcctccgcggcggctggggaggagacgccgccgccgccggccgctcccaagaagatcctcaagaagaagcccgtctactcgatgaagaaagggcagattgtgcgcgtggacaaggagaagtacctgaacagcatcaattatctgtcagttggacacccgcccttctacaaggggctggactacatataccaagaccgcggcgaggtcttggatatcaggaacttcgaaacaggagaatacgccctgatcgcttgggtggggatcccgacgccaccggcatggctaccaacctacatgctcatcaagtcggacaagctcgactacgagaggatatgatggccggccggccggccggccggcggccttgcagggcaccgtagcgccgccgccgaaatcatgcttcatttcgcatcaggagtcggccaatcaggacgcaccttggtgttgacttggttgtaggtatatacgtacatgccagtatttgccagaacagtcgacagaggcaaatctgagacctccggctgctgggaataaataaggaagtaggatcgagagccgacctaccgatggaccaagaattcctaattgccgggcggccc

SEQ ID NO: 90991 - protein, 147 aa, Zea mays; identical to SEQ ID NO: 65916
  misc_feature: Ceres CLONE 1579110

SEQ ID NO: 90992 - DNA, 809 bp, Zea mays
  misc_feature: Ceres CLONE 1579112
  misc_feature: Translation starting site: 95
  misc_feature: SWISSPROT Homolog: EC 1.3.3.4 Protoporphyrinogen oxidase
  misc_feature (412)..(412): n is a, c, t, g, unknown, or other
  misc_feature (532)..(532): n is a, c, t, g, unknown, or other
ctggagctccccgcggtggcggccgctctagaatagtggatcccccgggctgcaggaattcgtctcacccctagaaaaagcaacgccgccggaaatggtcgccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcgtactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctnctgggaggagggtcccaacagcttccagccctccgaccccgttctcaccatggccgtggacagcggactgaaggatgacttggtttttggggacccaaacgcgccgcgtttcgtgctgtngggaggggaagctgaggcccgtgccatccaagcccgccgacctcccgttcttcgatctcatgagcatcccagggaagctcagggccggtctaggcgcgcttggcatccgcccgcctcctcaggccgcgaagagtcagtggaggagttcgtgcgccgcaacctcggtgctgaagtctttgagcgcctcattgagcctttctgctcaggtgtctatgctgggaccaccgagcgtgaggggaaggtttggccatcgagacaccgcctcaagatgtcagtt

SEQ ID NO: 90993 - DNA, 896 bp, Zea mays
  misc_feature: Ceres CLONE 1579120
  misc_feature: Encodes the peptide sequence at SEQ ID NO. 90994
  misc_feature (896)..(896): n is a, c, t, g, unknown, or other
ctccccgcggtggcggccgctctagaactagtggatcccccgggctgcaggaattcgtctcacccctagaaaaagggtctccgacaatggcggcgctagctccatccaagattctgggcacccagctcaacttcgcgggctcctcccgctacgccaccgcagcgcccaccgcgggggctcagaagattgtctcccttttcagcaagaagcctgcccagaagcccaagcccgctgcggtatcgtcctcttctccagacatcagcgacgagctcgccaagtggtatggtcctgacaggaggatctacctgccggatgggctgttggaccggtcggaggtgccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcctgcaacaagttcggcgctaactgtggccctgaggctgtctggttcaagaccggggcgctgctcctgggacgggaacaccctcaactacttcgggcacagcatccccatcaaccggtggtgggccggaatccggaaggcaatcctcctcgggggggccgaattattaccggatccccaccggacggaacctaaaggaacaagcggcacccccgggggggcccctttgaccccccgggggcctgggccagggaacccccgaacagaggcgccctttcctcaaggggtaaagggaaaataaaaaaaagggcccggggggggcaagtggtcccccacggtgttccgccttttttttatccacgggtcccttatttttaccccggggaaaaaagcccccccgggggn

SEQ ID NO: 90994 - protein, 199 aa, Zea mays
  misc_feature: Ceres CLONE 1579120
  misc_feature (83)..(200): Pfam Name: Chloroa_b-bind Pfam Description: Chlorophyll A-B binding protein
MAALAPSKILGTQLNFAGSSRYATAAPTAGAQKIVSLFSKKPAQKPKPAAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLGREHPQLLRAQHPHQPVVGRNPEGNPPRGGRIITGSPPDGT

SEQ ID NO: 90995 - DNA, 824 bp, Zea mays
  misc_feature: Ceres CLONE 1579122
  misc_feature: Encodes the peptide sequence at SEQ ID NO. 90996
  misc_feature (626)..(626): n is a, c, t, g, unknown, or other
  misc_feature (747)..(747): n is a, c, t, g, unknown, or other
  misc_feature (815)..(815): n is a, c, t, g, unknown, or other
ctccccgcggtggcggccgctctagaactagtggatcccccgggctgcaggaattcgtctcacccctagaaaaactcacctctctcgaaactttccccaatcccatctcctgcccccctctcccaaccctatccacgccgccgccagccctgctcgggtggtgcgcatacatgaaccatccgtcctcgtcttcgtcctccgcccagccgccgccagccccggcggcggcggccgaggccacctccctcgcgccgggcttccgcttccaccccaccgacgaggagctcgtctcctactacctcaagcgcaaggtcctcggccgcccgctcaaggttgatgccatcgccgatgtggacctttacaagctcgagccctgggacctgcccgcccgctcccgcctccgctcccgcgactcccagtggtacttcttcagccgcctcgaccgcaagcacgccaaccgcgcccgcaccaaccgcgccacgtcgggagggtactggaagaccaccgggaaggacagggaggtgcgccatgggcccaggcttgtcgggatgaagaagacgctcgtattccacgcgggacgcgcccccaagggcgaacgcaccaactgggtcatgcacgaataccgnctcgagggcgacgacgccgcagggataccgcagtgaaaatggacatgggcagattgtaacgcgaattgtaaacaaaggggctagctttacttcttgacgccactgattaaagctggaccangtcctcggaatggcgcacagtatggagcacccttcgttgaggagggaatggggagaggatgacccccnatgatggtt

SEQ ID NO: 90996 - protein, 163 aa, Zea mays
  misc_feature: Ceres CLONE 1579122
  misc_feature (26)..(154): Pfam Name: NAM Pfam Description: No apical meristem (NAM) protein
MNHPSSSSSSAQPPPAPAAAAEATSLAPGFRFHPTDEELVSYYLKRKVLGRPLKVDAIADVDLYKLEPWDLPARSRLRSRDSQWYFFSRLDRKHANRARTNRATSGGYWKTTGKDREVRHGPRLVGMKKTLVFHAGRAPKGERTNWVMHEYRLEGDDAAGIPQ

SEQ ID NO: 90997 - DNA, 1132 bp, Zea mays
  misc_feature: Ceres CLONE 1579123
  misc_feature: Encodes the peptide sequence at SEQ ID NO. 90998
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (548)..(548): n is a, c, t, g, unknown, or other
  misc_feature (565)..(565): n is a, c, t, g, unknown, or other
  misc_feature (729)..(729): n is a, c, t, g, unknown, or other
tttggggcgttggcggggcgccctttctttcggtcagactccccctcacccggggtagaggtgtttttaaannnnnggaaaactgggactccccgcggtggcggccgctctagaactagtggatcccccgggctgcaggaattcgtctcacccctagaaaaggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcggcgacgtccgcgtgggcgggcgcgtcccccccgaggagccggagccggaggtcttctccttcgccgagcccctcccgtcgtggcccacaggcgggggattcgcgcgggggaggatacgtatcgccagaggggagctggagctcgccgcggccaccgcgttccagaagatctgcaccctgtcgtcgcggacgnccttgggcggccccctnctattgtctacttttctgtcggggccggtcacggcgtccccagtaaaaaacgttctttgtttcccctaatgtggatacacttttacgggaactccagatattgaccccgcgcccctgatcgacgagggggtgcacacgtctttctcccggagttcattcccctngacccccggctcggggcaaattacaatccgtcgctaggccacgcggtatatcctcccttgctatgtccgtacaatagatttggagcggagctgagattgagactaacttaaaagagtggtgattgaacaaggagaccgcaccggcgggtgcatgctctcattatgttcttagaattgtatagttatgcgaacaaatcttcccctacgttctctccaccattgctacttcaaagtttcttttctatacgcttttaggtccttactatctaccgacacttgttagaggcaccctatctgtggggattcttaccgcccttgtggtcttgtacataataaaaaatatttgtggccccaccttatatcgatcacttaaatctaatctccatatatatctctccgcgta

SEQ ID NO: 90998 - protein, 103 aa, Zea mays
  misc_feature: Ceres CLONE 1579123
  misc_feature (76)..(76): Xaa is any aa, unknown, or other
MRRRWDSCFSGGDVRVGGRVPPEEPEPEVFSFAEPLPSWPTGGGFARGRIRIARGELELAAATAFQKICTLSSRTXLGGPLLLSTFLSGPVTASPVKNVLCFP

SEQ ID NO: 90999 - DNA, 856 bp, Zea mays
  misc_feature: Ceres CLONE 1579125
  misc_feature: Encodes the peptide sequence at SEQ ID NO. 91000
ctggagctccccgcggtggcggccgctctagaactagtggatcccccgggctgcaggaattcgtctcacccctagaaaaaatgtaaaccacactccactccagcactgaacacttgattgattcagtgggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcggggttccccggagacgatccgcgacccgcgcgggttcgccgtgaagttctacacccgcgagggcaactggggactgctgggcaacaacttccccgtcttcttcatccgcgacggcatcagttccccgacgtgatccacgcgtttcagcccaatcggcggtcgcacgtggcagagtacttggcggggtgttcgacttcctgtcgcatcttcccgagaagctgcacaaccttcttctttcttcttcaaacaactggggcgtgcccgtcccactacggccacaatgaaaggggttcggggtgaaaacccttacccccttccctggaagcccggcggggggaaaggcccaattaacttgaaatttccacctgggaagccc

SEQ ID NO: 91000 - protein, 153 aa, Zea mays
  misc_feature: Ceres CLONE 1579125
  misc_feature (18)..(153): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTHDVTSLTCADFLRAPGVRTPVIVRFSTVIHERGSPETIRDPRGFAVKFYTREGNWGLLGNNFPVFFIRDGISSPT

SEQ ID NO: 91001 - DNA, 868 bp, Zea mays
  misc_feature: Ceres CLONE 1579126
  misc_feature: Encodes the peptide sequence at SEQ ID NO. 91002
gagctccccgcggtggcggccgctctagaactagtggatcccccgggctgcaggaattcgtctcacccctagaaaaaagtcggatcctcatactgcaagaaccccccccccccccccctctctctctctttctctctcaacacacacacacacacacacaaaaggaagaagggagcctccaagcagacccctgttgcttcctcagcatgcacgaatcctaactgaggactaggccaacaatacatcgcaatgaagtacatgaagctcggttcaaaacctgatacgttctataccgaagaagcagtcaggtcagtcgtatcagacatacccgccgatctcattatccatgtaaataacaccaagtatcagctacacaagttccccctgctcctcaagtgcggcctcctgcagcgcctctgctccgacaccgacgacggcgatgaggagccggtgcccgtggcgctgcacgacatccctggcggcgagcaggcctttgagctgtgcgccaagttctgctacggcatctccatcagcatcagcgccgggaaactggtgcccgcgatgctggcggcgcgcttcctccggatgacggaggccgtcgccaagggcaacctggtggccaaagctcgagaacttcttcgactcctgcgtcctgcagggctgaaaggactcggtcgccgcgctgcaagcggcgtggcggatcttccgctggaaagagaaccgcaatcgtaacgccctgcaatcgactccatcgtcgaagagaatcttcttgcccacgtcccaagttcacgtgggtccctaccccttaaaccaagggcccggggtaacaccagccccaaggaaaaaccccacccaagtccgttcccca

SEQ ID NO: 91002 - protein, 160 aa, Zea mays
  misc_feature: Ceres CLONE 1579126
MKYMKLGSKPDTFYTEEAVRSVVSDIPADLIIHVNNTKYQLHKFPLLLKCGLLQRLCSDTDDGDEEPVPVALHDIPGGEQAFELCAKFCYGISISISAGKLVPAMLAARFLRMTEAVAKGNLVAKARELLRLLRPAGLKGLGRRAASGVADLPLEREPQS

SEQ ID NO: 91003 - DNA, 1149 bp, Zea mays
  misc_feature: Ceres CLONE 1579128
  misc_feature: Encodes the peptide sequence at SEQ ID NO. 91004
  misc_feature (1)..(1): n is a, c, t, g, unknown, or other
  misc_feature (17)..(17): n is a, c, t, g, unknown, or other
  misc_feature (931)..(931): n is a, c, t, g, unknown, or other
ntttttttttttttaanttttaaaaataatttatattttaaatttttttccttctttttaccaccaccaataaaaactggagctccccgcggtggcggccgctctagaactagtggatcccccgggctgcaggaattcgtctcacccctagaaaaagacccaacccgtttgtgtcgtaggcggtttgcactagcgtttccgtgaggcgggcgaaggcgtccgtgaccgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccgccatgaggcgcggcgcggctggcgcgacgccggacctcgggtccgggctcggccacccaacccccaaacttcgcgatcttctacgcgctcggcaggaaagctcggggcaggggcaagttcggcaccccccctacccttctgccaccggaacttcgcccacgggggggaatcgaacttacccccctggcaaaggtccaattcttcaaaagcggcaaagacttcatttcccccaaagggaaggggaagcgttccgaacacaaacgtgtggccgcccccccccgaagaaatatcccaggaatttaatttggggagaaccgaaacccttttttttctcgcgggggcacaaaaaaaaagaaaaaaacgtttccgttcccgcccctatattctaaaaggggggggggcgcggttatccccaaggggaacaccccggggtttttaaccgtttcccaacaaatttctgtttcattggngagaagccttctttggtgtcccccggggggggcgcgaaaaactttctttttcgaaacccgggaaattcataaaaaacgccgcgcggggaaaaacctaaaaacgtcgagagggcgtagagggggcccccccgcgcttttataaaaagggaaatcacacctctctgggggggtcctttttaaaagggcctccgcccattttgtctctcccggggggtaaa

SEQ ID NO: 91004 - protein, 187 aa, Zea mays
  misc_feature: Ceres CLONE 1579128
MGNACSGALRSKYLHSFKHAASQRHDSEYSASASADDSPRKPTPPATTDAHAPAPPAAAMRRGAAGATPDLGSGLGHPTPKLRDLLRARQESSGQGQVRHPPYPSATGTSPTGGNRTYPPGKGPILQKRQRLHFPQREGEAFRTQTCGRPPPKKYPRNLIWGEPKPFFFSRGHKKKEKNVSVPAPIF

SEQ ID NO: 91005 - DNA, 826 bp, Zea mays
  misc_feature: Ceres CLONE 1579132
gagctccccgcggtggcggccgctctagaactagtggatcccccgggctgcaggaattcgtctcacccctagaaaaagcctacctctctctttctctttctctttctctgtacgcgttcgtctctctctctctgcgcgcaacaagtgacgcgtcactgcgccgcacaccaccgagggggatcgccgccgcgcgggagatgagatgagaggagacgtctttctggcgctccttgctgctgccgccgccgccgccgtcatcggcgtcgcggcggcggcggcttccgaggggctgccaacggcgggcggcggaggtggacccgtcgtggcggttcccgagccggcgcctgcgggacgcgtacgtcgcgctgcagacgtggaagcggcaggccatcttctccgacccgagcaacctcaccgccgactgggtcggcccgggggtctgcaactacacgggcgtgtactgcgcgccgctcccctcgggccccgaccgcggcgcgctcgccgtcgccggggtcgacctcaaccacggcgacatcgcgggcttcctcccgcccgagctcggcctcctcgccgacctcgccctgctccacctcaactccaaccgcttctgcggcgtcctcccgcgcgcgctccgccgcctccgcctcctccacgagctcgacctcagcaacaaccgcttcgtcggcccgttcccggacgtcgtgctcgacctccccgcgctccgcttcctcgacctccgcttcaacgacttcgagggcgccgtcccggccccgcctcttcgacgcccgctcgacgccatcttcctcaaccacaaccgcctccgctc

SEQ ID NO: 91006 - DNA, 838 bp, Zea mays
  misc_feature: Ceres CLONE 1579134
gagctccccgcggtggcggccgctctagaactagtggatcccccgggctgcaggaattcgtctcaccccctagaaaaagccacgcccacgcccactaaccacgaccacgaccacgcccactacccacgccgccgacggttccgcccctgcgtactctaggtatcccgtgtccaacggtccacccccaccgcaaccgccgtccgtccgtccgcccgccgccgcaccctgctagggtttcggccaggccggatccgccgccgcctgtagattctcctatccgaccgcggcgcctcgagccgcaccggcaacctcggacctgaatacctgatacactgcacttcttcagtccgcaggaccacagcacgcacaattgttcttcaatctgcaggactgcagccgcgcacaagccgtagctgatagcatcttctttgattgtcatcttttgcatactcttgttgacggtgctatcatattcttgaaaaccttccacgctgtccatctgagcattcttctatctctgcatttgtcccttaacagtcacctgctttgaggttccattttggataccaatggctggattcagtttgagattattaaataacttttggttctagctggtttccgttgttttctttccatcccaacattagccccttggcttcccccaaaatttgttgggttcctgtggctctttttcaaagttttccttgggaacctttgaagcttttgggaaaaaggcccaaggcaaaaacagggaaaatggctggcttccaaaccaaaaattacgcctggaatttgggctcaaaaacaaagaaacaaatttgggaagttttgaata

SEQ ID NO: 91007 - DNA, 840 bp, Zea mays
  misc_feature: Ceres CLONE 1579135
  misc_feature: Translation starting site: 163
  misc_feature: SWISSPROT Homolog: EC 4.1.1.49 Phosphoenolpyruvate carboxykinase (ATP)
  misc_feature (606)..(606): n is a, c, t, g, unknown, or other
ctccccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgaagggcgaggccgccgcgcagggcgcgccatcgacgccgagggcgcaccagcagcaccgccaccccgccgcccccgccatcgccgtcagcgacagctcccctcagttcactcatgtgctncacaacctctcgcctgctgagctgtacgagcaggcccatcagtacgaggaaggggtcgttcatcacgtccaccggcgcgctggcgacgctgtccgggtgcaagaccgggccgtctccagggacaagcgcgtcgtcaaggacgaggcaccccgcaagaccttgtggtgggggcaagggctcgcccaacatctagatgaacgaaaagacgttcctgatcaacaaggaagagggcct

SEQ ID NO: 91008 - DNA, 1212 bp, Zea mays
  misc_feature: Ceres CLONE 1579138
  misc_feature: Encodes the peptide sequence at SEQ ID NO. 91009
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (63)..(63): n is a, c, t, g, unknown, or other
  misc_feature (77)..(77): n is a, c, t, g, unknown, or other
  misc_feature (80)..(80): n is a, c, t, g, unknown, or other
  misc_feature (81)..(81): n is a, c, t, g, unknown, or other
  misc_feature (482)..(482): n is a, c, t, g, unknown, or other
  misc_feature (529)..(529): n is a, c, t, g, unknown, or other
  misc_feature (858)..(858): n is a, c, t, g, unknown, or other
  misc_feature (1212)..(1212): n is a, c, t, g, unknown, or other
ttttnnnnnnnnnnnnnncccccccccaacacaccaaccgccaacccccaagagcgagagagnaaagggggaggggnttnnaggattgggactcccctcggtggcggccgctctagaatagtggatcccccgggctgctggaattcgtctcacccctagaaaaaaattttgcatcgcttcagtaaccaattaacgcaagaaacaggtagtagatcaagtccgattagttgctgatgtcgccgacgaccatgtctctgacgaccacgacgagccgcctgcccatctgccgggcacgggacgtgtccaagcaggcgcctccagctgccaagggcgcgcctcctccgtcgccgtcagacaccaacggttttagcaggaggaggctgctgcggtccgcggcgctgggtttcgggctcggtctcgccaggagagacccagcgcgggcgcgcaccgagacgacgccgccatcacccgcgctggccccngaggaggggacatcgaaacgggatggtcctacttcgcggttccctgnaattaccttcaacgcccaaacgcggtggcggaaaggggggaactttcttcgaagaaacgggaacgggtgggcccggtccgttcgaaacctgagaaaaaaaccccggccccccctgggcgttccgaagaagggggcacccccggggtggccggggggttgccaaacctttcccacggtgccccggggaggggccgccttccccacaagccaaagagaagagcctttgggtgtgcccgcctaaaaaagcccctggcgccgcgagggaaaaaaaaagaggcggggccgccttctccagaaaacactttttcaggaccgagggcgtgggcgcngccccccccgcgtgggggggaaaaaccccccaaacacaccctccggggaggaggctcatatatgggttggtgcgcgctgacaaaaaacgctctcctcatacgcgtgtcaaaaatattttgagagggagttttttaccgagaagataacccgtcttgtgtctactaccagacactctggggggtgtggaaatacctcggagaaagggggctcagggttcccactccacccgaggagagaaacaccccccctgttccccctctcttgttgcgagagggggagagagggccccaaaaacactctccccgtgtttttgagagggttactgagagagaggatccacaaagggggcgaan

SEQ ID NO: 91009 - protein, 173 aa, Zea mays
  misc_feature: Ceres CLONE 1579138
  misc_feature (94)..(94): Xaa is any aa, unknown, or other
MSLTTTTSRLPICRARDVSKQAPPAAKGAPPPSPSDTNGFSRRRLLRSAALGFGLGLARRDPARARTETTPPSPALAPEEGTSKRDGPTSRFPXITFNAQTRWRKGGNFLRRNGNGWARSVRNLRKKPRPPLGVPKKGAPPGWPGGCQTFPTVPRGGAAFPTSQREEPLGVPA

SEQ ID NO: 91010 - DNA, 843 bp, Zea mays
  misc_feature: Ceres CLONE 1579139
  misc_feature: Encodes the peptide sequence at SEQ ID NO. 91011
ctccccgcggtggcggccgctctagaactagtggatcccccgggctgcaggaattcgtctcacccctagaaaaacccccccccaaaaaatccagcagcagcagcaagccccacgcaacattagcagcaggagaccaccccaatcccccacggacattcgtcgcgaacccttatctgcacgccgcgccatggccgcagccgccgcggtcgcccacctctccatccacggccgcctccgccgctcaccggagcatcggccgtccatcaccaccaccaccacctcctcctcttcctcgtccgctcaccgcccgtccctcctgcggtgccgcgcgttcaagcaggaggccggcgacggcgacccggctgaggccgacgcgcggaagcgcaggaagggcccgctgtacaagctcaaggcggcgatccagggcctcgcgggatcccgctccgccgccgccgaggtgtacgggggagagtaccagtaccagcgcgccgtcgagaaggcggaggagatcttcttctcggttgctactcagctaggcagatatgttatcactatgatgagcagcggtgttgtacttggggttgggatccagctgtcaggcggagacagccaaatgaacgaactaatttggtatagctggcctggggggggtgattatcggcacaatgataagtggcaaacagtgtcctaggaggaacactggaaaagctggaaccttcccaatggtccttcattactgggaaaccaccaagaggttttaaggaaaaaacgccttggccccgggagagttttctttcttttcctgggaaaacccgggtgttggtaaatttccctttcccccaa

SEQ ID NO: 91011 - protein, 167 aa, Zea mays
  misc_feature: Ceres CLONE 1579139
MAAAAAVAHLSIHGRLRRSPEHRPSITTTTTSSSSSSAHRPSLLRCRAFKQEAGDGDPAEADARKRRKGPLYKLKAAIQGLAGSRSAAAEVYGGEYQYQRAVEKAEEIFFSVATQLGRYVITMMSSGVVLGVGIQLSGGDSQMNELIWYSWPGGGDYRHNDKWQTVS

SEQ ID NO: 91012 - DNA, 1166 bp, Zea mays
  misc_feature: Ceres CLONE 1579141
  misc_feature: Encodes the peptide sequence at SEQ ID NO. 91013
  misc_feature (1)..(1): n is a, c, t, g, unknown, or other
  misc_feature (24)..(24): n is a, c, t, g, unknown, or other
  misc_feature (51)..(51): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (428)..(428): n is a, c, t, g, unknown, or other
  misc_feature (959)..(959): n is a, c, t, g, unknown, or other
ntttaaaatatttttttttccctncccttttatcccaaacaacacatccantgttggtttatttttannnncaaanntggaactcaccgcggtggcggccgctctagaatagtggatcccccgggctgcaggaattcgtctcacccctagaaaaaacacataagaggcgacatcacatcgcgttccgccgcctcacacgctagttggagctgtagtattagccaaccagccagcctccgatctccatccatatggaggaggctgcgcccgcggcggtcatggagcgggagcgcctcacggccgagatggccttccgcggcgcggacgaagctcggcgggaaggcggcgacccggcgcccagcatcgtcatcaagaatcgccggcgggctcccggacttcgcccgcaacatcaagctcaagtacgtggngctcgggattcgccacggggggcagcccccacgtccctgcttgccggggcttcttcgtggccgggggggtcgccccccccccccctatattgttttcgtcccgccttgaaagtgtatttataaaaattcccgtgagaacttgggttcacccttggggtttccccctgggggtttggggaaccaccgggctttggtgtgtggggtttccccccggtctttaataaaaacccttaaaagagggggcgccccccccgccccgcgcggtgatccccccccccccccaaaatattttccgccgaggtggtcaacaaaaaaaacccccaaaaaaaaaaagacaccgcccctctcacgaagaaaaatatcttctcaacaaaagatgcggggcgcgtcttctcccttccttttgaaaatatacaccccccgagaaaggccccccccgcgggttcctctctttattaaataaaagaggaggggggcctcctcttggggaaaacttctccccaacacaaaccacaagatattttaccaacngtggcccttctttccccgcgctcccctggggggagagaaaaaaaaaaattatattttttttccccccccggggggtggatattaataaggggcggccccccccccccccccgaggataaaaagagtgtggggaagaagaccgcgcaaaaaagagggagccacaagaggggccctattttttttggtgggggcgggaaagacaccccg

SEQ ID NO: 91013 - protein, 99 aa, Zea mays
  misc_feature: Ceres CLONE 1579141
MEEAAPAAVMERERLTAEMAFRGADEARREGGDPAPSIVIKNRRRAPGLRPQHQAQVRGARDSPRGAAPTSLLAGASSWPGGSPPPPLYCFRPALKVYL

SEQ ID NO: 91014 - DNA, 837 bp, Zea mays
  misc_feature: Ceres CLONE 1579143
  misc_feature: Translation starting site: 251
  misc_feature: Pfam Name: Peptidase_M1 Pfam Description: Peptidase family M1
  misc_feature: SWISSPROT Homolog: EC 3.3.2.6 Leukotriene-A(4) hydrolase
  misc_feature (573)..(573): n is a, c, t, g, unknown, or other
  misc_feature (738)..(738): n is a, c, t, g, unknown, or other
  misc_feature (740)..(740): n is a, c, t, g, unknown, or other
  misc_feature (765)..(765): n is a, c, t, g, unknown, or other
ttccccgcggtggcggccgctctagaactagtggatcccccgggctgcaggaattcgtctcacccctagaaaaaagttccttccaagaagagctcaaaaagctttgtctgctcaacctggacgcctcggcctcggcgatccaccggcacggcaccgaaacacctcgtctcgatttcgaaccaaaccctccagtgtccagccccgtctcgttcgccgcggcaggagcgagcgagcgaccgagcgagcagccatggcgccggtcgatccccactcctacaccgacggcgcgcacccggtggtctcgcgcgcggcgctcgccttctacctcgacttcgccgcctccaccatacacgcctccgcggtgctcaccctctccgcgccgcactccggcgacctcctcctcgacacccgcgctctcgccgtccactccgcctccaccgacgccgacccgccggagcccatccccttctccctcgccgcggcgcccgacccggtcctcgggacggcgctgaccctcgccctgccccgcgacaccgcctccttgcggctcaccttctcaacctcccccgccgncctccgcgctgcagtggctggccccgccgcagaccgcctccgcgcagcccttcgtcttctcgcagtgccagtccatccacgcccgctgcgtctttccctgccacgacacccccgccgcgcgcatcaccttctcgctcctcctcaacgtccccgagcaggctctcngncgtcgcccgccgcgcgccaagtcgngcgccgggacccgctgccctccgtaccaccgcggggcgtgcgacgtacgggctctggtgcgcgcccgggcgc

SEQ ID NO: 91015 - DNA, 1303 bp, Zea mays
  misc_feature: Ceres CLONE 1579146
  misc_feature: Encodes the peptide sequence at SEQ ID NO. 91016
  misc_feature (13)..(13): n is a, c, t, g, unknown, or other
  misc_feature (922)..(922): n is a, c, t, g, unknown, or other
  misc_feature (1085)..(1085): n is a, c, t, g, unknown, or other
  misc_feature (1232)..(1232): n is a, c, t, g, unknown, or other
ccggtgtgtcganccgaaacaaacaaactaaatcaatacacgtaagcccacgcgcgccgcgacttaaatcaaaactggagctccccgcgagggcggccgctctagactagtggatcccccgggctgcaggaattcgtctcacccctagaaaaaacactcgtccactcaccccctctttgctctgcctcgtcgcgccgcagagcagagtatggcgtccccacgccctctcctcgccgccgtcttcctcgccgcggcggttctgctcctcctttctccggcagaggccgggacggtgggcgtgaactacggccgcgtggttaataacctgcccaacccaacggcggttgcgcagctgctcaagccagcagggcgtcgcgcatgtgaagctctctatgtcgaccccgcggtgctgcgcgccctcgcgaatatcgggcatccggtggtcggcggtgctttcaatgatgtagcgtgtgagtgcgtggttcccgctctaccctagttgcttcctgcggggttgccccccgacacctttgtcgactttgccccatctggcttgctgatacaatcgggggcgcccgatccgggggaacggaaagaagatatgtagggagggagcaaacgagaaacggacaccgaaataacgtagggggacgcgcggggtaaaggggcgagagacggcttcgcgttaagcgcgggcgtcgggaacctgacggggggccgataacctgcagaataatgtgggggctcctcctatctatcaccgcagcgcaagagccgatccactcgcccatataataccggggatccttatttacctccgctgcaatgtctaatcgctgatttgtctttctatatccccactgtagagtatcgtaagatgcgcacgcgcttggtagagagggggcgatttgccacactcacncccgagtgggtacgcggttaaaagctctcccctaatactcgcgagtgatctcacgtattttattttttaaagacattccgtccaaagaggcgccccgtacaaattattgtcgttgtatggcctccatctgaccccccgcgcggccggatgttgtattatcatntaaccccgcgttttttactcccccagcaaccactcctcgttatcgaattatgatttagatcaaacatctatgccacagtttttagacggcatgcggaatttgaatattcgtcagtcgcgaccgttaatatggatatagttgtcggcnctcgcttctactaaagcgatctattgttggacagttttgtgtacaacacttacatgtatacgcactttaat

SEQ ID NO: 91016 - protein, 96 aa, Zea mays
  misc_feature: Ceres CLONE 1579146
MASPRPLLAAVFLAAAVLLLLSPAEAGTVGVNYGRVVNNLPNPTAVAQLLKPAGRRACEALYVDPAVLRALANIGHPVVGGAFNDVACECVVPALP

SEQ ID NO: 91017 - DNA, 959 bp, Zea mays
  misc_feature: Ceres CLONE 1579147
  misc_feature: Encodes the peptide sequence at SEQ ID NO. 91018
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ncctgtctnnnccatcgttcatgtattcttaagtttcttaggggtttggttgtaagtagnnaaggtttnnnttttaaaactggagctcaccgcggtggcggccgctctagaatagtggatcccccgggctgcaggaattcgtctcacccctagaaaagtaaaagaaaaaccgtccgtccgtccggggaaggagcggtagggaggcggagatgatcgaggtggtgctcaacgaccgcctggggaagaaggtgcgggtcaagtgcaacgaggacgacaccatcggcgacctcaagaagctggtggcggcgcagacggggacgcgccccgagaagatccgcatccagaagtggtacaacatctacaaggaccacatcaccctcaaggactacgaggtccacgacggcatgggcctcgagctctactacaactgagccgccgcccctctctccctctcgtcaggttggtctgaattctgaaatcatgggtgcaattcgcttccgcggtgatctcttaagctcatcacatatataaaagcaacgtcagtgggctatgtaagacattggcgtgccaaactatcaagtgaccactgacagcttttgcatacctttggtgtatgggtcaacctgcaaaacttgggtgttactgcctactccgtacttataaataaacaatagggtttttaaccttttggttggtgggtaaaaaaaaaaggcattcccccaattccaactcccgcattctgaattccggcacttcgggcagcgcggccagcctcccttaggtgttaaggaaggaagggaaaatgggcccctcaacaaaaaaatcgggtctttggctggggcctttgccggtcaatggggggccaaaaaccttttgcccttcaaacattttggcaaaaaaaaaagggttcccccccacttttcggtggtatccaaaagggaacaaaccctcccaaggga

SEQ ID NO: 91018 - protein, 73 aa, Zea mays; identical to SEQ ID NO: 58555
  misc_feature: Ceres CLONE 1579147

SEQ ID NO: 91019 - DNA, 800 bp, Zea mays
  misc_feature: Ceres CLONE 1579150
  misc_feature: Encodes the peptide sequence at SEQ ID NO. 91020
  misc_feature (657)..(657): n is a, c, t, g, unknown, or other
ggagctcaccgcggtggcggccgctctagaactagtggatcccccgggctgcaggaattcgtctcacccctagaaaaaacaccattcgactccacagctggaggctgaagctccgcagtcacagcattcaaatcaatctctctctttctctctctctctcacaggaggtaagccatggcagagttgcctttggcagcggggctgatggaccttcgcaactgcaagctctctccgaagccagcgccgcccttgccactccccgcgctccgccgcatgcacacaagcgccacggctacgacggccccgtccccgcgccatgcggtccccgaactccactccactaccgagctggcggacgggagcatcgtcttccgtttcggccatcctaagtccaaggcgctggagccggagccggcgagcgtaaagaccagcccttactccagagttgcccctgcctcgggcgctgtgcccggcagccagatggagccggagattgactctgaacatggattagacggcgtgcgaataggcaccacggctggggttgagaagccgagcccgaatgccgcagccgaggcctggccgacatctccacctcctgacgccggcgcggtaaccggtgccacttccgctgcgctagaggaggcgccggagcangaggcgggttccaatgctgccgtttgaggaagtggacaccaggccattattccgcagagtctcttgttcccgtcgagatcagaggatgtggccaaaggggcgaccggcgtccgctgttgaaggctgggcaagtcccgaccaac

SEQ ID NO: 91020 - protein, 169 aa, Zea mays
  misc_feature: Ceres CLONE 1579150
  misc_feature (161)..(161): Xaa is any aa, unknown, or other
MAELPLAAGLMDLRNCKLSPKPAPPLPLPALRRMHTSATATTAPSPRHAVPELHSTTELADGSIVFRFGHPKSKALEPEPASVKTSPYSRVAPASGAVPGSQMEPEIDSEHGLDGVRIGTTAGVEKPSPNAAAEAWPTSPPPDAGAVTGATSAALEEAPEXEAGSNAAV

SEQ ID NO: 91021 - DNA, 1026 bp, Zea mays
  misc_feature: Ceres CLONE 1579154
  misc_feature: Encodes the peptide sequence at SEQ ID NO. 91022
  misc_feature (10)..(10): n is a, c, t, g, unknown, or other
  misc_feature (70)..(70): n is a, c, t, g, unknown, or other
  misc_feature (71)..(71): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (864)..(864): n is a, c, t, g, unknown, or other
ccaccggcgncttgcgtgtgccaccaaaactttttgtttagcccgtacccgtttgttgtgggggagaaannttttcaaagctggagctccccgcggtggcggccgctctagaactagtggatcccccgggctgcaggaattcgtctcacccctagaaaaaactgacccaccccacgccgcctcctctcccagtgggtcctccgcatctcccatctcccgtctcccctcttcctcctcccctgcgatctccaccgcatcacctccctcgaaccctagacccacccacgcgcccattgccttcggtcgccatgtccgccgctcagcttctccgtcactcgcgcaagctgcggagtttgcaaaatcctgtaggttgtgagaattttagttttgttcggcatttctccagcggttctgggtcctttatcgccagggaaaatggtattggaaaaagaaccagaggtaccagattttcccagcataaccagcctgcaaaacagctcgagacattctcagcaggagtaaatggaagctgcacatggagaatagcatccaacagccttaccccaagtgctgctagctggctcagtggttcattctcatgtggacaggtagtctcagcacggccattctcaagtagtgcagacctgcctcctccacatcaagaaattgggatgccgtctctttccctacaatgagagctgaagggaaacattggccaaggtgggtttaaaaaagggaagggagacaaaggttctccccctgggggagaggttctcctcagnnnaggggaaaacccgtgacaaaaccccctctgggggaaaatgggaaattgcaatgggaaagaaggggcttatcccttggctnaaagaatttatttccatgggaagaatcggtggccaaaaaggacaatgttaaaaaggtttggtgtgaagaggttcatttttggccttttataactttggttaaaaaagaaaaaaaagggggggagaaccatatcccaaagaaaaaagttttgaaaaaagggaa

SEQ ID NO: 91022 - protein, 128 aa, Zea mays
  misc_feature: Ceres CLONE 1579154
  misc_feature: SWISSPROT Homolog: EC 2.3.1.12 Dihydrolipoyllysine-residue acetyltransferase
MSAAQLLRHSRKLRSLQNPVGCENFSFVRHFSSGSGSFIARENGIGKRTRGTRFSQHNQPAKQLETFSAGVNGSCTWRIASNSLTPSAASWLSGSFSCGQVVSARPFSSSADLPPPHQEIGMPSLSLQ

SEQ ID NO: 91023 - DNA, 786 bp, Zea mays
  misc_feature: Ceres CLONE 1579156
  misc_feature: Encodes the peptide sequence at SEQ ID NO. 91024
ggagctccccgcggtggcggccgctctagaactagtggatcccccgggctgcaggaattcgtctcacccctagaaaaaagccgcacgcttcttgttgccgaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcatcgatttgaatttgatgtactcatggagtctaagggtggcaagaagtctagcggtagtcgttccatgatgtgtgaagctccccttggctacagcattgatgacgttcgacctgccggaggcgtgaagaagttccagtctgctgcttactccaactgcgcgaagaggccatcctgatgtcccttttggcttcctcattctagtagtttaggatttcttttctgacactttgattctgcacaatctctctggcctgctgcttcctgataatcgaccagttccccagtcttgctccgtgcactcctccctcctccatctccagcattgagtgctgattcacctgctccgatggctgttctttctgctgctgatgcttccccgggctcagctatcgggtttggaggctatgagaagcgacttgagatcgctttctctgacgcacctgtctctgtggaccctcatcgcgtgtggcttgcat

SEQ ID NO: 91024 - protein, 50 aa, Zea mays
  misc_feature: Ceres CLONE 1579156
  misc_feature (1)..(50): Pfam Name: AdoMetDC_leader Pfam Description: S-adenosyl-l-methionine decarboxylase leader peptide
MESKGGKKSSGSRSMMCEAPLGYSIDDVRPAGGVKKFQSAAYSNCAKRPS

SEQ ID NO: 91025 - DNA, 1333 bp, Zea mays
  misc_feature: Ceres CLONE 1579158
  misc_feature (14)..(14): n is a, c, t, g, unknown, or other
  misc_feature (15)..(15): n is a, c, t, g, unknown, or other
  misc_feature (1099)..(1099): n is a, c, t, g, unknown, or other
tttttccccccccnnttaccagccaataactcaaataacacccaaaccatctaaataactaaacaaaaacatggactccccgcggtggcggccgctctagactagtggatcccccgggctgcaggaattcgtctcacccctagaaaaaaacctcctcactcctcagactcctctccgcacataccctccctacctcgccgtcgccgtcgcatctgccatgggggcgtacacctacctctcggagttctggggaaggaagcaatcccacgtgatgcggggtccttcaacgcgtgccctgttggggagtacagtgtgggcagcccggcggtcggtttgcctcacttagggccactcccgtctgaacaagggctcgcccggatagcgcgttcaaagccccaggcaaggggtacagttgttctacccgccctccgcgccctaacgcaggtgtgccgcccgaaacaaagccatgggccccacaagggaattagtccccaggaaattagacaaagcaacacaagggccatcctcttcccgagccgcgggttccgtttagaggagctcgacgagatccctacctggccttcaagaacacctgtggcctccgccacaccctccccctagtgcgtaaacccagggacacaaagcctacagagaacacaacggagtgaagagggaggaggcgccaactctacgttgacgcacgagtccgaggtcccatccaacttcctcaccaagttattttttttagtgcggccatacgcactctctagacccccgaggcccaccccaccccgcgctcgccagacggacgctgccactccctgggaggtcggagaggtgaaattgacaggagggagtggagaacaagagcgggagctctaagcggcacgccactttggccagcgcgtgtgactcacacacccgtcgctgtcgggcgcactgggggatggctatgttcctcgactgtgtgtcccctaatacaagctatttcggagatcatgcagaacacacgcgtatggtggattcggcagcagatgagcggagtccatgaatgtctcgccattaagaattgccacaacagactccctcgtgtcgtcgncactcagcgaggaaaaagactctgtggaagcgaaatctgattcaattaacaaaatatggacggatctgtaatgcgagattgggtggccgaatggaacgcctgtctcgtgtgcgaacacacacagacgatgaattcatcccgattatgttacacattaaccgttggagtccgcgctctcgctccgctacccacgcctccaccagccaatgcgggcgtctcacctcgcgcacgcca

SEQ ID NO: 91026 - DNA, 1278 bp, Zea mays
  misc_feature: Ceres CLONE 1579159
  misc_feature: Encodes the peptide sequence at SEQ ID NO. 91027
  misc_feature (1)..(1): n is a, c, t, g, unknown, or other
  misc_feature (11)..(11): n is a, c, t, g, unknown, or other
  misc_feature (16)..(16): n is a, c, t, g, unknown, or other
  misc_feature (18)..(18): n is a, c, t, g, unknown, or other
  misc_feature (55)..(55): n is a, c, t, g, unknown, or other
  misc_feature (70)..(70): n is a, c, t, g, unknown, or other
  misc_feature (997)..(997): n is a, c, t, g, unknown, or other
  misc_feature (1064)..(1064): n is a, c, t, g, unknown, or other
  misc_feature (1225)..(1225): n is a, c, t, g, unknown, or other
  misc_feature (1278)..(1278): n is a, c, t, g, unknown, or other
ntttttttttnttttntnttttttttttgtggttgtcgcttccttttttcttttnctccccgtgtagtgnaatttaattcaaaactggtactccccgcggtggcggccgctctagaactagtggatcccccgggctgcaggaattcgtctcacccctagaaaaaacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgacccccgtccacggcgacgacggcggggcagggtcctcctccaagccccgaaagcgccttctcaagaagggcgggcggtggaggcatggcccggcgatgacgggctggaataacctttggggtgggaggaccaagggaacccggaacccttccgcctgaagggcaaagaaagaaggaaaggggcttcctccgctcccctgaaggtaaccctccacgaaggggggccgggggtcgcggccaggggtaagtaaataaagggctaaaaaaaaaaatgccgcgcaaatgggtgagggataccaaacccggtgtatggggtgggaagggggaaactaactgtggggtacatttggggtggaatgcggtaatatatgaggcgcgggggtgtaaaagatataacgcctctgtggaagaatgggtaaatagagtggagtaatccttcgtatcgtggcgttggggattttgagatgttcacatgtaacatccacacttatgtatgtgataacaatatgtgctactctaaggaatggtgtacactaaactgtctcctttcatgtatatcctagtcctgtggtatatgcttgtcgtgctnatttttcatagatagcttgttatcttctcttttacctctacacacatttataaacttaagttacagncgcaaatattcgcgcccgatgtcctggggcacagagcgtcttgacactctacattgggctccgtcgctgtaaacaaatgcagaagagacgtgagagagttgtgtattagatgggttccccgctacggctcattcggaggactgttgttaaatggcagagtngagtgaaaatgtagaaaatctacatcagataatcacagacacacacacagagn

SEQ ID NO: 91027 - protein, 98 aa, Zea mays
  misc_feature: Ceres CLONE 1579159
MGDNYDDEGEPIVNLDEREPSPEHQPYEDLDDDLDGGGDWTRDRSPTPVHGDDGGAGSSSKPRKRLLKKGGRWRHGPAMTGWNNLWGGRTKGTRNPSA

SEQ ID NO: 91028 - DNA, 872 bp, Zea mays
  misc_feature: Ceres CLONE 1579163
  misc_feature: Encodes the peptide sequence at SEQ ID NO. 91029
aaagctggagctccccgcggtggcggccgctctagaactagtggatcccccgggctgcatgaattcgtctcacccctagaaaaagcaacgccgccggaaatggtcgccgccaccgccaccgccatggccaccgctgcatcgccgctactcaacgggacccgaatacctgcgcggctccgccatcgaggactcagcgtgcgctgcgctgctgtggcgggcggcgcggccgaggcaccggcttccaccggcgcgcggctgtccgcgtactgcgtcgtggtgggcggaggcatcagtggcctctgcaccgcgcaggcgctggccacgcggcacggcgtcggggacgtgcttgtcacggaggcccgcgcccgccccggcggcaacattaccaccgtcgagcgccccgaggaagggtacctctgggaggagggtcccaacagcttccagccctccgaccccgttctcaccatggccgtggacagcggactgaaagatgacttggtttttggggatccaaacgcgccgcgtttcgtgctgtgggaggggaagctgatgcccgtgccatccaagcccgccgacctcccgttcttcgatctcatgaggatcccaaggaagctcaaggccagtctaggcgcgcttggcatccgcccggctactccaggccgccaagaatcaaaggagaagttcgtggcccgcaaccttcggtgctgaagggcttttgagcgcctcaatgaaaccttttctgctcaggtggtctatgcctggggatcccttcctaagcttagccttgaaagggttgcattttgggaaaaggtttgggcgggtgggaaaaaaaacctggaaggtaagtttcttttgggggggaaacccatcaa

SEQ ID NO: 91029 - protein, 202 aa, Zea mays
  misc_feature: Ceres CLONE 1579163
  misc_feature: SWISSPROT Homolog: EC 1.3.3.4 Protoporphyrinogen oxidase
MVAATATAMATAASPLLNGTRIPARLRHRGLSVRCAAVAGGAAEAPASTGARLSAYCVVVGGGISGLCTAQALATRHGVGDVLVTEARARPGGNITTVERPEEGYLWEEGPNSFQPSDPVLTMAVDSGLKDDLVFGDPNAPRFVLWEGKLMPVPSKPADLPFFDLMRIPRKLKASLGALGIRPATPGRQESKEKFVARNLRC

SEQ ID NO: 91030 - DNA, 1109 bp, Zea mays
  misc_feature: Ceres CLONE 1579165
  misc_feature (11)..(11): n is a, c, t, g, unknown, or other
  misc_feature (14)..(14): n is a, c, t, g, unknown, or other
  misc_feature (26)..(26): n is a, c, t, g, unknown, or other
  misc_feature (70)..(70): n is a, c, t, g, unknown, or other
  misc_feature (71)..(71): n is a, c, t, g, unknown, or other
  misc_feature (83)..(83): n is a, c, t, g, unknown, or other
  misc_feature (1109)..(1109): n is a, c, t, g, unknown, or other
ttttttttttnttntttttgttgttnttttttgtggggatttgcgtttttgttttgtgtttttttggtcnncacaggcgtttntctcaaactggtactcacctcggtggcggccgctctagaactagtggatcccccgggctgcttgaattcgtctcacccctagaaaaagcgccgggccagggcgcctctccctcctcccttcgtttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaacagggccttttttctgcggattccagctgccaaacagagatgtccgctctcctcgacctactgatggggatcttccgcccagcagaccctcggcggcgccgccctggaagctggccgcgctgggaggcggccccttctggcgtcgcccgctcttcttcggccttcctcaatcagggtggggcggtggccgcccccaaggttggggcaggggggtccgtcctttccgggggaaccaacaaatggcttcaagccaagggcgggggcggcaggctttccctttaccggcccgacaccggcccggttttggccggcgggggtggggttccccctccagcaaaacgaaagggcggccacccgaccccgttccgtaacccgcaaaagaaacgtgggtgggggggggcgctccctggggcgggccgcttccggaaggggacccaaaacccaggcctggggccgggggtggaccaccacccccggtggaacctcttggaatggcccccccctccttggggcggggctctcgaatctcccagggataataaaggggacgtggggggggcccccccctccctggtgttaactccccactggtgaatggggaaaccggctacctgttggggn

SEQ ID NO: 91031 - DNA, 839 bp, Zea mays
  misc_feature: Ceres CLONE 1579168
  misc_feature: Encodes the peptide sequence at SEQ ID NO. 91032
  misc_feature (567)..(567): n is a, c, t, g, unknown, or other
  misc_feature (723)..(723): n is a, c, t, g, unknown, or other
ctggagctccccgcggtggcggccgctctagaactagtggatcccccgggctgcaggaattcgtctcacccctagaaaaaaaccgggctcgaaagatcgaattctattggtcgagttcggtggagcaacctctcaagtgccacgtgtaccatacgtcgcgaaacatctcgacccaaccgacgccccgcctcttaaaacggcgaccttcctccatggccaaatcgttgtcctcctccgcttccctccaaatccaccctggatccaaccccgattttccccagcagaagcaaacccgagcaaattgagcgcttgcagcttcacccggcgaagcagaatcgaatcggagccgctcgccactccgcgatggggatcctcctccggtccctcctcgtcgcctcgctcgtcctcagttcgctcgtcttgcacgtcgcagcggctaaaactatagatccttacaaggttctaggagttgacaagaatgctagccaacgggatattcagaaagcctttcacaaactttctctaaaataccaccctgacaagaataaagggaagggcgcacagganaaatttgaagaaataaacaatgcatatgagattctatctgatgaagagaagaggaaaaactatgacctctacggggatgagaagggtaaccctgaatttggtggtggaaaatttggaaatcatggggggtctacatacttcactggtggtggcccntagtccagtcaattcacatctggtaatggatggcagacgatgggtggtcaaggaaatacaaaacgttttcattttcatttggtgggtaaactggggccagtggtggaaacccgttg

SEQ ID NO: 91032 - protein, 120 aa, Zea mays
  misc_feature: Ceres CLONE 1579168
  misc_feature (29)..(90): Pfam Name: DnaJ Pfam Description: DnaJ domain
  misc_feature (68)..(68): Xaa is any aa, unknown, or other
MGILLRSLLVASLVLSSLVLHVAAAKTIDPYKVLGVDKNASQRDIQKAFHKLSLKYHPDKNKGKGAQXKFEEINNAYEILSDEEKRKNYDLYGDEKGNPEFGGGKFGNHGGSTYFTGGGP

SEQ ID NO: 91033 - DNA, 802 bp, Zea mays
  misc_feature: Ceres CLONE 1579169
  misc_feature: Encodes the peptide sequence at SEQ ID NO. 91034
ctcacggcggtggcggccgctctagaactagtggatcccccgggctgctggaattcgtctcacccctagaaaaagcccatctttcgtcctccccatcccgtcgtggttgcgcgtcgacgccatcgaccgacgctgcctgcccacttcccccgctcccgtcgcggcttgttagtctcacctggtccatcggcggtccctctcaccgggacgcgaactcctccgcgcttccttccgccgaagcgaagcgctctacccaccttcgtccttctgcactcttctgtacgggcgtgaaacggagatctgtctatgctggcactggtttctgcttcccttggtcagtatttctgcagctaaacagataattcacatttgttgctatcaagttattcgaaaactttttatggttcagagaaacagatattcttcacctagtgggtctgctcattgatggaagacaaccagattttggttcagtcagagcataaccttataccaggtgcgcagacccttgtcattggtcaagagtttgcagatgttgacacatgtcggaaggctgtcaaggacatggccattgctttgcactatgaactccgtgtagtgaaatctgatcgtagccgtttcattgcaaaatgctcataagaagggtgcccttggcgtgtgcacatcgccaagtgccccgggcgttgcaactttcactgtccggactttgcagggagagcaccaatgtgatggtgttctgaaacttgctcatcaacaggctactgttggtagggtttgctaggtctgcccaaggcaagactca

SEQ ID NO: 91034 - protein, 63 aa, Zea mays
  misc_feature: Ceres CLONE 1579169
MEDNQILVQSEHNLIPGAQTLVIGQEFADVDTCRKAVKDMAIALHYELRVVKSDRSRFIAKCS

SEQ ID NO: 91035 - DNA, 847 bp, Zea mays
  misc_feature: Ceres CLONE 1579170
  misc_feature: Translation starting site: 137
ccccgcggtggcggccgctctagaactagtggatcccccgggctgcaggaattcgtctcacccctagaaaaaggccgccctacatcgtcccacctgtaggtacgacactgcgccgcttgaaggaggctttgcggcgatggaccgggtcggcggcggcgaaaagcaactggaggattgcacagtagccaagtcagtgatatccccgctcgctctctctctctctctctctgtacctcttcctccctgattgatggattagatagttaggtatatcttcccctgttggtagtaggtgcatgatcgggatttatttgtacttcgcatcgactgtcttccttattaggacgctaattgttgtggaggcgataagctggacccgtatttatcctatgatgcttctagcgatggcttctgttcgaaatgtttgctaaaaaaaaaaggttcgccacacctgtggcgcatactctcgtgtcccaaaaccaaacacggcggtgctggtgcgcgcgcagctagcagttgagtgctcgcccttgtcgtcagtcgagtcgagcgatggagaagacgacggtcgtgctgtacccgggcgcgggcgtcggccatctcgcgccaatgctcgagctagccaaagcgttgctccgccccgcaggtgacccagtggacgtcgcccatcgtggtcgtccgagcgccccttctacccggacgggtttcgcccccacgggtcgcgcgcgccaagggcctccaaaggcctcccgttccctggccacgtggctacaccccgcccgggcctcccaaagggggggcgcccaaaccctgaaccaacccccctgaaacccgaactgtgttccgc

SEQ ID NO: 91036 - DNA, 1135 bp, Zea mays
  misc_feature: Ceres CLONE 1579171
  misc_feature: Encodes the peptide sequence at SEQ ID NO. 91037
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (712)..(712): n is a, c, t, g, unknown, or other
  misc_feature (713)..(713): n is a, c, t, g, unknown, or other
  misc_feature (723)..(723): n is a, c, t, g, unknown, or other
tttttttttttnncnnaccatctaattgaatgatatctcttttatcaagcaccactttttnnnnnnnnnntnaaaagctgggactccccgcggtggcggccgctctagaatagtggatcccccgggctgcaggaattcgtctcacccctagaaaaagtccgttccttcctctctcctcctcctcctcctttccctgctccctccaaactccaactaaacgccattggtgaatggatctcaaggaggtcaaactgatgcagagcaagttggacttttcagtcagtggcctggccttgcagatggctcccgcgaccgcgaggctggccgacgaggcaagggggccttttgttaggaagtccagtcgactggccaaaaaaaagagcgggccctaaaaccggtttctccccgggggggttctttttctgggctaacactcccccagggggtccccccgaaaaaaagtttgttccaccccaaaattacccgcctttccgcaattcttcctctatcattcactaggggaacaaaaagggggcgagccttctctcccctgtattacacggagttctatcatcccctgggtttttccgggaggaacccctctggcgcggtgcgagaaccctatgtaccccccccctctctctttnnnnnnnnnnnnnnnnnttaaggctacagnnnggactaggcaggccnnnnnnnccccccnnnnctnntgaagggtgntaggggggggggggacctctctagagacttattttctctctgggcggcccgtgaggcatgaggtcttaatataggcactgtcaattaacactcttatcttgctcagcgaacaacttaggaagaaggtaaataaaaaaatgcttatagtcaccgcacataaaagtaactcaattgaattttttattttctaggcgcatcctggaggggggtgagggaaagcataaaaaaaagatcaaacacccccccccaattgtaaagggtttttcccccccccctccccgtggcggaagtgaactgaatttttttactaccaaggtggttttttactaaaaccttaccatcattgtaaatatagtggtaattgtatagcgagttaggagagaagacgataggttttgcctgcacaaaaatg

SEQ ID NO: 91037 - protein, 53 aa, Zea mays
  misc_feature: Ceres CLONE 1579171
MDLKEVKLMQSKLDFSVSGLALQMAPATARLADEARGPFVRKSSRLAKKKSGP

SEQ ID NO: 91038 - DNA, 812 bp, Zea mays
  misc_feature: Ceres CLONE 1579172
  misc_feature: Encodes the peptide sequence at SEQ ID NO. 91039
ccccgcggtggcggccgctctagaactagtggatcccccgggctgcaggaattcgtctcacccctagaaaaaatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaggtgctgcttgagctgaccggcggcgactccaccagcgaccggtcggggcttgacctggtggccgtgctggacgtgagcggcagcatgcagggcgagaagatcgagaagatgaagactgccatgaagttcgtggtgaagaagctcagctccatcgaccgcctctccatcgtcaccttcctggacaccgccaacaggatctgcccgctgcggcaggtgaccgaggactcccagccgcagctgctgaagctcatcgacgccctccagcccggcggcaacaccaacatcagcgacggcctccagacggggctcaaggtcctcgccgaccgcaagctcagctccggtcgcgtcgttggcgtcatgctcatgtccgacggccagcagaaccggggcgagccagccgcaaacgtcaagatcggcaaacgtggccggtgtacacccttcggggttccgcgcgggactacgaaccccacgggtggctgaacgcgggtggccagtgaacaagcatgggggaggggacccttcttcccgtcggtcaacgaacgtc

SEQ ID NO: 91039 - protein, 204 aa, Zea mays
  misc_feature: Ceres CLONE 1579172
  misc_feature (63)..(203): Pfam Name: VWA Pfam Description: von Willebrand factor type A domain
  misc_feature: SWISSPROT Homolog: EC 6.6.1.1 Magnesium chelatase
MSFSDDEPIIPSPNSGPRPTPIVPGRVQLVSKNNNMAPLEENTQKVLLELTGGDSTSDRSGLDLVAVLDVSGSMQGEKIEKMKTAMKFVVKKLSSIDRLSIVTFLDTANRICPLRQVTEDSQPQLLKLIDALQPGGNTNISDGLQTGLKVLADRKLSSGRVVGVMLMSDGQQNRGEPAANVKIGKRGRCTPFGVPRGTTNPTGG

SEQ ID NO: 91040 - DNA, 1167 bp, Zea mays
  misc_feature: Ceres CLONE 1579174
  misc_feature (56)..(56): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
tggtgtggtgggtggggggtttttgtttttctttttggggtgggggtgtggggggntttttgtggnnnnnnccaaaactggagctccccgcggtggcggccgctctacactagtggatcccccgggctgctggaattcgtctcacccctagaaaaatagaacggggttgcgaggtaccccaattctacagcactagtctttttcgtctcggtcgccatgtccttcagcgatgaccaagcgatcatcccttctccaaactcagggccgaggccgacgccgatcgtgcccgggagggtgcagctggtgatcaagaacaacaacatggctccactggaagagaatacccacaacgtgccgcttgagctgaccggctgcgactccaccagcgaccggtcggggcttgacctgccggccgtgcttgacttgatcggcttcctgcagggcgagaacatccacaagaaaaagactgccctgaacttcctgggtgaaaaaactcaacctccttcgacccgcctctccattcatcacccttccttggaaacccgcccaacagggatctggccccccctgctggaagggtggaccccaaggaaatccccaagccccccagcctggctagaaagctttcaattcaaaacacccccttcccaatccccggggagggggctttttcctcccaaaaccttttgatggttaacacgggtcctctcccccaaataacagcggggggtctcttaaaaggggtgcgtcctacccccccccagaaaaacccccaataagggcgcctcccaccccttccccgcggggatatcgggcggccccgcaaatatgtggggagaatctcagttgtcgtgtcaagggtgtttccgccaaaacggggcccacaatagaaaaaaaaaagcgcgggggggggtgtaagccccaacctcccctccccaagacttttcatagaaattcgggtgcaaaacacatggccctcggtgttttacaacccccctccccgggtgttctccggtgcccgaggaatttaacccaaccccccccccgcgttgacccttaaaaacccacgggggggcccacagaaaaacaaccactgtggggggggggaaacccttttttcccctgccttctaaaaaaaaaaagggatactttggtttaaacacatgg

SEQ ID NO: 91041 - DNA, 1222 bp, Zea mays
  misc_feature: Ceres CLONE 1579175
  misc_feature (19)..(19): n is a, c, t, g, unknown, or other
  misc_feature (990)..(990): n is a, c, t, g, unknown, or other
  misc_feature (1018)..(1018): n is a, c, t, g, unknown, or other
ttttttggttttggtggcnggtgtgaaatataattattacttataaaaataaaaggaacagagatatttcgttttgtgtaaactgggactcaccgcggtggcggccgctcttgaacagtggatcccccgggctgcatgtattcgtctcacccctagaaaaaaagtttgcagaaacgaaagcagcagcccaattgggagctccaccccacacaacccaacccgccacctctcatggcgactgctgcgaccaccaccaggaggccgagcgggcccgtactctcggccgcgcactaccgctacgcctcgcccacgcgcgtctcgctctccggcgccgggcagtccgtcagcgtcagcgtctcgtcgtcggcgcggggccgacggacctgcatgtgctcgccgaccagccacccgggctcgttccgctgcagcctgcacaatgagcgcgcgacgaagccgccgccgccgcacgggcacggtaagtcgacctccccgccgccgcccctgaccaaccaccagccatcttgtgcgcggcgagggcaggccggatgggcaagcgcgcctgggtgcgagattgggcgctgttctgaggggaggggcaagtggagcggcgtccgtcgcagatcgctgggcaaaccgatctcgacccgatcctcccggccaggcgaggaggaaagagaatagctggtatcaacaaaccgggtgttctgtggcggccccgtgacgtcctcgtctcccggggaccccacaggacaccacaagggcggggacggatcaagcacaaatgagcggggacgagataccgtgtagggaccctcagggacggaaaaccatggcgctccgcccaggagacctcaaaaccataaaagaggggctcgaccaaccctggatattgaagaaaaactcccacctttgtgatctggtaaaccttcgatgcactcaccccgttatagataaacgtggtggatcaggagaagctttaactctcctganctgtaaggcaatacttaagttataagcnctaaaaccgagaaggaatgttatcggaactaggacacaccccacggtcgctgggagctgacataataaagagaaatagataaaccgtgggacacgggatgagagtctatgaactatctatactaaagaagacagtgaagttcgaaaccgacgtggaagaagtttggtcgagacccctggaaaaaagagggaagaataatctatg

SEQ ID NO: 91042 - DNA, 1057 bp, Zea mays
  misc_feature: Ceres CLONE 1579177
  misc_feature: Translation starting site: 239
  misc_feature: SWISSPROT Homolog: EC 1.4.1.2 Glutamate dehydrogenase
  misc_feature (13)..(13): n is a, c, t, g, unknown, or other
  misc_feature (14)..(14): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ttttggggtttgnncggttcgtgtctgaattcactctcaaatatcacaaagggggtgtaaaagagatannnaaaaactggagctccccgcggtggcggccgctctagaatagtggatcccccgggctgcaggtaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaaacagtttgcagctgaagagatctcctctatgggttcttatcaagatggcgtgagaattgctgaaagctttaccttgggtagcaacgaatcaaagaaatgctgtggggccacaggtccccggcccaaccttcaaatgaaccccaccagaaggcaagggccccacaaaaagggaagcctgggggggtggaatttgcctgggccctttaaagggtggcttgcgcgaaattcattcgaaagaaaggcccaaaaaggcttgaccagccttatccccccctaagtggggctcttggaacaagaaaagagggcttaccccacggtgttccggggtggaagaaagagaaaaggttcccctccactctcttttgggaactcttttggggaaggagagggagacaacctcttttggaaaagggtttttgcccgctttcccctaaataccaattttttaaaggaaaaaaggaaaaaaaccctt

SEQ ID NO: 91043 - DNA, 972 bp, Zea mays
  misc_feature: Ceres CLONE 1579178
  misc_feature (972)..(972): n is a, c, t, g, unknown, or other
aagctggagctccccgcggtggcggccgctctagaactagtggatcccccgggctgcaggaattcgtctcacccctagaaaaatctcttctctatcccctccaaaaccgacgacgacgtcgctctcctccaccggtgctcggggctcttccttccaccagcggcgggtcacagacgctcggcgagctccaccggcgggcgctggcggctggtcagatcccctcggcagttcttccacctggcacattcgggtagctggcgccctccgttggaagtcccacagcgccgccgggcccttccccaagggcccccgggggattcggaacacacccgcttgtgtctggctaaaaaaagagagggtggtgcccccccgcaaagcaaaagctcccagcgtcctcccttccaggccaagctttaaagtttcttccccccccccgggggagttttttcaaaaaaaaaaaccccccccccggcttaatatcctttccccccccccccgggtttttcaaaaaagtttttttttaatggggggggcccccccccttctcccggaaaaaaaaaaagagaaaaccacgggcacgcgggagtttttttgtggtgaaaaagaaaagaattcccttgtttccccttttcccaaaacccacttttttttgagccgcccccccccgggggggggggggggaatattcccctttggggggggggggggggggggtttccccgggggtcccccccccacggcgggatcccattttttcaatattctggaaaaaaaaagagggggggggggggggtcctaaaagagtgtgttcccaaagtttttccaaattgttctggcgccgggaaaaaccggcaaaaaaaatatttttttttcttggggggggggaagcttctctccggggggaaacccttttccaccttcaaccccccttatagtgctgggggggatggccattccccccccacaaattgn

SEQ ID NO: 91044 - DNA, 910 bp, Zea mays
  misc_feature: Ceres CLONE 1579180
  misc_feature: Encodes the peptide sequence at SEQ ID NO. 91045
gcggtggcggccgctctagaactagtggatcccccgggctgcaggaattcgtctcacccctagaaaaaactcccttccctttcagagctcacagttcggagtgggaggaggagaggagacccacacactgtacccggccacagaagcagctactacagcaggagagggagaggaggccggcccccaagatctccgtccgagaagaagcgagcggcgacggcgagacgaggcagagagcttggtgactgcagaaggattcggtgaggaatctcgtcatgcagacttcaaaaccaaggagtgggtcttcagatgccccgcagaggacttctccaaggacaccgcgggcatctcgtgtggccaaaaccggagggaatgaaatcgattctacaggagttaccccgacaagaacgcctacggagaggagccctaaggttactgagaggcggtctccacggagcccaattactgaggtaaagaagcgcccaagcaggctatcagaactgggagtccaagggcagccagctgcaggatgaactgaaagaggccaaggagcaacttaagctcgtccagaggcacgggaggcgccttgcgccaccaggaaagcccaagaaagcaaagaccgccagagtcaggctgcagccgccctcgaagcttggagggaattggcagcgcccgtcttgaccaagttcctcggcggcgggaaggaaatcccggtcttcccagaaactggccacaagattctccgcaggaaacgttgacccggtgcccgtgggagaccggaaaactttgggggtggtgccgcaaggtcagaaaattcagcgtggaggctagcccgcccctccggggtctgggcctatggtttcccaaaaatccccttcggggccgaaaagacattcaccttggggaaaat

SEQ ID NO: 91045 - protein, 80 aa, Zea mays
  misc_feature: Ceres CLONE 1579180
GGGRSRTSGSPGLQEFVSPLEKTPFPFRAHSSEWEEERRPTHCTRPQKQLLQQERERRPAPKISVREEASGDGETRQRAW

SEQ ID NO: 91046 - DNA, 1245 bp, Zea mays
  misc_feature: Ceres CLONE 1579187
  misc_feature: Encodes the peptide sequence at SEQ ID NO. 91047
  misc_feature (445)..(445): n is a, c, t, g, unknown, or other
  misc_feature (949)..(949): n is a, c, t, g, unknown, or other
ccactccccaatgcggggggtggtgtaagagccacgaaaaaagacaaagcaacaataatacacggggtgagtcaagctggagctcacgtcggtggcggccgccctcacaatagtggatcccccgggctgcttgaattcgtctcacccctagaaaaagtctcgcgcttcgctctcacgctcgcgtcaccggagctctccagaaccgaaccccaactgcccaagggcgagcgatccgaacccctcggcggcttcgtcaacgacgccgagaacactttgaggaatggctgaagaggatgtccagccccttgtgtgtgacaatggcactggaacggtcaaggcgggtttcgctggtgacgacgcaccgagagctgtctttcctagcattgtacgcaggccacgccacactggtgtgatggtgggcatgggccaaaaggatgcatatgtnggcgatcaagctcactccaaaagaggtattctgacactgaagtacccaattgagcacggcatttgtcggcaactgggcatgacatggaagaagatctggctaccacacccttctacaattgagcgtcgtggtgggcacctggaggaagcaacccgtatacctggctggaccggagagcttccttcttgaacccccaaagggggaaaacaggggaagaaaagattgaacccccagaatttaatgggtgtcgaagaaacattttccagacactggcacccatgcccaaattggggtaatggaggggggcgccacatcccactagggtgcccgatgtatgctcttttttttcacgcctgtggtctaggaccgccctcctcaggtgtgggggctgtcagtaaaaagcaaataaccggagcggtgttatatttggagggagcgctctcgccgaaaacacttctcgggggctgtggctactgggggttgtggctctgaagacaccccganacaagccccgtgtggctccccccttatgtctccttaagcccgataatagggggggtagatcacaaaacggcgctctgatcccacattcaacaaggcgcgatacaattccaccgtttacggagaagagtgggagataacacacatgtggcagcggggggagagcggattggaataacctctggtataccacgataacaataaccctcgtggattcagggacaagaatactcccgggtggatacctaggaggataaggggtgtgttataacacccgcgactgtgtaaaacataaacaa

SEQ ID NO: 91047 - protein, 117 aa, Zea mays
  misc_feature: Ceres CLONE 1579187
  misc_feature: SWISSPROT Homolog: EC 2.7.10.2 Non-specific protein-tyrosine kinase
MAEEDVQPLVCDNGTGTVKAGFAGDDAPRAVFPSIVRRPRHTGVMVGMGQKDAYVGDQAHSKRGILTLKYPIEHGICRQLGMTWKKIWLPHPSTIERRGGHLEEATRIPGWTGELPS

SEQ ID NO: 91048 - DNA, 833 bp, Zea mays
  misc_feature: Ceres CLONE 1579189
  misc_feature: Translation starting site: 186
  misc_feature: SWISSPROT Homolog: EC 1.11.1.6 Catalase
  misc_feature (713)..(713): n is a, c, t, g, unknown, or other
ctggagctccccgcggtggcggccgctctagaactagtggatcccccgggctgcaggaattcgtctcacccctagaaaaattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatcccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagaaggtaacttttgacctcgtgggtaacaacatgcctgtgtttttcatacgagatgggatgaaaattcctgacatggtccacgcttttcagccgaatccaaagaccaatttgcaggagaactgggagaatagtagatttncttctctcaccaccccagagagcctacacatgtttcacctttcctcctttgaacaatgttgggcatccccactccaactacagggcacattgggaggggcctttgggtggtcaataacct

SEQ ID NO: 91049 - DNA, 1291 bp, Zea mays
  misc_feature: Ceres CLONE 1579191
  misc_feature (686)..(686): n is a, c, t, g, unknown, or other
tagagcccagatttggactgttagcgaggtgaggacacccaattttaatctcttttccgccccaccttggttgtcaaactggagctcaccgcggtggcggccgctctttactagtggatcccccgggctgcatgtattcgtctcacccctagaaaaagacgtctgtccaagaacactcgctccccacctgttcgctgcttcttcttcttgccaatctgctccttcttctagctagatcttggatggaactagggatgacgatggaggtagcgaagatcatcgaggtatggatagtacgcggctgctagttagttcaccacgccatcatgccagctccagcttcgtccgatcgatagatgcgagctgtagcagcgtggcagccattcagcaggtgtcaaatctcatattccccccatccccgctgctagtaggtggtttagcaaatcccaccaagcaggatacagccgtggatcgtagccttaccccacggatccccgtgtctgaaggagggcccatgggactccggaggggcggtttcccacgtggttatctggcgtgcgtgggccggtgatttcacagtcgggaggcccgtttctttggcctaatttcggccgatatgtaaggggggcttcctcctgtcgtggtgtccccccccagtctggcaaagtgtcggcttgtccttgggntctttgcattgtaagtcctcccgaaatgctatcgcgatttaccctcccctgcccagtatgttaaatccctgtcgcccccaaattcctaagtggtagacccctagtcacacgcttttccactgagcccacaccacatgtggtctttgtggttctcgcaataaccgtgtgtgtgatgaactcctcttagttaaagaataggcgggatctcggataaccaagatgtagttttacccaggtaagataatcatatgtagtggtggaaccgcccaccagagttcttgttctccatttgtgtgtactcatgtaaaacctcctcagatcgtcatagagagtgacatgagggaaaccccttgtactcgagggagatcatcacctcaatatctcaatcacatccccttggcgtctagcgagcgcggtactagaaggtctcctttttcggacggactcgtatttgttccgatgcttagagacgagaatcaacttccgtgcgatgagctgcttctgttcggtatctctcatctcgctaagtatttatatattccccgtgccagagaaaaagcagacacgccgacctccctaaaaaaatacagaacagtgacgccccc

SEQ ID NO: 91050 - DNA, 1232 bp, Zea mays
  misc_feature: Ceres CLONE 1579197
  misc_feature: Encodes the peptide sequence at SEQ ID NO. 91051
  misc_feature (75)..(75): n is a, c, t, g, unknown, or other
gcggcagggagtgagggggtgtgtagttccttgccccccccccccccccccccccccttcaatcccccccggggncttaaaaactggaactccccgcggtggcggcctctctagaactagtggatcccccgggctgctggaattcgtctcacccctagaaaaaacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggcgcaacaattgttgtctctggtgatggccgctatttctcaaaagatggctgttcagatcataacaaaaatggctagctgccaatggcattaagacgctgtttggcgttggacaaaaaccaagctcatgtctaactccatgctgttatcttgctgtccctcccgtgaaaagagtttcggtgcaacatggcattcaaaacgtctacctgggttgccctctccatcctctgtacagaagcagtcctaaaaactcccagtgttggggtctcctttaactgtaaggcaacctcttcgggggattccaaacctacccaaacctttgcggccaaaaattgggatgggggcgcccttgccctttctcctagtaatatccatgtgctttacccgatgaacaaacagaatatatttgccacctttgatacacctaaagcggaacaaaattgcttacgcggcgaaaatacgccggaagattcatacgtggaaaagaaacccttacctcctcacaatatatatgtgaatcacgtacctccggtgttgctattctggcgcgcactcccacccacggtcaatgagctgtgggcgtgcaccaccgagagagggcctcctcgttttgtataggttcggcgaagcgatgtgggtaggaaagtgtctcagtgcgcaaacgcatactacacactagccaggttttgacaccatagaagaccccggatgtgtgtgtggacttttactcacagaggtcatgaaaagaataaagagcgtcgacatgaaaaccttttatcccgaga

SEQ ID NO: 91051 - protein, 79 aa, Zea mays
  misc_feature: Ceres CLONE 1579197
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDGCSDHNKNG

SEQ ID NO: 91052 - DNA, 820 bp, Zea mays
  misc_feature: Ceres CLONE 1579200
  misc_feature: Encodes the peptide sequence at SEQ ID NO. 91053
  misc_feature (796)..(796): n is a, c, t, g, unknown, or other
  misc_feature (797)..(797): n is a, c, t, g, unknown, or other
aaagctggagctccccgcggtggcggccgctctagaactagtggatcccccgggctgcaggaattcgtctcacccctagaaaaaaccgttcactcttgttggccttcttgctgcagagagcaagttccaacatagttcttcccttcgcctccgccggctgccactccctcctgtcttgctcactctcgctcccaactgccaccctgtttcccttctcccctgccccgccgttcccactccgcacccgcgcgccgcggcagcttagcttgccgcgagccctgccctgccctgccctaccacccggcgccatcctgacctgtgtgtgctacggcgaggcagcaggagctcgcgctcagctcggtaggttgatgagctagcgacgacggccagtccgcccgaggcagcgtcgcgtaggggcggacgaggcgtctcaacggcaatgagggtgtacatcacggcgacggcgacggcgggcgaaggcgacgcgacgaagcccaaggcgccgccgccgcatcagcagcagcagcagcaggcgcggcgcgggtgccgctcggccgccgccacggggctcctcgccggtctgctcctcttccgcgccgcgctgctcgccatcgaggccggcgcctccctctgcccttccacggcggcagggtgcctggactggcgagcggggctggggcgatggctctacggcggcggcgacggcggcgacgcgacggaggaatttatggaggaatggaagcgtcgcagcagggaagccaccctgctggaccctgtggtggtggaaagcgggccnngactccatggacgcgctcttggt

SEQ ID NO: 91053 - protein, 127 aa, Zea mays
  misc_feature: Ceres CLONE 1579200
  misc_feature (120)..(120): Xaa is any aa, unknown, or other
MRVYITATATAGEGDATKPKAPPPHQQQQQQARRGCRSAAATGLLAGLLLFRAALLAIEAGASLCPSTAAGCLDWRAGLGRWLYGGGDGGDATEEFMEEWKRRSREATLLDPVVVESGPXLHGRALG

SEQ ID NO: 91054 - DNA, 826 bp, Zea mays
  misc_feature: Ceres CLONE 1579201
  misc_feature: Translation starting site: 158
  misc_feature: SWISSPROT Homolog: EC 5.4.2.1 Phosphoglycerate mutase
  misc_feature (553)..(553): n is a, c, t, g, unknown, or other
  misc_feature (812)..(812): n is a, c, t, g, unknown, or other
ggagctccccgcggtggcggccgctctagaactagtggatcccccgggctgcaggaattcgtctcacccctagaaaaagttccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcacttggtgctggtcggattttcgcccaaggtgctaagcttgttgatcaagctcttgcctcaggaaagatttatgatggagatgggttcaactacatcaaagaatcttttgaaaatggtactcttcaccttattgggttgttgagntgatggtggtgtccactcccgccttgaccaactgcagttacttctgaaaggtgtcagtgagagaggagcaaaaaaaattcgtgtgcacatccttaccgatgggcgtgacgttttggatggcagcagtgttggtttcgtggagaccctagagaatgatcttttggagcttcgagggcagggtattgatgcacagattgcttctggtggtggaaaggatgtatgttaccatggaccgttatgagaatgactgggatgtggntaaacgtggctggc

SEQ ID NO: 91055 - DNA, 804 bp, Zea mays
  misc_feature: Ceres CLONE 1579202
  misc_feature: SWISSPROT Homolog: EC 4.3.1.5 Phenylalanine ammonia-lyase
  misc_feature (555)..(555): n is a, c, t, g, unknown, or other
aaactggagctccccgcggtggcggccgctctagaactagtggatcccccgggctgcaggaattcgtctcacccctagaaaacaagaagagcacgcccactcctccggctcttcttctccaccggcaccagtccaccacctcctgccaccgcgcgggcccaaccaaccacaccgcagcgcaccaatggcgggcaacagcgccatcatgaagagcgacccgctgaactggggcgacggacgccgaggagctgaccgggagccacctggaccacgtgaagctcaaggaggcccacgtcctgcagaacgtggtgaagatcgagggctcacccctccgcgtacgccatggtgcacgccgtcgcctccgccaagggacgcggttccggcgtaggccgtccaaaccttctagaaagaaaggccccccccccccccaaaaaagcctaaaacccccaagggggattccctaaaaatccccttttactccgggggggggttaaaaattaggggggggccccccccccggggttttttcgggggagaaaaaaaaaatcttggggncaaaaaaagaggggggggggccgccccctttttttttttttaacacgggggggggggggggggtttttcccccggggggaaaaaaaatttcccccccccttattaagaaccccccccccgccttctttaaaataaacaccccccccccccccccaaaattttgttttgggaccacaaccacaccacccccccccccgcgaagaaaaaaaaaaaagggcggggggggggttaaaaaaaaaaaaaaaaaaa

SEQ ID NO: 91056 - DNA, 1109 bp, Zea mays
  misc_feature: Ceres CLONE 1579205
  misc_feature: SWISSPROT Homolog: EC 5.4.2.1 Phosphoglycerate mutase
  misc_feature (29)..(29): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (1109)..(1109): n is a, c, t, g, unknown, or other
gctccctgggcttctcttttcccccttantttctttttctacttcttccctttttttnnncccaggataaaaaaaaactggaactccccgcggtggcggccgctctagaactagtggatcccccgggctgcaggaattcgtctcacccctagaaaaagttccgtcgccccgcattgctcgcccagagctcttgtttaggcaaaggcaaaagcacgagcaaaaaggtttcgctggccatggcgagctcgtggacgcttcctgaccacccgaagctccccaaggggaagccggctggctgatcgtcgtgctcgacggatggggcaaggccaaccccgaccagtacaactgcatccatgtcgctcagactcctgtcatggactcgttaaagaatggcgctcctgataaatgcagactagtgaaggctcatggaacagctgtgggtctcccatctgatgatgacatgggcaacagtgaaaccccccacaatgcacttggtgctggtccgattttcgcccaacgtggctaagctagttgatcaagctcttgcctgaggaaagatttacgtatggagatggggttccacctacgttaaagaaatctttttgaaaaaggtacttccttgcacctttaatggggttgcttgaagtgaagggtaggtggttccatctcccagcctcttggactcaagctggtcacgtttacctttcttgacaagggtgttccacttggatgaaggagcgaggccttcaaagaaaacatttcggttggttggcacccatatccggtttaacccaaattgggggtcttgggaaccggtattttttggaattggtgccaggccaatttggtatgggatatttctttgtggcagaacccccttacagagaaaaatgtatcctatttttgggaacccttcccgcaagagcaaagggggtcacttggtttggccacccgccaattgactcttcatggagtgtagtttccaaatggcatcgtttttgtttaccccctttttgaacccgccctctataaagaattgtatctttggcaaatgtggtgattaaaacactcttacctcgggatatcctctcggggtgcccccaggaaan

SEQ ID NO: 91057 - DNA, 877 bp, Zea mays
  misc_feature: Ceres CLONE 1579206
  misc_feature: Encodes the peptide sequence at SEQ ID NO. 91058
aaagctggagctccccgcggtggcggccgctctagaactagtggatcccccgggctgcaggaattcgtctcacccctagaaaaaatcggccgatgctgcggcgactgaccacagctttcgaccctctccagtggagggaacggggttagcgagcggcctccgctgcgacggcaacggcgtgggagggccatggcggcccccgcgctcgccttccccatgttgctggctgcctcactgatctccgtcgccgctcctgcgctggctcgaagcccatcttgccctgatggttggcaagtcggccctgttcagaacagatgcttcatgtacatatcagcctccctttcttgggatagatccgaggctgtctgccataactacagcgggcatctcgctgcactatcatcaatccaggagctaaacttcgtgaagtctctctgtggatcatcatccacaggatgctgggttggagggcatcactacagcactagtaccggtaacggttggaaatggtctgacgattcctctgtttggaatgagactgtcttccttggtgagccattgcctgccaactgcagtgatcctgcatgtaaagtagccaccagcaacgatttgtgtactttggtcaccaatggtcagcccttcactattactggaaaaaggtgcggtgagtcccatggtctcatctgcaggaagaacccacgtggacagatgctaccatgatcttggtcccaaggagtatttctattccataattgccgggagtggtttcattctggcaaccacctctaaccgttggggttttggctggcttttcctacgggcgagccaggaaaaccaaaaataatcccggaaagggttaagtgccccaccctgctgc

SEQ ID NO: 91058 - protein, 176 aa, Zea mays
  misc_feature: Ceres CLONE 1579206
  misc_feature (49)..(168): Pfam Name: Lectin_C Pfam Description: Lectin C-type domain
  misc_feature: SWISSPROT Homolog: EC 3.4.21.84 Limulus clotting factor C
MAAPALAFPMLLAASLISVAAPALARSPSCPDGWQVGPVQNRCFMYISASLSWDRSEAVCHNYSGHLAALSSIQELNFVKSLCGSSSTGCWVGGHHYSTSTGNGWKWSDDSSVWNETVFLGEPLPANCSDPACKVATSNDLCTLVTNGQPFTITGKRCGESHGLICRKNPRGQMLP

SEQ ID NO: 91059 - DNA, 877 bp, Zea mays
  misc_feature: Ceres CLONE 1579211
  misc_feature: Encodes the peptide sequence at SEQ ID NO. 91060
  misc_feature (795)..(795): n is a, c, t, g, unknown, or other
  misc_feature (850)..(850): n is a, c, t, g, unknown, or other
ctggagctcaccgcggtggcggccgctctagaactagtggatcccccgggctgcaggaattcgtctcacccctagaaaaattaattaagcgcgcaccggacctgacctcacgcatccttcgaccaaaacggcagctcctttctcccgcggcgttgccgtcgcactcgcacgcacgcactcaccgccggcctgagcctaatcctaatcctaatccacataccgggacaatccagacgaacgagcgaaccaacgcacggacggccaccagccgctgcgtgcgttcgctttcccccgaaacgtgacccgagccaagcttcagagagagaaaggagaagccgccatgaagcagcagcagctgcagctgcctcctagtcgtcccagttaaatccgtgctcgccaagccacgactacgagcacctgccccggtttttctcctcccgcccccgttccccgtcccgactcccgaccgacccaacccatatcagagattccttccttggtggcgctggcgttcccgtgaggcggcccgcgcgcgaaggcggccgtgaccgaccgtccggagcttcatgcgccaggggcggcggctccaccccgtcgtttgatgggcaacgcatgcggcggcgcccttagatccaagtaccagcacagcttcaagcacgccgcgtcgtcgcagcgccacgcctcctccgagtacagcgccagcgccgtggccgacgactcgcccaggaagccgccacaggcgcccggcaccacggaacgccacgcgccgccgccccgcaccgtcaacgtcaccgncgccatgaagcgcggcggggcccgcgcgccgccggacctggggtccgtgctcggncaccccacccccaaactcgcgaactct

SEQ ID NO: 91060 - protein, 92 aa, Zea mays
  misc_feature: Ceres CLONE 1579211
  misc_feature (65)..(65): Xaa is any aa, unknown, or other
MGNACGGALRSKYQHSFKHAASSQRHASSEYSASAVADDSPRKPPQAPGTTERHAPPPRTVNVTXAMKRGGARAPPDLGSVLGHPTPKLANS

SEQ ID NO: 91061 - DNA, 810 bp, Zea mays
  misc_feature: Ceres CLONE 1579212
  misc_feature: Encodes the peptide sequence at SEQ ID NO. 91062
ggagctcaccgcggtggcggccgctctagaactagtggatcccccgggctgcaggaattcgtctcacccctagaaaaaaaccccaacccccaccgctgctgtgcggcaccatcaccacaccatcaggaatcgggcgccacaccacccacaactctccaccccaccctcgccgcgcgttgctcagtcgcagcgagcgaggcggggccacaggccacagcgcgagcggggcggggcgggagggagggccagggatctctactctcgtccgtgcgggggcgtgggcgtcgcatgcggcggcgcgccggggcaaatgcgggtaacctcacggtcggaggagcgctgacgcggcggcggcagccagggagcgatgcaggcgccggagcagcagcagcagcaccagcagcggcagaggaagggttcatcagagatggacttcttcagtgaatacggtgatgctaacagatacaaaatccaagaggtcattggcaaaggaagttatggcgttgtttgctcagctgttgaccaacatactggcgacaaagtggcaatcaagaaaatacacaatatcttcgagcacttatctgatgctgcacggatcctacgtgagatcaaactacttcggctattacgccatcctgatatagttgagatcaagcatataatgctgcctccatcaaggagggacttcaaagatatctatgttgtatttgagctgatggatacagatctccaccaagtcatcaaggcaaatgatgatttaaccagagagcatcatcagttctttctctatcagatgctccgtgcactgaa

SEQ ID NO: 91062 - protein, 147 aa, Zea mays
  misc_feature: Ceres CLONE 1579212
  misc_feature: SWISSPROT Homolog: EC 2.7.11.24 Mitogen-activated protein kinase
MQAPEQQQQHQQRQRKGSSEMDFFSEYGDANRYKIQEVIGKGSYGVVCSAVDQHTGDKVAIKKIHNIFEHLSDAARILREIKLLRLLRHPDIVEIKHIMLPPSRRDFKDIYVVFELMDTDLHQVIKANDDLTREHHQFFLYQMLRAL

SEQ ID NO: 91063 - DNA, 1231 bp, Zea mays
  misc_feature: Ceres CLONE 1579216
  misc_feature (1)..(1): n is a, c, t, g, unknown, or other
  misc_feature (7)..(7): n is a, c, t, g, unknown, or other
  misc_feature (8)..(8): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (59)..(59): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (798)..(798): n is a, c, t, g, unknown, or other
  misc_feature (983)..(983): n is a, c, t, g, unknown, or other
ntttttnncccnnnnnncccactcccttacttcatcaatattcatccctaatgttgctnangaagaaanntaagagctggagctccccgcggtggcggccgctctagaatagtggatcccccgggctgcaggaattcgtctcacccctagaaaaagtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggaggtgggcggcaatggaggatgcgatggcggcggacgggaagagcgtgctgcaggggcggtacgagctggggcgggtgctggggcaccgcaacttctggcgggtgcacgcggcggcgggacctgcgcacgggccccaacggtctcggtctaaagtggtgggccaaggcaaaagcccggagccgcgccgggccatgggcggaaacaaaatcaagcgggggagaaatctccccgtcttgtaaagaatgggggtgtcctactccccaaccttcttttggtaacttttcaattaatggtggaatgggcaccaccccggcattacccaagaaaatattaacctcttggtcgtcttcttgaaacttatccgtcctccctccgagtttagggggacaagatctcactnatacttttcttctctgccaaatattcatcgggctcgcccagaccagaggtggagcttggggagtatacccgatgagagagggaaacctattttcggaccacctgggaccataggcttgcacccattctccccgggggtgaaggatatgtgagataatcgccccgagctcgcgcgtgcgcaactgntttgtagcgtctcctatcaatgccaactgtgtcggggggtgtgagttttacccaatatagtcgaaaataccatatctcaaaaactttttttaatacatctcctcatgagatttcccttaccagaatagagaggtataaagggtacaaaaccccttctaaaatagtgagctgtgacgaagtccttttgttgtgggtatctaatcgaatgtgctgatatacacgcggggagacatattttcggctctttt

SEQ ID NO: 91064 - DNA, 920 bp, Zea mays
  misc_feature: Ceres CLONE 1579218
aaagctggagctccccgcggtggcggccgctctagaactagtggatcccccgggctgcaggaattcgtctcacccctagaaaaagtccctgtccctctactccgcctgtctagcacttggggctgtctgatgggggctcccgcccacaccccttccatgcgcgcgaccacctttctttccccgtgagatctagcagcacctccccctctcttgctatcattccctctgcgtcctatcgtttcttcggcccccagcgctctcgcgtgtcgcctccacatctccacgggctttaaggtctttggcctcccccgttcttggacaggggcacaccactgatccaccggatgcccactactcgaaatacgagtccctcgtgcggctccttaaggtggaagatatccatcatgcaggaactgggaggggcggcttccacactaccggacgcgatgggggcaatggctgtcttgccaggtccactctgcccgtggatctggatctcttgcttactctgacagtatgcgacgcttcaaagcacttctagaaccatttctgcagacagtggaagccacaactgatacctgagacatagctgagatgtgacatcctcctacgctttgccatgctcggcttcgctcgctctggagtgactatagctatatccttacaatctgagctaagtgtcgatatcacacagagacccgatatctcatccctgagggtcgcccgtccattgcatccctgtagccacgcccttgtggcatgagcttgacgagtactcaacaatcttgttgatggggttagtggactgagctacatcgacacgcttcactgatgctactatccggatactaatgtttgcgatatacatccatctctcatgatgctgaggttgcatcaaacgtgcaaagctcatgcacagt

SEQ ID NO: 91065 - DNA, 902 bp, Zea mays
  misc_feature: Ceres CLONE 1579220
  misc_feature: Encodes the peptide sequence at SEQ ID NO. 91066
ccccgcggtggcggccgctctagaactagtggatcccccgggctgcaggaattcgtctcacccctagaaaaaaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcaaatggatcaaaggctactgggggccttcttccttgacggcgggccctaagccatgtggtccctaaggaggactttcgggaacaaaatccaccatggggaaatggtggggcctgcctcctgaaaccctgtaacggaaaaaatttttcttttaaaaacaacgcccaatcgtctgaaaaacgtccatttcctggagaacccttccccgaaaggttggataattttttggtgggaccggcggtctccaagccttttagaggggaacgcctgagaggccccctcttataaggtggggaaggttgtttagaaccccgagggtggggagaattaccctaaagagtttcaatggaagagaccgttgtttttagaacttcggca

SEQ ID NO: 91066 - protein, 121 aa, Zea mays
  misc_feature: Ceres CLONE 1579220
  misc_feature (16)..(122): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGANGSKATGGLLP

SEQ ID NO: 91067 - DNA, 1333 bp, Zea mays
  misc_feature: Ceres CLONE 1579224
  misc_feature: Encodes the peptide sequence at SEQ ID NO. 91068
  misc_feature (64)..(64): n is a, c, t, g, unknown, or other
  misc_feature (898)..(898): n is a, c, t, g, unknown, or other
ccgcgggccgttttcctatttgttgcgtttgtgtgtaggggcggctatattgcaggcggttttntacaaaactggagctccaccgcgtggcggccgctctagaactagtggatcccccgggctgcttgaattcgtctcacccctagaaaaaactcaagccaccatcgaccttcaagtctcgctacgtagcagtgcaataaaaaaagcagccgcaatggcgagcagcaccatggccctctcctccacggccttcgccggcaaggccgtgaacgtgccggcgtcgtccgccttcggcgaggcccgcttgacgatgcgcaagacggcggcgaaggccaagccagcggcggcgtccgggagcccgtggtacggccccgaccggttgctgtaacagggcccactgtccggcgagccaccgagctaccttgaggggccagttcccccgggcaccaccgctgggataacgtggggctgggggggggaaccggaaaacgttcgcccagaaacgggaagctggaggggcaacctccttcccgtccggggcatagtttgggcccaccctccgggtaatgttttctcttccccaatgtggccccgaccccaaaaggggcgttcaaagattaagcggaaagtcccctttagggcttcacaagggagatgagttttcaccaaaacctttttcaaccaaaagaggctggcgctcatgcgcatttttatcctttcggggtagaaattcccaagagctcttcttatgatccatggacgcggcatagaagtacaaagaccccttggtaatctataatactggagggcgcgcctcgtattataagagagagtaggggagtgcctcctctaatcgagagggtcggtgagcccccccattttgcaatgaggaggcggncttatacagcgtcgaaaaaaacaggcgtagaagggttgggggatctgtcacgccatgttctacgggctcccataggcttatcagtcttcagaatatgctcccacgatttggttttaggacacctcgggggagcgcggcacgtgtttcgtgctctcgatatccgcgcccccccgggcgtggtgcatatcaggcgcttaaaaaataagacctcaccccaagtgggctcctccctcgccacccatagaagctcgcatagaggttctgaagggtgatagtgtcgatcacaaaatcggtgtgtgctctcctccccctccatgtgtgttcctccacacgtgatttcgttgatatcttcccgcaatcgcctcggtatcccttctgttttatactcagaaaaagcagcactcttctttgaagaaaacaccccgtgttgaaaca

SEQ ID NO: 91068 - protein, 57 aa, Zea mays
  misc_feature: Ceres CLONE 1579224
MASSTMALSSTAFAGKAVNVPASSAFGEARLTMRKTAAKAKPAAASGSPWYGPDRLL

SEQ ID NO: 91069 - DNA, 932 bp, Zea mays
  misc_feature: Ceres CLONE 1579226
  misc_feature: Encodes the peptide sequence at SEQ ID NO. 91070
  misc_feature (892)..(892): n is a, c, t, g, unknown, or other
ccccgcggtggcggccgctctagaactagtggatcccccgggctgcaggaattcgtctcacccctagaaaaaggccgtaagtgagccgagagcccccgatataccagctagctagataaccagccagcgcgagcatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggcgccggacctccgcggctactgcggcaccgccgcgccgcccgacgtcgcgtcctactccgcctcccccgtcgtcggcgacgtcgtcgccctgctcgacgcgatcggcatccacaaacaagggtgttcgttggtggggtcaaccactgggggcgccattatcgcgggggtacctcatgccttgttccgggccgggaacggggtgggcggcgccttgatcaaccccccagcgttccccctttcattcgccccctctctttctcattccgcgcccggccgacaatccgttccataaaaggacccattacaaattacttttctaaccggacttccttatggtggccctcccccctgccaatctttcgggggcggctttccagaattacacaattttattcaatctggtccggttcccggccctccccgcatactcaacccgatttgaatgtttgtaaatcgtgcacggggcaaactctccgattggcgggatttataatattgggaatgcaaattggcgcccccagactgggcactctttgttgctctctaggggcattttatctttcnactctccgctcgctgctccagcttggcgacctttgttgct

SEQ ID NO: 91070 - protein, 161 aa, Zea mays
  misc_feature: Ceres CLONE 1579226
  misc_feature: SWISSPROT Homolog: EC 3.3.2.10 Soluble epoxide hydrolase
MEAAAAAVRHRTVEANGISMHVAESGPDGGDGAPAVVFLHGFPELWYSWRHQMAHLAARGYRCVAPDLRGYCGTAAPPDVASYSASPVVGDVVALLDAIGIHKQGCSLVGSTTGGAIIAGVPHALFRAGNGVGGALINPPAFPLSFAPSLSHSAPGRQSVP

SEQ ID NO: 91071 - DNA, 855 bp, Zea mays
  misc_feature: Ceres CLONE 1579229
  misc_feature: Encodes the peptide sequence at SEQ ID NO. 91072
  misc_feature (16)..(16): n is a, c, t, g, unknown, or other
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (246)..(246): n is a, c, t, g, unknown, or other
gctggagctccaccgncgngatggcgnngccgctctagaactagtggatcccccgggctgcaggaattcgtctcacccctagaaaaaccatctagcccatctgctctctcagcgaggacgaaggcacaaacccctcacctccctcaaaccctagccctcgctctcccgcttgttcccgtcaccgccatcatgggctcagatgcggacatggaggactacggggtcgagtactctgacgaagagccngaggagcaggatgtcgacattgagaacccagtattacactcccaaggttggtcgagacagaccagagggtgcacctgccgggttttgatccagtggtcagtatggaagcctgaaaaagcttgatgggggatttaaagccctttaaacaaactgggaaagcttttccaaaaagctgggggaaaatcccaaaaaaatgggggggtcccctttttgggggaaggtttaccccccccttaaaaatctcggggggccccccgaaaattccccccggggaaaaatttttaaaaacccccacaaggggggttttttttttttctggggggaccccccccccccaaaaatttttctccctccttcgcgagaaaagttttttccccccaacaaacccccttaaaaaacctctttttgtaaaaccgccaaaaaaaaggagggtttttttttgtgtttttaaaaaaaaaacatcttgggcggtttttgctaaaaaaataattttttttttttttttatttttggagaaaatggggcgccctcgctttttaaaaaatatatttttttgtgaggagggggggcgttttttttttttctccccaaagagaggagaaaaagagg

SEQ ID NO: 91072 - protein, 59 aa, Zea mays
  misc_feature: Ceres CLONE 1579229
MGSDADMEDYGVEYSDEEPEEQDVDIENPVLHSQGWSRQTRGCTCRVLIQWSVWKPEKA

SEQ ID NO: 91073 - DNA, 1309 bp, Zea mays
  misc_feature: Ceres CLONE 1579232
  misc_feature: Encodes the peptide sequence at SEQ ID NO. 91074
  misc_feature (912)..(912): n is a, c, t, g, unknown, or other
gttctgtttttttttttattttctctactttttgataccttccccccggcccccctaaatatttaatactggtgctccccgcggtggcggccgctctagaatagtggatcccccgggctgcaggaattcgtctcacccctagaaaaacccggcgacggggatcctgcactcttgggttcttgcatcccgcataccctcgaaagctcgaaagatcccgcggcgcagcagccacccttctctcctctccgctcccaatcttatcgtcgcctccctcgaagtcgccgctgccttcattccaccatggagcttcacgccccggtccacgtgatgaaggactcgctgaagcgggagtctggcgcgaaggttcaccaagccaacatccatgcggccaaagctgttgctgacatcattcgcacgatattggggaccaaaatttatgctgaaaatgcttctgtgtcctccacgaggttttgccgccaccaacgatgggaattctgatttgagggaaaagagaaattccctatccccggtttcctaagattaaaatatgtaaattccataccgcaatcccacattgtagaaacgcttccttttggtggcaaacaaacccggttccctggtttctcacccgtgaataatatgctctagaacctttggcctaagagctttctctttttttcacacaataatcactcccccccccctattgcttctaccttttagccgaaccatctatgcacccaccaatcgctctttacccgagaatttccaattggggctcgacccacacccttaatataaattattttccaactcgatccacattttgtagactttatattaaaatgctcatttccctcgttggagtccaatcggttatcatgtggccgcccccgtctggtatagaacctncatacaacagggggcgtaatacaatatattactacacgtggagagcatcacctctgtgtggaggacacgccttatgtttttgtgtatcaccgcctcatactcttctctattgtctctcctcacactaaatatcttcgtgggtttgtctcaccctccgtttctctcttccacttcttctatactccgcttcctctccgatcaactaattaacccgcccactcttatactcttccctcccttttgggtggaccctacttgctattacctaccaaatcgccccctatgacttctgttgtaactacctcacaccctcttttattcctcgccgttacgtttttgtaccttttgtttcaccctcgattactcatttgctaatttcgcaaactcgattatttcc

SEQ ID NO: 91074 - protein, 65 aa, Zea mays
  misc_feature: Ceres CLONE 1579232
MELHAPVHVMKDSLKRESGAKVHQANIHAAKAVADIIRTILGTKIYAENASVSSTRFCRHQRWEF

SEQ ID NO: 91075 - DNA, 892 bp, Zea mays
  misc_feature: Ceres CLONE 1579234
  misc_feature: Encodes the peptide sequence at SEQ ID NO. 91076
ctccccgcggtggcggccgctctagaactagtggatcccccgggctgcaggaattcgtctcacccctagaaaaactcccccctccgccattgctccacgagtccacaagagatctcccgcgcgccagagctctagagagaaactggacaggagcgcgggcttcggactcccatctccgcgggggcacaaaagatgcaggtcctcatgactcccagcctccgcgcagcgcaatcggattgtcaatgaatctacaatgcaaaaagtccattgcaatgccaaggttgcttcctgactgaccagatcgagcgtgttgaactctctggtcatctcgtctggaaaaacacacaggtggtgttgcagctatggcttcgaaggcattgcctcaaattctcccagacccccctggcacgaagcagtgctctaagggtgctccccctttcgagcttccccagacgaacaattcctgtgcttcagcgctgacggtgttaccgggaacaacaactggacctgagcaaatcgagccctaaacctgagctgaacgagccgaaaccagaccacaccctaaaggaacctgtcgaccccgcgtcggcaaagtttccccgtataaccgaaccaaaaaaccggtacgggagcctgggaaccccaaacggggggtcccacttcgtgttcaaaacctggggggggggataagcaaggccccaggaaaaagggccaaagggaaaagtgcaatagggcccctaaatccaccccagaaaacttggtaaatggggggaaacacgtgtgaaaatatggaggggcccatacccaaagccgggagaattttctgtgtacaaaaaaacccttggggggacaacatttggtgaagaaaagccctgtaagagcccccaaaaag

SEQ ID NO: 91076 - protein, 54 aa, Zea mays
  misc_feature: Ceres CLONE 1579234
MASKALPQILPDPPGTKQCSKGAPPFELPQTNNSCASALTVLPGTTTGPEQIEP

SEQ ID NO: 91077 - DNA, 1070 bp, Zea mays
  misc_feature: Ceres CLONE 1579237
ggagctccccgcggtggcggccgctctagaactagtggatcccccgggctgcaggaattcgtctcacccctagaaaaaggaccgactacccacccgtctattctggtcacttcttttggggttctccgttcccctacccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctcttttgagggagggggaagtaataaaagggaaaaagctagcaaggggatttccttgatcccatcatcgtgctacagatcctttagttctagcaaggaggaggaaaaagagagagcaagcccatggatccccagccagatgatgttccccatctgggggggcgccgccctccccccgcccttgaaacccgcccctcgatgaatcacgccggccgccccccaaagcggcaggggccaggccctttcttccccccccttccccattcccaaaccgccggctgggaaaacgccaagaaatcccggcccgccccccggccctaatcaagccaaaggggccccctgggggaattctccccggtggccaaaaaccccgccccaagagctccgcccccctgggtttcaaagaaaaagcgggggggggcggctatccccccaacccaaaggcgcgcaaggttatttctcttcccccaagaaaccaagaaacaaacaaagttcgcccggcgcccgcgcaaaaacccaccctccctttaatacatccggggcaaaacgccgcccggacggcattggtccttccccctggttctccccgtggtcccgctatcggccgcccctgtgtttcccaaaccgcggtttcttccccttcccccgaagggcctagctgatatggtcccagcccacattgggggcgtcaagggttaccgcctcccttaagggcctcatccgcctccgtagttccccaagccagactaccccaaggcgg

SEQ ID NO: 91078 - DNA, 1176 bp, Zea mays
  misc_feature: Ceres CLONE 1579238
  misc_feature (8)..(8): n is a, c, t, g, unknown, or other
  misc_feature (55)..(55): n is a, c, t, g, unknown, or other
  misc_feature (56)..(56): n is a, c, t, g, unknown, or other
gccggatnagaccatattttctaaatgtagatagggtgtggggcacagagcgcanntgttttggaaggttttcaaactggactccccgcggtggcggccgctctagactagtggatcccccgggctgcatgaattcgtctcacccctagaaaaatcttcctcgcaacgccgacgctgcaacttccgctccctccccgactcgcgctcggcacgcaggcaggcgactgcggtggcgctcaggctcgggctctcagcaacggcggggttgcaagattttccagcatagcttgctcacctacttctcaatttaaaagacctcaatttctggaatcctgagcatcaaatcaagaccataccacttttagtcagtcctgtctgataggcactggactggcagctccagccaagtggtgaattcaaaagaagtggttcctcaaaaggaaacctattcaaggttgattgtaagcctggcccaccttgagaaacaatggggtcatatgggacaagggggtcgggcggttttggccatttgtaaacccccctccggaggggatgggaaaaatcccactccaaaaggaatccccacaagtaaagcgttagtaatcgggagtcccctggcaccaaaatgggggaaaggcgcgggttgtttttacggagaggaaaggaacaaaaaccactcgggaagaaaaagcaatttatcccgggtgtttaaaaatacacaaaaaggaaccaaaattgacccctaggggctacgaaagtctttgggcataatgagtgttaaaaaaaaacatttcaaacacccacccatatgagggaaggtaatcagtcttcgagtagacaacaatgtaggggagtagccccacgcaacagaacagcaatatggatggtgagtgtagagcgacggcacacgtggaggtgatatcacacaaatagttgccgtggccgcgtctggagataagggtatgtgaatttatcagcaacacaaaagattggtgggagagcaatgaggcgctgtaggtctgcagaaagagtggtggcgagaacagggagcgtttagggttcatgtttacgagaatgaaaatctgcggcctcgacagaataccattcttttaaataattttattcatcttgtgggctcagcggagagcaccatgaaatacctcatgagagaggagt

SEQ ID NO: 91079 - DNA, 938 bp, Zea mays
  misc_feature: Ceres CLONE 1579240
  misc_feature: Encodes the peptide sequence at SEQ ID NO. 91080
  misc_feature (356)..(356): n is a, c, t, g, unknown, or other
  misc_feature (519)..(519): n is a, c, t, g, unknown, or other
  misc_feature (533)..(533): n is a, c, t, g, unknown, or other
ctggagctccccgcggtggcggccgctctagaactagtggatcccccgggctgcaggaattcgtctcacccctagaaaaaaccccgtcgaactcctcatcgcctcatcgtcatctacctcgctcgcaccacacgcgaaaccgaacaaactactcaggcattgccgatactcacgccggcgaccgatgggatcggagggtgagatcaccggcccgctcctcgcgtcgggcgccggcgcgccggcgccagaggcggtgcccccgtggcgggagcaggtgacggctcgggggctggcggtcagcgccgtcctgggggtgctcttctgcctcattacgcacaagcttcacctcaccgtcnggaatcatccctcgcttcacgtttccgcgggggctgctccgctaattcctggttcgcaccctggaccgcggcgctcgagaaggtttggggtcgtcttccagcccctttacccaaaaggagaacacccgttttttagaacattggttgtctccttggtacaggnctccccttttaacnggggggggttggaaactcttttgcctttccacgggggccccagaacacctttagactttttgggggcccaattattccttgggaaaaagggcccgtggaatgattaaaacaactttctcctgggggggggaaggatagggaatcccccatttgttgttaagcccccctctcgggggggtttatacattttttgcccccccccccccggggttttgggagattgatttatcaaaccgggctttttttcccccgggggaaaaccccccccccttgtttttataaaaaaaatttctctcccacccaccttcgggggggaaacctttcttaaaccaaaaaaatcagggtgtgtgttgtgggagaaaaatcacccctctccttttttttttgggaacgcgctctttatag

SEQ ID NO: 91080 - protein, 151 aa, Zea mays
  misc_feature: Ceres CLONE 1579240
  misc_feature (58)..(58): Xaa is any aa, unknown, or other
  misc_feature (112)..(112): Xaa is any aa, unknown, or other
  misc_feature (117)..(117): Xaa is any aa, unknown, or other
MGSEGEITGPLLASGAGAPAPEAVPPWREQVTARGLAVSAVLGVLFCLITHKLHLTVXNHPSLHVSAGAAPLIPGSHPGPRRSRRFGVVFQPLYPKGEHPFFRTLVVSLVQXSPFNXGGLETLLPFHGGPRTPLDFLGAQLFLGKKGPWND

SEQ ID NO: 91081 - DNA, 1071 bp, Zea mays
  misc_feature: Ceres CLONE 1579242
  misc_feature: Encodes the peptide sequence at SEQ ID NO. 91082
ggagctccccgcggtggcggccgctctagaactagtggatcccccgggctgcaggaattcgtctcacccctagaaaaaaatccccatcaaaccccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgagctcaagcccgactgggccaagggctactcccgcctcggcgcggcgcacctcggcctcggcgacgcggccagcgcccgtcgccccctaagagaagggcctccgagctcgaccccccgccaacgaggggcctcaaagcgggggctccagggacgcccaagaaagaccgccggccgttcccctccgtcggccggcggggttgcttcggggccccgcaagccccttcggtccagaatgttttcccaggggcccccccagaccggttggaagacaagtaatctggtttccgtaacccccttccaaggtcgggggccttatcctttataaggaggccccgcatttttttatggccactaaggtacggggcccgcaaagtgtccaaagggaaaccccagagccgccatttagttatggttattctccctcccaattcccccccccaagaaagtcaggttggcctcacgccccccagactctaaatggttcaagatctcctaagacccccaagggccttcgagaaccgttcgcagatctatccccgccgcccccccgaaacagtcggcggcagccgtcagacgccgtccttctgaaaaacaaagctacggatgtgggagcccgagcccgaggcataaccgatggatttgatcgtagaggaaaagacccgcaggcgacaaagctgcggctcgataaaagaagaagtggtaa

SEQ ID NO: 91082 - protein, 171 aa, Zea mays
  misc_feature: Ceres CLONE 1579242
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAIALAPDNHVLYSNRSAALASLHRYSDALADAQKTVELKPDWAKGYSRLGAAHLGLGDAASARRPLREGPPSSTPRQRGASKRGLQGRPRKTAGRSPPSAGGVASGPRKPLRSRMFSQGPPQTGWKTSNLVSVTPFQGRGPYPL

SEQ ID NO: 91083 - DNA, 974 bp, Zea mays
  misc_feature: Ceres CLONE 1579246
  misc_feature: Translation starting site: 99
  misc_feature: SWISSPROT Homolog: EC 3.6.3.14 H(+)-transporting two-sector ATPase
  misc_feature (902)..(902): n is a, c, t, g, unknown, or other
tggagctccccgcggtggcggccgctctagaactagtggatcccccgggctgcaggaattcgtctcacccctagaaaaagactgagcttctctcactcatgtgggagataggcctcaatactctctccacgaccataaatatgcgttttgagccgtcgaacacggcgactttttctaattattatcctagattccgacctgccgtggcgtccctcctggtcatactcctccgcttcgttgcattccccctaccgcttccgtgccgcctcgcctcggctgcgtttcgcccgctttgggccgtccgcaccccccagtcgcgcggtgcggggaaatctgtcaacggggcagcccgctaccctttgtgcgctgcggcacaggtggctgccgccaacgagccagacagctcacatgtgaagacgcgagcgagcgtggaagatcacctatctagttcaccggcgaccgaggccatgcggaccatgtgtgccaggtggatcggcgccgtctgtcaacttgcgctatcgatgaggggctcccgggcatcctcacggcatctcataggtgctccacaacgatcttccgcctcgtgctcgaggtggcgcaacaccttgtcgagaacatagtgcgcaccatcgctattgaccgctcgtgaggggctcgtccgcaagacagcgcattcctcaagactggttcttccatcaccctgcctgttggcacggatgccctaggacgtatcagtaatggtatcggtgaggctattgatgagaagggtgatatgaagacttagcacctactccctatgcgtgaggacgtccctccctctgtgacaggcccctgaggagtgattcatgttactggaatcaggccgtggatcatctgcaccgtccaagtagtggtaaactganctatcgggggtgcaagattggtaaaacggtgctataaggagctatcacattgttgctaaggcagagcggttc

SEQ ID NO: 91084 - DNA, 944 bp, Zea mays
  misc_feature: Ceres CLONE 1579248
  misc_feature: Encodes the peptide sequence at SEQ ID NO. 91085
  misc_feature (944)..(944): n is a, c, t, g, unknown, or other
aaagctggagctcaccgcggtggcggccgctctagaactagtggatcccccgggctgcaggaattcgtctcacccctagaaaaaattgtttcccggctctccgtcccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctcccttgaggattatcatctaaaccaaaagcttgccccatttccgacagagaaacgtatccctggaaagtgtttggggcttgccccgggggagcccaattgccaaggggttttcttttggagggccacccccttgaatgtcctctccaacctttaacatgatgccgtgatttttccaccgcgggcgctcctggggggccccagtaaaagccctggttaatttggtccgcgggtttttcctatccaggttgtcggcacatgaaaacgtagggaaacacccttgtaaaaaccttgtgaggggaaacccccagtagggatttgcgcctgggcgaggttgcttgcccccccgggaaggagggggtaaatgttttcactcccccgctgggggataaaaaaacaatctcctcggaggttttttttcttacacagagaggggggagaaaaaaaggtcgcccggaaaaaaggggtgcacaccgtcgttttagaggggcgcaattctctgaagaataccattgtgttgggn

SEQ ID NO: 91085 - protein, 42 aa, Zea mays
  misc_feature: Ceres CLONE 1579248
  misc_feature: SWISSPROT Homolog: EC 1.11.1.6 Catalase
MDPYKHRPSSGSNSSFWTTNSGAPVWNNNSALTVGQRGPILP

SEQ ID NO: 91086 - DNA, 865 bp, Zea mays
  misc_feature: Ceres CLONE 1579249
  misc_feature: Encodes the peptide sequence at SEQ ID NO. 91087
  misc_feature (699)..(699): n is a, c, t, g, unknown, or other
ctccccgcggtggcggccgctctagaactagtggatcccccgggctgcaggaattcgtctcacccctagaaaaaaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgccccgcgctgtcgggagcagccggagcgctgccgcgaggctgctgctgctcccgcctctccggctgcggcgcggccggcgcgccgcctccgcgtgcgcggtgagggcgggcctgcacgggctcgactccgtcggcgggccccacctccaggccgcgctggagcgcgccgaggcggcgctctacacgctcgccgacgcagcggtagccgcggcggacgccgccgcgggcgcgggggacgacgccggccaagctgcggcggcggtccagaagaacggcggctggttcggcttcatctccgaggccctcgaggtcgttctcaaggtgctcaaggatggtctctcagcagttcatgtgccgtactcctacggattttgcatcatttctcttactatcattgntaaggctgcgacattgcctttaacccaaaagccaggtgaaatcaactatggcaatgcagaatttacagccgcagcttaaagcaatcagcagagaatagcgggcaccaggaaaaggatcagctagaaactggctcggaaacagggcaactgggggtcacccttttaa

SEQ ID NO: 91087 - protein, 172 aa, Zea mays
  misc_feature: Ceres CLONE 1579249
  misc_feature (147)..(147): Xaa is any aa, unknown, or other
MAKALLYSSLLPGLPRAVGSSRSAAARLLLLPPLRLRRGRRAASACAVRAGLHGLDSVGGPHLQAALERAEAALYTLADAAVAAADAAAGAGDDAGQAAAAVQKNGGWFGFISEALEVVLKVLKDGLSAVHVPYSYGFCIISLTIIXKAATLPLTQKPGEINYGNAEFTAAA

SEQ ID NO: 91088 - DNA, 1212 bp, Zea mays
  misc_feature: Ceres CLONE 1579253
  misc_feature (71)..(71): n is a, c, t, g, unknown, or other
  misc_feature (665)..(665): n is a, c, t, g, unknown, or other
ggaggggtggagggagggaaaaagggaaaaagaaatttctcccttccctttccctcacagacatattcttntcccaaaactggagctccccgcggtggcggccgctctagaatagtggatcccccgggctgcattgattcgtctcacccctagaaaaaatcgccagggcgtcggatcggagcgagctcattctcaactcgactcaagagctctgcctcctccatctccccttctctggcctccggagccacgctgagagatggaggcgaatcccaaagaacacccttcacgatcaaaatggaagacggggaagccccgggaaggaaggccggcttggccggtcgaaacagggtttccggaaacgtttctggcccaagggagggggtcccccaaactttgggccctcaataaaaaaaaacactagggggattttgttctgggggggcacccacctacaaattttcccccaaacactcggcggtccgcaaaggccgcccctcttataaaaaaaccccccccccggggggcccctattgtgtggaaaattcttatatggggagcttccccaccacggggggcggtccaaataacgctctctttttttttaaaaaaaaaaggggggggaacccaaccctcacgtgagggggggggggtattctcctttnaaaaaccggttcgttctcggtgtgtaaaaaccccataccatgtaatgcggtctaacaaacatattatgcaacccatctcgtggtccccccccacccaaatatagacaaacgcgcggggggaggggggaggggttaagaagccttccccatttatacgacgaatatgggtcgcgaaatctgcgtctcttccatatgttcgctatgataagccagcgtccgacaaacccatggtaataattccgtgcattgagttcatcgcgcatctcctcaacaaaagaaacaaccgcataaagctatcgtttcttagcctgtcctttctcgttcttggtgcccgccactaaataacactgaactataaaagtggggaacacccagggtgtgcggatgtgactgcggcagctgaaattaccgcgcccgcacctccccatgattgttcaggataggagtgaatacaaccgcctcacagtcatggtggcacgtccatcccgtcaccatacgcaggccacgtgagccataccaaggaagttgagacggaaagaatgaggac

SEQ ID NO: 91089 - DNA, 792 bp, Zea mays
  misc_feature: Ceres CLONE 1579254
  misc_feature: Encodes the peptide sequence at SEQ ID NO. 91090
  misc_feature (441)..(441): n is a, c, t, g, unknown, or other
  misc_feature (464)..(464): n is a, c, t, g, unknown, or other
  misc_feature (505)..(505): n is a, c, t, g, unknown, or other
  misc_feature (520)..(520): n is a, c, t, g, unknown, or other
ctggagctccccgcggtggcggccgctctagaactagtggatcccccgggctgcaggaattcgtctcacccctagaaaaaactcctttttttctcctctcaatctcccccgtctcccccctccctctcccttgcttccctctccagtccccagcgcgcgcgacacgacacgggccaatcacccagccgccgccgccggcgatcgccggaactcggcgccggtgcttccgagcacgctccgctcggaaccatggtgaggagcgggagcatacggcggccgcgggcccgcgcctatgccggcgccggcgtttaccgtgtccccgccgactcaggctgctggaggaagtggaacggcgcaacgccgtcgtatacgcgcggagtcattcccaccgccggacggtcgctgtgaagtgtctggatctcgatcgggtcaacagtaccntcgatgatgtaagaaaggagacntcaactatgagcttgatagatcaccctaatgtcatcaggtnctactgctcatttgntgtgggtcataatctttgggtgggaatggcatttccagtcgaagggtcctgcctgcccccaaatgaagtggaaatccccgagggttttgaaggaccaattttttgccctctttttaaaggaaaactccaaagtctttaaaaacctcctaaggcagggaaattttcttcccggggtgtaaaggcgggaaaatccccttgggaaaaacccgggggaagccaaaccccggggaacttttggggccctccccctcccacgttttaaaaaaaaggca

SEQ ID NO: 91090 - protein, 218 aa, Zea mays
  misc_feature: Ceres CLONE 1579254
  misc_feature: SWISSPROT Homolog: EC 2.7.11.1 Non-specific serine/threonine protein kinase
  misc_feature (147)..(147): Xaa is any aa, unknown, or other
  misc_feature (168)..(168): Xaa is any aa, unknown, or other
  misc_feature (173)..(173): Xaa is any aa, unknown, or other
GAPRGGGRSRTSGSPGLQEFVSPLEKTPFFLLSISPVSPLPLPCFPLQSPARATRHGPITQPPPPAIAGTRRRCFRARSARNHGEEREHTAAAGPRLCRRRRLPCPRRLRLLEEVERRNAVVYARSHSHRRTVAVKCLDLDRVNSTXDDVRKETSTMSLIDHPNVIRXYCSFXVGHNLWVGMAFPVEGSCLPPNEVEIPEGFEGPIFCPLFKGKLQSL

SEQ ID NO: 91091 - DNA, 828 bp, Zea mays
  misc_feature: Ceres CLONE 1579256
  misc_feature: Encodes the peptide sequence at SEQ ID NO. 91092
ggagctccccgcggtggcggccgctctagaactagtggatcccccgggctgcaggaattcgtctcacccctagaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactaccgtggcccgtgggggaacaggttcggctcctgtcgtcacgcggaccgcgttcactcccaggggcagtgaccgtgctgcttgcggcgaacgcgaacgggagggatcctggggtcccggcatggccaagcaagaaatctcaacaaagccatctcggtccctgtttccggttcccccactggcaaccctacccaaaaggaacttaaaagga

SEQ ID NO: 91092 - protein, 171 aa, Zea mays
  misc_feature: Ceres CLONE 1579256
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYRGPWGNRFGSCRHADRVHSQGQ

SEQ ID NO: 91093 - DNA, 1211 bp, Zea mays
  misc_feature: Ceres CLONE 1579267
  misc_feature: Encodes the peptide sequence at SEQ ID NO. 91094
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (1043)..(1043): n is a, c, t, g, unknown, or other
gggggggttggctttttttgatggggacgaggacgggggaggggaaagacatatagatcgggttatatagnnnnnnnnntcaaaactggaactcaccgcggtggcggccgctctagaactagtggatcccccgggctgcaggaattcgtctcacccctagaaaaacatcaccaccaccccgcggctgcagctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgtggacgacgactgcaagcgccggttcctggagctcaaggccaagaggacgcaccgcttcatcatctacaggatcgacgagaagaagaagatggtggtggtggagcaggtgggcaagcccgtgctcggctacaaccactttcggcgccaggctccccgccaacgagtgcaggtacgccattcttcgactaactacttccgtcaaccgaaggaaaaactgccccgaaagagccaagattctttcttccatcccccctggagcctcctggaaacggggcccgcgccctgtaagggaacccaagaaaggaatccctaaccccccaggccttcccaagagaaaagaagggtttccaaaaaccccggggaaaaccttgtgaaaaccgggcccttttcccaaggggtggaggaaaatacctttcccaccgggggggccacaacacacggaataccctccccccgcccccccaaaaagatttttgtggggggcccctcttgtgggaaacgcgtttctctaattcccaagagggggggcccccggggggaaccaaaaaaccctggagagggaaaaatgggcccccccaggggggtaaatgtaaaaacgtgcgcccctccaatgtggcccagaaaaaggggaatgttgtattgggagaaaaacaacccattcccagtggttttcgaaaaagtgagagaaacacacttttattctctcggggnccgggggcccttatatttataaaaaaaactgggatttctcccaccgcccaagtgggggtgggaaatattcattgtcttaggaaaaattttaaacacacccccccctttgagaaggcggtggggtgtgttctttgggttaacgtattcaacccaaccacactttctttg

SEQ ID NO: 91094 - protein, 113 aa, Zea mays
  misc_feature: Ceres CLONE 1579267
MANAASGMAVDDDCKRRFLELKAKRTHRFIIYRIDEKKKMVVVEQVGKPVLGYNHFRRQAPRQRVQVRHSSTNYFRQPKEKLPRKSQDSFFHPPWSLLETGPAPCKGTQERNP

SEQ ID NO: 91095 - DNA, 1192 bp, Zea mays
  misc_feature: Ceres CLONE 1579268
  misc_feature (11)..(11): n is a, c, t, g, unknown, or other
  misc_feature (15)..(15): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
  misc_feature (71)..(71): n is a, c, t, g, unknown, or other
gggggaaaaancttnttatatacctaacgctgcttacccaaaccccctctcataatcacncgatccnntnnaacaaaatggaactccccgcggtggcggccgctctagaactagtggatcccccgggctgcaggaattcgtctcacccctagaaaaaaaaattggctggcaaggccgacactccaccatcctccatggccgttaagcccacatccatcatcgccgcctccgccacagcacgccatggagaccaacaagtcgccaccgctctactcggcgccgcgggagccctctgccacgacagtgatgctgtgtccgtgcctggcgttcttcctcctcgctctcatcatcacctccatcgcactcactgtccactttcgcctctactgccacactcctcttgcccacctcatctccccgcaacgctgcccccaccacatctgacctccgtctcccgcccgcatcgctggggtgggccctgcttcccaaaggcgtgttccctccggctgcccgccgagatccccgatactttaactagtttcccctctccttcgcgaaagccgggcatgcggggggcttaacaaacgttgcttctgagggggctttcccacaacccggaaaaaggttcccctcctcccatcctttgggctggcccctcccggaaccaaaaaaaaatcaaggggcctctccttctccggaaacccaagtaaagggccgggtttgttttaaaatcacaaaaccctcccgataaagggggcgctttgggaaaaaaaccccaccgttatatctttggtgagccggggacccccctattccgcgcgcgggaaaaaaagtttctctgttcccagcccccctcttcccggggtgggtccccccaacaccccgcaaaaaacacactttgggtaagggggcggggggcgcgcctttaattacttcgggcggattttttatgtgaccacaaccagttctttttgttgaaaaaaaaagacaggatcccacgggcccaccaccctgtattcttccccccccaccgcccctttttaaagccaacgctccacatattggggcggggtgcctataacacatctttctttattaagagggtgggggcccccaaatatttctcccggggggttttgtatttcccccccacctccccctttatctcctatggtgtagagaagaatgtaca

SEQ ID NO: 91096 - DNA, 852 bp, Zea mays
  misc_feature: Ceres CLONE 1579275
  misc_feature: Encodes the peptide sequence at SEQ ID NO. 91097
ggagctccccgcggtggcggccgctctagaactagtggatcccccgggctgcaggaattcgtctcacccctagaaaaactccccttcactcgagcgccgcttcctctccccttccatcgagcgcagcgcctgcgccgccgccaccactccgcaccgccgccagttccccacttcctccccacacccgaatcggattgaagccagaaggcaaggtgaagagtgggcttgggtaacggttgcaaagagatatccccaacagttgcagtcactcgcatccagtcggctcagctatggaggaggactcatcagcgatggagccgaataggctgcgcgaggccgaggcggcggctggggagctgaagaggctgcgcgaggccgggcagtctcagtacatgtaccggtctatcgccgacgccagggttgtcggcggccgggtctgcctcttcgccgtcgtctccgagatcggcgctaccgtccacagccgtggcacggatttcactgttacgttgagggtaatagatgaatcatacaagtctggaatatctgtaactttttttgctgacagcactgcactattgccttgtgtgaagtcgtgtggagatgtgatcagtctccataacgtcgtgataaagaaatatagagatttctttgtggcatttgaccaaaagtactctcattcgggctgtttgaaggcaaacgttactgaatgccgtcatatcggactttttaagaaatccgggcggcgaacacgacaagatttttttaatcgaataaaaccgggtttctttagggctgaagggtttcccttccaaaattcccgaatggttttaagaaattgaaaggccgcattcc

SEQ ID NO: 91097 - protein, 182 aa, Zea mays
  misc_feature: Ceres CLONE 1579275
  misc_feature (65)..(181): Pfam Name: Telo_bind Pfam Description: Telomere-binding protein alpha subunit, central domain
MEEDSSAMEPNRLREAEAAAGELKRLREAGQSQYMYRSIADARVVGGRVCLFAVVSEIGATVHSRGTDFTVTLRVIDESYKSGISVTFFADSTALLPCVKSCGDVISLHNVVIKKYRDFFVAFDQKYSHSGCLKANVTECRHIGLFKKSGRRTRQDFFNRIKPGFFRAEGFPFQNSRMVLRN

SEQ ID NO: 91098 - DNA, 1279 bp, Zea mays
  misc_feature: Ceres CLONE 1579276
  misc_feature: Encodes the peptide sequence at SEQ ID NO. 91099
gttacctttcttaccctctttccatcgaacataccgttgtatatttaacctcattacttccttcttcccactctggtacttcccgcggtggcggccgctctagaactagtggatcccccgggctgcaggaattcgtctcacccctagaaaaactaaaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaactagagagatcgagagaaagaaagggagggcatccaccagccgccggcgataagaggggaggatagagaggccagagaagaggaggagaagaagaagaaaaccaccagctgcctctgccttccgaaaaaaaaggaggggccagcgaaggagaagccgtccacagatacccccacctcgtcactcctttcagaaccagaagcccctcccctaagcctccaccctccttccttccaaggtcttccctccaaaggggctatgggatccccaccccgtcaaggcgccttaaaaaagcggggctcccataaagtttcaagaccccgaaggtcctatgtaacaagaaaaaccggggagcatgtttccgtaaacccccttcaaagatcccgggtccaataagccaccgaggggaaccactgagttggtttccgcaatgggcatccctaaattccaccgactgtagtcgcccccgcttccccgcttgtaactctctggtggggctcctggctaatcccccggtgctcaatgaccatgttcttaacgagtccctagccaaaatatccgcacgtctcaccttgtgtccctccaaccctgtaccctatacaagcattctaaggaatatgccccggcgccaccactgtgtacctgaccacctatttaatattcattccccagtgagtgccactaccatcccatgctgtcactgattcatatcccgacgcgactatatagcgccctctaagatatcacccggccgctttggtctattcagggaggtcaacccacttttttaacctcataaggaaatgggcagcgtaccactaaaacaatgtccactcttcttatcttacataaaaaccaccatatggggaatatcgcgatgcccctggccctacataatcaaaggtgagataaaaa

SEQ ID NO: 91099 - protein, 51 aa, Zea mays; identical to SEQ ID NO: 82348
  misc_feature: Ceres CLONE 1579276

SEQ ID NO: 91100 - DNA, 1325 bp, Zea mays
  misc_feature: Ceres CLONE 1579277
  misc_feature (7)..(7): n is a, c, t, g, unknown, or other
  misc_feature (8)..(8): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (883)..(883): n is a, c, t, g, unknown, or other
gtttggnngtgggncnngcttcttcccataccgttgttatttcacgtggtacgagggcggaccaccgagagaggaaatttacaaaactggagctccccgcggtggcggccgctctagactagtggatcccccgggctgtctggaattcgtctcacccctagaaaaaccgttcgccttcctcgcccccatctctttctcgccgtgccactcccacctcttttcgctgataagcacgccgctactccccactccatccatccatccacccgccgcttttctctctgctttggagagggagccgcacgcagtggtttggtgccgctggtccgccagggtcctgggcgctgtgctcattccaccggtcggcggtgggcttttcaagcttcttcaacggtgtcgagagtggaggaaatgtcgacgacagagtgcgcggacctcggggaggagttctggctgcccgaagactttttggaccaccacctcctctcctaagaggataaagctgcccgtggcagcccgggagcgtagagcgaacaagggagggacagccttggggagggggctcctcggcggccggcctccgtggggggccttccctccgggccgaaacgggggggaaaaagccgcaaaggggcttcccccggccggtgcccaaaggggtggaaatggtggaaccgtggtttggggggttctgccccctccgatagttccgtaaaacacccctttctggaccagggagcccttggcccacccaaaaagattccctgcggggggcacaagagaggtagaaataaaccccccacccaaatacagcagtgatcagagtggggagtgccgcatgtcccccgaaaaaagtggggggcgctaaactgcgtgattaacnacacaccccgaaaaccgcggaattccgaaggtttcccagcaccccccacctcatgaggggtagagaccacacaaaaagaaggggcccccctctctccccgataaaaataccgctcgggtgtgggggaggagatattttggtagtgtcttttcttatgacaaataagacgccgggaggtacgccggggaaaatacaaggggctttgtatcgacaccacaccaatatgtcgcgcgctgcgcccgcgctctcaaaaacagagtacgggagtggccgcggggagggagctcagggagcgcctctccaataaaatgggtgtttgtccccatcttgtggctccttctagatgcgcgagggtgtttcatcagaaagcattaccggctcgacagaaataaatgctccatatttacacatcgagtgttagaatatgtatgtacactttccc

SEQ ID NO: 91101 - DNA, 929 bp, Zea mays
  misc_feature: Ceres CLONE 1579280
  misc_feature: Encodes the peptide sequence at SEQ ID NO. 91102
  misc_feature (756)..(756): n is a, c, t, g, unknown, or other
  misc_feature (803)..(803): n is a, c, t, g, unknown, or other
ggagctccccgcggtggcggccgctctagaactagtggatcccccgggctgcaggaattcgtctcacccctagaaaaactcgctcaccctctcaccaaatccttctcctccgcgccgccacagccgggcgcgcctctcgatcgagatccaggagatatgcctcgttatgatgatcgccatgggaatacacgcttgtatgttggaagattggcccctcgcacccgttcccgcgacctagaatatcttttcagcaaatatggaaggttttcggttttttacccaaccatggaggtctgtggtggaagggtgcccttggtggaattggtggccattgttccgatatttgtggaggactttggtgaagggcgcccttggtgtaatcttattgactgttgtagatgaagttgcaagttgatgcatttgagtacttgactcatgtcagcagcttactgtttgtggaaactatttgcgcagaatacgtgaagtggagttgaagcgtgactatgcattcattgtatgttctactacactcaggctatctccaaccattccccctcccaatccctccatttgtactttctattcatatttaaatacattcccctcaactattcttccccctattttttctcctctccacccattccccctattcagctccccctttactctttaactgagctatttgccttatatatatatatatatatcactttttggattttttaaatatactaccatatttgtagtaccgtnatacacattgttatctagtaatatacttaaaaaaattatttcacagntaaagcactgattaacgaattggggagaatatagatctccctcgtgtacgggggcgcagaagctgataccttttgagaggtccccaagcggcctccttgaaagcgccggggatacggctccctcat

SEQ ID NO: 91102 - protein, 81 aa, Zea mays; identical to SEQ ID NO: 84891
  misc_feature: Ceres CLONE 1579280

SEQ ID NO: 91103 - DNA, 864 bp, Zea mays
  misc_feature: Ceres CLONE 1579283
  misc_feature: Translation starting site: 458
ctccccgcggtggcggccgctctagaactagtggatcccccgggctgcaggaattcgtctcacccctagaaaaaatccaagttccaagcggccccaaacctgagcgagcagttttcaggcaggaatgaccccggtctcacatgtcagtgagtcacaacagccagatggaaaggcccacgtcatctagtcattggttgtgaaatccccgttctacccctcccgtctctgatctcgataggggagccgggggagcgcgacgacggggagaaaaaacagaggaggaaaaaaacacccaaaaaaccaccttcttttcctgcgttcccctgctcgatccccgacgagaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcagcagcagaggctccggcagcagcagcagcaggcgctcctgatgcagcaggcgctgcagcagcagcagcagcagcagcagtaccagtccggcgtcctcgccgcggcggcggcggcggccatgacccagatggaacctgtttccaatggcaacttccacctgggtttgatccttccacttgtcgcagtgtgtatgttgggaatgtgaaccctaatgtcacggagagccttttgattgagtttttcagagtgctggcccttgtggaaagatgcagctcatacgaaagagaagtctcctttgggtttggggacactatgatcaaggactgctgctctagcatcatgacccttcatgggcctcccctatatggaaaagca

SEQ ID NO: 91104 - DNA, 1166 bp, Zea mays
  misc_feature: Ceres CLONE 1579291
  misc_feature: Translation starting site: 245
  misc_feature: SWISSPROT Homolog: EC 4.1.1.49 Phosphoenolpyruvate carboxykinase (ATP)
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (42)..(42): n is a, c, t, g, unknown, or other
  misc_feature (723)..(723): n is a, c, t, g, unknown, or other
  misc_feature (1000)..(1000): n is a, c, t, g, unknown, or other
ggtggggtgggnnnnntnggggtggggggggtgggggttttntgtatgtttttactgggggtagagggagggggaaagtggagctccccgcggtggcggccgcttcacaacagtggatcccccgggctgcttgaattcgtctcacccctagaaaaaacgaccgcttggcgcttcatcactcgtttcctttcgaaagcccgcgcacgcacgtcggtcgtcccgagcaggacctcgatcggcctagatggcgacgccgaacgggcttgcgcggatcgagacgaccgggaagaagaagcaagacaacggcgtgtgggtacgacgacagctcggcgccggggcgcgcgcagaccatcgacgagctgcacccgctggggcggaagcgggcggggcccaggacgccccatcggtccggggccccccacgccctataagggggggggcccactcgcccttccccccttccggatttgggggggggggacccccccaccccagcagaaggcaggcccaaccccgggcggtcttttggggcgctcccgtgaagccggggaaaaaccggggcccaaaaaggggttaaagggggcgaaaccccggtgggccaaaaggggaagaagggccccctccccccagggggggggccgccccatttaaaaaacgccaaagggggggggctcccatagctggaaaaaagggggaaaagccggggtgcggaggcaaccgggngacaaagtggcccctgttccaggcggaaaaaaagggctccccccctctcacgggggggattaaccaccccgagtgggggcgctctccaacaaaaaccccttttattaccgcgccgtggggtggtgagttcctttgtggttcaaaaaacccggggggggagtacctacatgttttccccaagaatagggtgggggggccgggctttcttattcagctggatgtgcaaacacgggggacgtgcgtgtggggagagatacagcgggagtcgctggggggngccccaaaaaaacctgagaggggcgggggtgcatccactgggcgataataaaaagcgcgggggtggcggttttgttggacaagaagcggtgacgccccggtgcctgataaaaacaccgtaagtgaggtgggggctacaagggggtctctctcgccacaaaatcggg

SEQ ID NO: 91105 - DNA, 914 bp, Zea mays
  misc_feature: Ceres CLONE 1579292
  misc_feature: Encodes the peptide sequence at SEQ ID NO. 91106
ggccgctctagaactagtggatcccccgggctgcaggaattcgtctcacccctagaaaaaatcctcctctttccattccactctctcactctctctctaatcacactttcgacactgatcggtactctagtgtccgactcgtcacaattttagcgagaacgagcgagcgagcgagggagaggatgggttccacaggaccggcgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgttttcccccccccccacaatccgacactcggggcggccttatccgtcgggccacgggaaagcacggggtggctggggataagcctccctaaatgtgccccggccttggtctatggaaaggctccgccttccggggggtcccccgatggggtccgggggacccgggtttgtgggaaacctggccgctccaaatataatttgcgggggttaaaaaaccgccccggaagggacagaaagataagccttttttgcctgtcccctggaggaaacccccccccccgggggggccaaaaaagacttgtcgaaaattggggggggaccccagagaaaaatttggttttgccgcccccttaggcgccagaagaacgaaccccccggggaaaaataaaaattggggcgaagtgaaaaaaaaagaagtgcgccgggcttttttcagggggggggaggcctccccaaattgcatggggttacgggaactggtgggggggaaacccccaacgcccgggtgagagcgccccagagaggcgccctctgaggggcgg

SEQ ID NO: 91106 - protein, 93 aa, Zea mays
  misc_feature: Ceres CLONE 1579292
MGSTGPASGFAAPERDIDDLPRNDANYTALTPLWFLERAALAHPGRASVVHGPVRYTWADTYRRFPPPPQSDTRGGLIRRATGKHGVAGDKPP

SEQ ID NO: 91107 - DNA, 1310 bp, Zea mays
  misc_feature: Ceres CLONE 1579302
  misc_feature: Encodes the peptide sequence at SEQ ID NO. 91108
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (841)..(841): n is a, c, t, g, unknown, or other
  misc_feature (925)..(925): n is a, c, t, g, unknown, or other
  misc_feature (1044)..(1044): n is a, c, t, g, unknown, or other
  misc_feature (1249)..(1249): n is a, c, t, g, unknown, or other
  misc_feature (1260)..(1260): n is a, c, t, g, unknown, or other
acggcgcgggctgtggggtgttaattgaattttgttcccatcaccatctaacaatcaaannnnaatttttttacaaagctggactcacctcggtggcggccgctctagaactagtggatcccccgggctgcaggaattcgtctcacccctagaaaaaacaaccgaccaacgcgctttgtaacgcctccgctgcaatcagcccccgcggcgagcttgccctgcccctgaccctgagtgctagttctcgccgttacgtaaggcttcttggccttgcgtcctccgtctttcgttgctgatacatcgaggtattaaagaagctgcctgattccgggtagcagaggtcgccgccgcctgcagcaatggccgacttctcctggctcacggtgcttggtttcctattcctcacattcaactcaggcatggcgatttatcgggccaacagtgacccctgctccgtcactttcatcgaggtatcttaactcgacctagtggccctgatacaccaagcttgcgcttaaaacaagcaggttggatcaagcaccactccccaaaaggcgcgccgaggggtcaaagggcatgggggttttagaaagaacatcaaacaaaccccttcccttgagcgagatgcacgggttttcatattttaaccaaatgccggggcttgggaaggaatgtaaattggcgcgccctataggcccaatggttgccgaaataccatggcgcggtggggcatcctcggggcgttcccagcaaaatgtggagacaagaggccccccggggcagataaatctccccacaccccccccgtgctattgggtgggcgcacgagacaccccccaanatatcccgctatattccggcaccccccactcatataccccattattctccgaaagcccgcccccatctggattgtccggggacnaacataaaaaaacgcgccccttgtggtgttccattaagttgtgccacggcgggttccactagatatcgggggggcagcgtctttcaaaccaaacgggggcggcatcacgcgtgataaantgtagactgtgtcccctataagggtgtatatgggcgctgggaggtcccttagccctcaaaaactacgtgaggggatgtgcccgcggacagtcatagatccctcctcgagcgcacgaggaagtgctgacaacattgatgcttgagacacgcgaggatatacgcagaggggattaacgagggacactacagtcggggggtggtaatntgcatgaacanctacagacgataacaacaaccctataggacagacggttctccaatctcag

SEQ ID NO: 91108 - protein, 39 aa, Zea mays
  misc_feature: Ceres CLONE 1579302
MADFSWLTVLGFLFLTFNSGMAIYRANSDPCSVTFIEVS

SEQ ID NO: 91109 - DNA, 861 bp, Zea mays
  misc_feature: Ceres CLONE 1579307
  misc_feature: Encodes the peptide sequence at SEQ ID NO. 91110
  misc_feature (678)..(678): n is a, c, t, g, unknown, or other
  misc_feature (679)..(679): n is a, c, t, g, unknown, or other
  misc_feature (682)..(682): n is a, c, t, g, unknown, or other
  misc_feature (685)..(685): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (722)..(722): n is a, c, t, g, unknown, or other
  misc_feature (724)..(724): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (773)..(773): n is a, c, t, g, unknown, or other
  misc_feature (798)..(798): n is a, c, t, g, unknown, or other
  misc_feature (804)..(804): n is a, c, t, g, unknown, or other
  misc_feature (806)..(806): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (840)..(840): n is a, c, t, g, unknown, or other
  misc_feature (841)..(841): n is a, c, t, g, unknown, or other
gagctccccgcggtggcggccgctctagaactagtggatcccccgggctgcaggaattcgtctcacccctagaaaaactggcaatccccatccccaaatctcccatggcttcttcccctccccagccactcacccgcaccgtcctcgccgctaccctgctcctcctcctgcacaatgccgccgccagagccgacggcgcgtcgccggcggtgaacccattcacggcgaaggcggcattcatccgatactggaaccgcaaggtgcccaacaaccgcccgcacccggccttcttcgtcgccaaactctccccgctcccggccgctgactccgcctccttcccatccgcgctgcccgacatccgcgccagcctacccgcgctctgctccaaagccgcgctcctctgccccgggccggctaccaccgatgcggcgtcgctggtggcatcgggccgcaggggcggggggcccttcaaaggctacaacaacgccaacttctccaactacggcaccggcggcgtagcggggaccgactcgttccagaagtactcccccggaacttcaacatcgcccgtcgaaaagggttttcccccccccttaaagggggggggggggagtttttttgtggggggggggggcggccccaaatttttttttcctttttctttttttctagagaatnnggnagnagagggggggggggcgctctccgacgggnnnnngccngnggcacactcctctcctcccccccccccttcccnnnccnnnnnnnnnacnccccccccaccgccggggggggggntttttntnttttttttnnnnnnnngnnnnnnnnnngnnnggnnggcgcgcctccccccgcaac

SEQ ID NO: 91110 - protein, 252 aa, Zea mays
  misc_feature: Ceres CLONE 1579307
  misc_feature (192)..(192): Xaa is any aa, unknown, or other
  misc_feature (193)..(193): Xaa is any aa, unknown, or other
  misc_feature (194)..(194): Xaa is any aa, unknown, or other
  misc_feature (204)..(204): Xaa is any aa, unknown, or other
  misc_feature (205)..(205): Xaa is any aa, unknown, or other
  misc_feature (207)..(207): Xaa is any aa, unknown, or other
  misc_feature (218)..(218): Xaa is any aa, unknown, or other
  misc_feature (219)..(219): Xaa is any aa, unknown, or other
  misc_feature (220)..(220): Xaa is any aa, unknown, or other
  misc_feature (221)..(221): Xaa is any aa, unknown, or other
  misc_feature (222)..(222): Xaa is any aa, unknown, or other
  misc_feature (232)..(232): Xaa is any aa, unknown, or other
  misc_feature (234)..(234): Xaa is any aa, unknown, or other
  misc_feature (237)..(237): Xaa is any aa, unknown, or other
  misc_feature (238)..(238): Xaa is any aa, unknown, or other
  misc_feature (239)..(239): Xaa is any aa, unknown, or other
  misc_feature (240)..(240): Xaa is any aa, unknown, or other
  misc_feature (241)..(241): Xaa is any aa, unknown, or other
  misc_feature (242)..(242): Xaa is any aa, unknown, or other
  misc_feature (243)..(243): Xaa is any aa, unknown, or other
  misc_feature (244)..(244): Xaa is any aa, unknown, or other
  misc_feature (245)..(245): Xaa is any aa, unknown, or other
  misc_feature (246)..(246): Xaa is any aa, unknown, or other
MASSPPQPLTRTVLAATLLLLLHNAAARADGASPAVNPFTAKAAFIRYWNRKVPNNRPHPAFFVAKLSPLPAADSASFPSALPDIRASLPALCSKAALLCPGPATTDAASLVASGRRGGGPFKGYNNANFSNYGTGGVAGTDSFQKYSPGTSTSPVEKGFPPPLKGGGGSFFVGGGGGPKFFFPFSFFLENXXXEGGGALSDGXXPXAHSSPPPPPSXXXXXTPPPPPGGGXFXFFXXXXXXXXXXARLPPQ

SEQ ID NO: 91111 - DNA, 903 bp, Zea mays
  misc_feature: Ceres CLONE 1579308
  misc_feature: Translation starting site: 209
  misc_feature (335)..(335): n is a, c, t, g, unknown, or other
  misc_feature (418)..(418): n is a, c, t, g, unknown, or other
  misc_feature (422)..(422): n is a, c, t, g, unknown, or other
  misc_feature (424)..(424): n is a, c, t, g, unknown, or other
  misc_feature (425)..(425): n is a, c, t, g, unknown, or other
  misc_feature (501)..(501): n is a, c, t, g, unknown, or other
  misc_feature (511)..(511): n is a, c, t, g, unknown, or other
  misc_feature (528)..(528): n is a, c, t, g, unknown, or other
ctccccgcggtggcggccgctctagaactagtggatcccccgggctgcaggaattcgtctcacccctagaaaaaaccaactcacatcacacctcaccttccactccagaagaagaagccagaccggaatcccgagagccctgcccctgctccctcggttcctcctccgttgggcgtttggccgccgggggtggtgggccgagaccgagatgatatcgtggaacgatgtatacacggtgctgaccgcgatggtgcccctgtacgtggccatgttcctggcgtacgggtcggtgcggtggtggcgcatcttcacggcggaccagtgctccggcatcnaaccgcttcgtggccatcttcgccgtgccgctgctgtccttccacttcatctccaccaacgacccgtacgccatgaacctccngttncnntggcgcggacacgctgcagaagctggtcgtcctcccggggctggccgcgtgctcgcgcctgccctccaggctgggngcgcccccgnttggactgggccattangcttttttctcgtgtcgaacctgcccaaaacggctgggataggcatccccctgctgattcccctgtaccggccctacgcccgggccccaatgggtgcaagggggggggcccccagtggcccatctgggaaacccggcgggcggttcccttttaaattcccccccccccggaaacccttttcgggaaaattttccggaaaaccggggggggccctttggttctctcccggggaccccaaaacggtgttccctcggggggggggcccccccaaaaagaggcccaagtggggggaaaaagccgcggtctcctttaaaagtggcccggtgtttttgggtttccggggggttctttttgttgagaaaccccccccccccc

SEQ ID NO: 91112 - DNA, 1131 bp, Zea mays
  misc_feature: Ceres CLONE 1579309
  misc_feature: Encodes the peptide sequence at SEQ ID NO. 91113
  misc_feature (15)..(15): n is a, c, t, g, unknown, or other
  misc_feature (93)..(93): n is a, c, t, g, unknown, or other
  misc_feature (1043)..(1043): n is a, c, t, g, unknown, or other
ggaaagaaaaaaaanggacaaaaaaaaaaaagaataattatatcatatgaagttagatttatttttagtttctttcaaagctggaactccccncggtggcggccgctctagaactagtggatcccccgggctgcaggaattcgtctcacccctagaaaaaagtccacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgctttccgcaacgagcagtccgcggggtacgccgccacctcctacggcttcctcacgggctccccgggcgccctactcaccgtctccggcccaagatgcgtccacgggctcgcgggcactctcccacgccaccgccaacgactgagccgcctcctcatgaatctccggaatcctggcgaatacaggctgaacgccagggcagggggcgtactttccatggagcttcgaacctagatccgcccggcccactaaagccccattcggccaagaactcggcccgtatcaaaggcaaaacaaaccacaattcgcccgaaacatttctccgggcggcaccatccgattcttttcccacaaggacccctttcgatcccatacccggccataagattacccggggaccacgtttcccccttgaaaggagttaggcctaaccacatcggaataaattccctcatttcaacgaaaagtgtgtcctatcccaacccataaaacaccccattcacactggataaataccacagaagaggtcccgcagggacattcccttcaaataattcacttgccaaggccaatggaccagcccgcgaatatttcagggcacgcgctatttgctcgagaatccgcttntcaccaaccggagccacaatggcgcctccgtaaggttcactccctgtcgcgtaacacagatggggagaaaacctcgcccataaacaaa

SEQ ID NO: 91113 - protein, 129 aa, Zea mays
  misc_feature: Ceres CLONE 1579309
  misc_feature (11)..(129): Pfam Name: TPP_enzyme_N Pfam Description: Thiamine pyrophosphate enzyme, N-terminal TPP binding domain
  misc_feature: SWISSPROT Homolog: EC 4.1.1.8 Oxalyl-CoA decarboxylase
MASDSTAAVTVDGSALAGRALAAAGTRHMFGVVGIPVTSLASRAAAAGVRFLAFRNEQSAGYAATSYGFLTGSPGALLTVSGPRCVHGLAGTLPRHRQRLSRLLMNLRNPGEYRLNARAGGVLSMELRT

SEQ ID NO: 91114 - DNA, 1141 bp, Zea mays
  misc_feature: Ceres CLONE 1579310
  misc_feature: Encodes the peptide sequence at SEQ ID NO. 91115
  misc_feature (16)..(16): n is a, c, t, g, unknown, or other
  misc_feature (18)..(18): n is a, c, t, g, unknown, or other
cctctattccgttccntntattactaagattagatttttccttttcaccaccccctcccgccctgtctaataaaaaatttacaaaactggactcacgacggtggcggccgctctaaaactagtggatcccccgggctgctggaattcgtctcacccccctaaaaaaatgggatacgccgctgcaatatacaccatggagtgtgccaaggaacgcaagcatatgctcagcgtacatatcagcaacctgtatatacgcaacatgcatattcccacccccaacctgcgaaagcttcaaacccttttgatcttcggaatgggccagcttcaagtcaagctcacatgcccctgtcaggaccacccaggagtattagcaagcccatctcccccaagattaatcagcaatctctaggattggtggacctccacagcagcctcactagctctataaatcatcctcatatccaagccatatcatgagtgcagaaattccaaacaacacgcccatgccccagaaacaaacaaaaaccatgattggaacgcagcaaaagcccgagatacctaacagccccaaaaaccaaaaaattaattaccagcatcctatggggggaaactaaatacaatatccggctacaaaataagctgtggatacataaccttgtttcctattaactctgcaaagaccaaaagtgggaactgggagcgaccctccatcctgtggcacaaaaaccaattgcaatgcctggaataaaaccctccaaaaagtaagaaactgatgcgttttaaaattacccacgccccggaagggcgaatagtggaagaaaatgccatcgacccagcaacttattgattgaaatcaacaaaattcttataagacattataatgagccttgatccaaatacgaggggcttcttccatttcattaaaacacaaatgggctagttttaatcgcctggcctcttagtataaccggtgcctatttatcgccatagccactaaccaggaacccctgcaacaacttccctatagaatataaaattatacctcatatctcagtgtattgagagaacgtctgggcgacttgggtaaacaggccacacaaactgagaagggccgtgatattaattctcttctcccgaataa

SEQ ID NO: 91115 - protein, 80 aa, Zea mays
  misc_feature: Ceres CLONE 1579310
MGYAAAIYTMECAKERKHMLSVHISNLYIRNMHIPTPNLRKLQTLLIFGMGQLQVKLTCPCQDHPGVLASPSPPRLISNL

SEQ ID NO: 91116 - DNA, 767 bp, Zea mays
  misc_feature: Ceres CLONE 1579312
  misc_feature: Encodes the peptide sequence at SEQ ID NO. 91117
  misc_feature (163)..(163): n is a, c, t, g, unknown, or other
ctggagctccccgcggtggcggccgctctagaactagtggatcccccgggctgcaggaattcgtctcacccctagaaaaacccatcccagatcaggattagccgaccacccgccgaaggccagagagaaatatctcatcttctctccaccggatcggttcaantcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttccgtgtccttttgcgctttctcgtccctctttctctcaatctcccccttatctttctccttccacggcaaaaccgggcggctggaatgggatcccaatgggccccaaaactgggaggccctttttgctcccgaaacccatcaaaaggggggggcacagtccccccccccatccgggatttggtcacccggggggggggggaattctcgggggggttttaaaaatttcccccgggggccccctccccaaaattttttttttttttaggggggggccgttttttttgggaacccccggagagaattctttttttggggggggggcggccctttcttccgggggaaaaccccctttgtggggggcg

SEQ ID NO: 91117 - protein, 47 aa, Zea mays
  misc_feature: Ceres CLONE 1579312
MSCFAHRRRSDVARRQDGLLVFVFFLSIPIRTSSFNLSSSNCSSNLL

SEQ ID NO: 91118 - DNA, 1333 bp, Zea mays
  misc_feature: Ceres CLONE 1579314
  misc_feature (821)..(821): n is a, c, t, g, unknown, or other
tcttgcgtttgcctcctccctctttctccgtgtgtgtggggggggctcttattttcccctttgttttggcccggggtgggcgccgcggcggccgctctaaactagtggatcccccgggctgcgggaattcgtctcacccctagaaaaactctcgaaaccctagtcctctgttacttctccctgcgccgccgatctggtcgctggtctccgcctccgtcaatcccctcgcggtctccgccaatgctggtgagaccgagaagagagggccgcgaagggtgatgggccggtaattcgtatcgatggtcggaacgacctactcttgggtgggcgggtgggcggaccaccttggggtgatcatcgacagcgacctgggtaacctttagctctcttccaggccgttcgcgttccactgtttgggcagcggtcctcgttggtttttggtcctaattgactacgctgccatgggtacgtttggcggcgccgtgccccttatgtccttgcgcgattatctccgccaggagttttgttttccgccgttctgtccctgatttgcttccggtgtttcgggccctttgatacgtgctcttcccttgtctgtgatggggggggcgggggatgaggggggctgaccacctggttctcttcgtccaccgcacgaggcgcctgtgtgtggtggcgcaagggtggagtgtgggtaccgtcgctggtgtgcgggtgggatgattgtagtgtgtgggctcggttgacacggaggtgctttgtggtggcgcggcgcagagaccccgaatacgccatggcgtccgtattgtgttgtgtgacgnttgtttcggggcgtgtgtttacgcagtgggtggggtatgattcggtgcgatggggcatgagcgtgctgcgatgcctacttgggacgcttggtcattggggtggtggcgagcacgtgtttatccgtgcgctactagtagtgcgggtctgtgagcagatagtctgctcattcgcctgttgtgttccgcgtctacgctcttgtgcgttccccaacttttatgcatcccagagtgagtctctagcatcaggattattgtggtgtggcgacaatcggtttgtgcacctgtattgatgtgccgcgatgtgttgtatgttgccactggttgtgtagcgcagcagtgtctccgcacagtagatatgtctctgatgctgttcgacgcgctgtgcctccgcagcgtagacggagagagtcgagtgtcacacacatctgggagtctgcgggcgttctcttcttcagtgtgtgtgatgactgtgacgtctgcatttttgtactcagcgtgatgtgagggtaggc

SEQ ID NO: 91119 - DNA, 911 bp, Zea mays
  misc_feature: Ceres CLONE 1579321
  misc_feature (259)..(259): n is a, c, t, g, unknown, or other
  misc_feature (269)..(269): n is a, c, t, g, unknown, or other
  misc_feature (270)..(270): n is a, c, t, g, unknown, or other
  misc_feature (298)..(298): n is a, c, t, g, unknown, or other
  misc_feature (299)..(299): n is a, c, t, g, unknown, or other
  misc_feature (354)..(354): n is a, c, t, g, unknown, or other
  misc_feature (355)..(355): n is a, c, t, g, unknown, or other
  misc_feature (358)..(358): n is a, c, t, g, unknown, or other
  misc_feature (359)..(359): n is a, c, t, g, unknown, or other
  misc_feature (911)..(911): n is a, c, t, g, unknown, or other
agctccccgcggtggcggccgctctagaactagtggatcccccgggctgcaggaattcgtctcacccctagaaaaacttccacatccgtcttcctcctgtaaccagatctgaacccgcggcgacagaaacaaacgctcgctcgctcgttcgttgtccgttcattgtcttcgccggcgccgagggaccctgagagggcaggctggcgagatggcgggcggcggcgttgaggacgtgtacggcgaggaccgcgctaccganggaagcaggnnctgaaatcacgcccgtggggcccttttnnttcccttcccggtttcccggccaaaaagcggggggctttttaaaaaaacaccaannaannaatatccctatttcctaaacactattttcatcctctccccccccccttcatacattattttttctttacctttccttcttatcttgtggttatgtgacatgtgttgtgcttcgattttgagttgaaaaactcttagtatcgtccttttgcattctgttattgttgtctcttccttcacacttatgatctgcaatataatataattgtagtgacggagtatggtcgacgggtagtacatgcgggagggttcagtatgctccttgctcgcgcgtgaggccgaacgggtgtgcatgatggcttcgcttgcgcgggtgtatgtgttcgtcttggtccgcctgcatgtgagtgtacgaaacttttggcaccctgtatctcaccattccgcgttactagtgtgtcccgggcatctacgttcgagaggcggggcgctgattatcaatatatttggggcgccggatccgaagttgggagcggcctcgctctaaccttactgttacggacctacgcgcggatggcctatggtgtgatgcgcgtaccgctgatgggagtgcn

SEQ ID NO: 91120 - DNA, 857 bp, Zea mays
  misc_feature: Ceres CLONE 1579324
  misc_feature: Translation starting site: 280
  misc_feature (719)..(719): n is a, c, t, g, unknown, or other
ggagctccccgcggtggcggccgctctggaactaatggatcccccgggctgcaggaattcgtctcacccctagaaatgattccctgtcttcctcccgaaatttcccacctcagactccgagagaagcaaacactagaagatgaagagaaaaaaactgtccgcacaaaaaagaaaacggcagcgccatccagtgaggagaaaagcttcagatccagctccagctccaggtccccctcctccccaatgcctcggccgtagctgcgtccgccgcacgtcgcaatggccgggcacagcgtgcccgcatcggcgctggcagccctgctcacggtctgcgccctcgcgtgctgtgccgtctcggagtcgccgtgcgagcgagcggtccgctctgctggagttcttcaatgagacaccacaagatcgccgcctcgagtggaacgcgtccaccccggtgtgtggttgggtctgggtcacatgtgactacgacaactccactttattcgaggtgctcctcccaggagtggagctcatcggcgacatcccgcctggcacgctcggtcgggtcactaacctcggagtgctctctctacagtccaaccgtgtactcgggtacagaccccgacgacgtgctccagcttgctgatctacgagcagctgtttctgcgacagattctgctactcgagcccatcgctactgttattgagaagctcaggggactttnagcgcttcgtgctctcccaaaaaacctctcgagcttcagcacgttatcgcttcacaaaataaccgggtttcaagtgctgtagctccaacggaacgcacttttacgggagggtttcccagcattggccattgcgtgggg

SEQ ID NO: 91121 - DNA, 911 bp, Zea mays
  misc_feature: Ceres CLONE 1579325
  misc_feature: Encodes the peptide sequence at SEQ ID NO. 91122
  misc_feature (326)..(326): n is a, c, t, g, unknown, or other
cggccgctctagaactagtggatcccccgggctgcatgaattcgtctcacccctagaaaaagtggccctcctccccatcgcgtctgtccgctacccctccccgaccagatcgctacgagacgccgcgcgatccgacccaggccgacgccgacgacccctctcgccgccggcggccatggcgtacggcgaccgcgtcaccacctttcgagactccgagaaggagagcgagtacggctatgtccgcaaggtctctggacctgtggttgtggctgatggaatgggtggtgctgccatggatgaacttgttcgtgtcggacctgataaantcattggggaaattatccgttcttgagggcgattcagctaccatcccaggtttttgagggaaacggctgggactggatggtttatgacccctgtttttgggaacaagaaaaccctcttttcactttgaattggggaccctgggatttctttgggaaacatttttttgaacgggattccaacccaccctcctaaaaacccatccccttttttaagttccggggagaatggtgtttaattcccctccgggggggggttttccagtttccccgggcccctttgaacaaaaaaattgtttttttgggggggaaatttctccgccccaacccaaaccctttgggggtttgggaaaaattttccatccccaggggggggaagatcttttctcccccccctgtgttttttggaaaaacccctttttgttgccgcccccctttggtttgtttctttccccccggggtttctttggggggaaaataaaatttcatttgggccccagctggggccggttcaacccgtgcaggaaacccagggccggaaattgtgtatttctcgggggtttataaaaaaaatttttctcccttcct

SEQ ID NO: 91122 - protein, 58 aa, Zea mays
  misc_feature: Ceres CLONE 1579325
  misc_feature: SWISSPROT Homolog: EC 3.6.3.14 H(+)-transporting two-sector ATPase
  misc_feature (51)..(51): Xaa is any aa, unknown, or other
MAYGDRVTTFRDSEKESEYGYVRKVSGPVVVADGMGGAAMDELVRVGPDKXIGEIIRS

SEQ ID NO: 91123 - DNA, 874 bp, Zea mays
  misc_feature: Ceres CLONE 1579327
  misc_feature: Encodes the peptide sequence at SEQ ID NO. 91124
agagctggagctccccgcggtggcggccgctctagaactagtggatcccccgggctgcaggaattcgtctcacccctagaaaaatttttcgtttgctcgagcagccagccgactcgtctccagcaatgcggccggggtcggctcgctggaggtgggcgccgccgccgacacctccaacgcctccaggcagggattaggtgagccgtcggctaatcactcgtcattgggaggatctcctcctcccgttcagatttgggcaagaaaggcccgggcgcgatgtccatggccgaggaggggagtgaggcctaggaggggagtgaggctgaggcgctcgagaaagacggcagcaaggcttcttcaccttcggggccaagtaaacaccacgggcaagggcgcaaagcatcgcgtgttgttgtttcgagatgcgtgggcatggccgtgctttcccttccgttggggtcaagctgaccggcctcgtgtgccccgtactcccaccgccgtcctgcacgcaaatcccaaaaatcagataaaaagactggtttttctccccgttctccttttccccccactaatcgatttaggttcttagttaggcgttcctgccgctcttcttcctccgtgtcgtcagaggaagccgcgaaaagcatgcaggaatcaggcggtcttgaggacgaggagctacaggtgcaagatgcagttgccagttgtttcaaggaggagcaaaaaatccgccgccggcggtcaaagcagggccaatgtcagttcgccccttgtggttcactcttcaccctgccatcctccctggtcccgggccaggaaaattccaaagtttaagccaagccaaacccccacatttggcattccattgcctgct

SEQ ID NO: 91124 - protein, 62 aa, Zea mays
  misc_feature: Ceres CLONE 1579327
MQESGGLEDEELQVQDAVASCFKEEQKIRRRRSKQGQCQFAPCGSLFTLPSSLVPGQENSKV

SEQ ID NO: 91125 - DNA, 883 bp, Zea mays
  misc_feature: Ceres CLONE 1579328
  misc_feature: Encodes the peptide sequence at SEQ ID NO. 91126
tccccgcggtggcggccgctctagaactagtggatcccccgggctgcaggaattcgtctcacccctagaaaaagcgccgccgcacacacacagcgcatgaccgaaccgaagagagagcgtgactgggagcaacgtgcggggagcgcaatacgccgggccgccggctaagcgggaggcaaaggcgaggatgttggggtcgcgccggtggcagtctccggctgatgctcctgcggccaccgatgacttggaggaggacactggtggcgtcggcggcccgtccaggcggcctctgcgccacgggctgcaccgcgcgtcgccctacggtggtgccccccgccggtggctctccaagctccccgttgacttccaaggatatttcccccaccattggccacgcgaaccgcacggggcctccggggaaataattcaagaaggtttcatttgtggaaaccccccttaaaaaatttatttttctggaaaaaaaacccctccccccccgaaaaccccaaaacctttctaaagtggggttggccgggccttattttttttacccccacttctaaaaaaaccccttgtggggggagccaaaaattccccttttttttaaaaaccccttgggttctttttttgggggaaagaggggggtggaaacctttggaaaaattcccccaagagtctccttggggggccaaaaaggggggggctctttttcctttttcaaaatattttggggagaaaaaccctctttttttccccccccccccgggagaaaaattatttttttttttctttcggggggggggtggagaaaaaacaccctctccccgctccttctttatataaaggagaaaaacttttgggggggggtataataaagaaaaag

SEQ ID NO: 91126 - protein, 90 aa, Zea mays
  misc_feature: Ceres CLONE 1579328
MLGSRRWQSPADAPAATDDLEEDTGGVGGPSRRPLRHGLHRASPYGGAPRRWLSKLPVDFQGYFPHHWPREPHGASGEIIQEGFICGNPP

SEQ ID NO: 91127 - DNA, 1180 bp, Zea mays
  misc_feature: Ceres CLONE 1579331
  misc_feature: Encodes the peptide sequence at SEQ ID NO. 91128
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
gctgtccttctttcttctcccacctgtcatcactcttctttcccatatggggtnnnnnncnnntnttaagctggagctccccgcggtggcggccgctctagaatagtggatcccccgggctgcttgaattcgtctcacccctagaaaaaagttggcacaagcagcttgggcgcaaaataacaactgcgatcgagcaagggacaatggcccgcaccgcggcgccggccgcgggctacggagaggacggagtgtaccgctccccgcgcccggccgtgcgcatcgagtccgacacaggcctctccctcaacgacctcctcttccgccgcgccgacgtgtgcccctccgctctcgcgctggtcgactccgccaccggccaatccctcaccttcgccgcctttcgctccgccgtcctcaccacggtcgtcgccctctcctcgcgcgcgggcgtccggcgcggcgacgtcgtcctcttcttcgcccccaactgcttcctctaccccgtctgcttcttcgccgtcaccgccctcggcgccgtcgctaccacggccaaccccctctacaccccttcgggaggtcgctaaacaggcccaccgactcgcggggccaagcctcgcaatccacggtctctggaactcccttcccaaaaatcgttggaccctcgggctttccccaaccattccttgcttccaacgggctggtgggcgactggcttaccccgggcccagtggcccgccttccctcccaaagcccctcagtggaagcccacgcgggggacggcgtttttatctcccgaaaccactcccttttctcccgggggcgcctcgtgggaaaaaaggaatataatcacgacccgcccctgcgcgaaaaaaaaatcaaaagctctacaccctaacccgcctctgttaagttttttctctcccggtgtatacaacaaggttgtgttaacccaagggtgttttcaactccttacacccgcctgtcataaatcccttctttcgtggagtgtgtgccccactgatataacagcgtggaacctacaacctccgttccggaaaaagagggcccaatatacttattctttgggcctcttgctcccaagttcgcacatctcccagacttggtcctgtaaacagttttcgccacaaaagagagccggtgagaaaacctccctccggagtaa

SEQ ID NO: 91128 - protein, 125 aa, Zea mays
  misc_feature: Ceres CLONE 1579331
  misc_feature: SWISSPROT Homolog: EC 6.2.1.12 4-coumarate--CoA ligase
MARTAAPAAGYGEDGVYRSPRPAVRIESDTGLSLNDLLFRRADVCPSALALVDSATGQSLTFAAFRSAVLTTVVALSSRAGVRRGDVVLFFAPNCFLYPVCFFAVTALGAVATTANPLYTPSGGR

SEQ ID NO: 91129 - DNA, 873 bp, Zea mays
  misc_feature: Ceres CLONE 1579333
  misc_feature (873)..(873): n is a, c, t, g, unknown, or other
ggagctccccgcggtggcggccgctctagaactagtggatcccccgggctgcaggaattcgtctcacccctagaaaaatgcccacaaattccttccaaacagaaacagcaccagactcctttccttttcctctcgctccctcgctctttctcccgcaactcggcgtcggcgaccgctgccgctgccctacgccaggtgcactgctgctggtctagtagcctcgtcggtcccttcgacaggttttcttcgggtcttcgccggcgacgagcacccgccaggtatgcgaccttatcttcccttcctgctgtgcgaaaccgagcatcagaactctatggagtaataagctggggccgccgccgccgccggccgccgccgctatcaggttgcagaatcactcgtcagaatccgctgggttgtcagaatttgatcaacatactgctctttccaatactattttcgctccacatatgacggagtagttcaggatccgccgagaatttccctcgaatataacaggatgtgcacctgtacaacgaagaattcacctgctaatctactatgtagggtcgaaaaggggggaaaaggtaagcggtgtttaacgttcatgccgacgcaatagctttacttgattgcgaggcaagagtagggttagaagtttggagtatgactgtgacgcacgcgtttcactgtcttcgatttccaagagacgtctctggttccgcatctgtcacgtcatgccattatgttgcgaatagtatttcgatccagaaaagatgtactgtacgtaggtttaggggaaacaaaagaggagatagtcatcgtgaaagttagagtttgagtgctgctatacgtagtagaactttatttgtacan

SEQ ID NO: 91130 - DNA, 1100 bp, Zea mays
  misc_feature: Ceres CLONE 1579334
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (888)..(888): n is a, c, t, g, unknown, or other
ggggagtgggggaggttggtattaaattattctatatttgtctgttgtcggttttttcttctannnggnggggtgtttattacaaactggagctcaccgcggtggcggccgctctagaactagtggatcccccgggctgcaggaattcgtctcacccctagaaaaaggccgcctcctcggctcctcccccgcggccgagctcgctcctcgccccgccgcctcaactcgtctcgcccgcgaccgatttcctccctccgctcgccgcgccgcaacccggagataaggccgcgctcgatcgagaaccacctggggtccagcgtcatcgcgaccagctccggcgaggcgtccgccctttgcagcccggtgtctctgcgaccggcacacagctccagagtttatagggtgtcttggactgaagaagatatcagcaaagcttgaaaaggactgagagatgtcattgggctatgctgagaagctgtcctaccgggaggatgtgggtactgtgggaatgcgctgagatctttgagacccctgagctagtccagaataagatagaaagagctttgctgccatgggtgcaaaaagaagtaagcattttagtgggtggtttaccgggggggaggggaatatcttaccttccatccagggcattgccctggaattttttcggagggggccaccatgtgggttggttcctgtggacctcttttgccaatcggttggtcaatgtaaaaaaaggggttatttttcaccacaaatagggcaaattcaaactttttgccccgtgttcacacaatccaacgggacctcggtatcgcccacaaggcctttttggaaccaaccaactatttgtgggtaaccttaagaattcacagaaaacctttctantaaaagaaaatcatggggggatttttttcctggtaaaagtgtttctttgcccccaatattaggaggccccatacaataattggatgtggcatagacgggccccatatccagtgccattgcccgtgttttgccctgggggctatttctccccgccaaagagaggacaagacaaacatattggggcgtccttggaaataataaaacaagtggag

SEQ ID NO: 91131 - DNA, 1271 bp, Zea mays
  misc_feature: Ceres CLONE 1579338
  misc_feature: Encodes the peptide sequence at SEQ ID NO. 91132
  misc_feature (11)..(11): n is a, c, t, g, unknown, or other
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (68)..(68): n is a, c, t, g, unknown, or other
  misc_feature (69)..(69): n is a, c, t, g, unknown, or other
  misc_feature (71)..(71): n is a, c, t, g, unknown, or other
  misc_feature (1019)..(1019): n is a, c, t, g, unknown, or other
ttgtggcggtnnccnncccgcctcgctcccacccctcttcccctgctttgtatatgtttatattttanngngtggcaaactggagctcaccgggtggcggccgctctagaatagtggatcccccgggctgcaggaattcgtctcacccctagaaaaggatgtgcgtggcaacgtccaatatccagaccgctggtaggagtatctcgtagacattgaacaacggctgcatggcgagcgcctgcgccaccttcatccccctcgtctcggcgccctctgcatgcccgtccaagaagaccaccgtcgccaggttccggcgccgcacggtgacgtgcagggccagcaacggcggtggcggtggccggggcggcgaaaatgatggcctcctttggctgccccggcgggacgtgatgctcaacggcctgtccagtgtcgccgccgggctcgcctggtacccgggcgtcgcgtccggtgtggaatcccctgtgctccatgggcctgacaagctcaacaaagaaaaaacggtcaatgtgcaccgaacccgggccggggacaaactttcccgtggccgttctgggtggtcgccccgacccgaaaccccgggggggaacctttcaaaggccggggaaaacacgaaaggtgtgaatgttcgtaaattccctgtcaaatatccggggcaagcaataccatcccctggaaaaaccccgggggagagtttactccccatgagaagataaaatgtttatactagaagggggaaagggttcaccgcactttccattacgggaaagaaagtaaatgtgcgaaatagaacggtccgctcccttttaatctctctcggtgatatgggaaaggctgagagcccccctccgccccagttgaaaagatgctatatttcgtcctcggggagggtgtccctcatagagaggagagcgagagacactagattctccaacaacatcaataatggggactctgtttaaggtggcgatatggaaaggaccgcgctcactgcgttagangtgtaacatgtatgcacggtagctctcccccaagttgagtgtgtccacaagaggtgtgatggcgccgcgctctgttattatacagaacaaagggttagaaaaatacactcataccagttagagaaaacaagtgttaccctgtgctccccactgagaggacaaagctctcgattagcatatagaaagacctataagcgtgaagaaaagataagagatgagggagcagccttgtgaaagttgtgtagctgaaag

SEQ ID NO: 91132 - protein, 168 aa, Zea mays
  misc_feature: Ceres CLONE 1579338
MASACATFIPLVSAPSACPSKKTTVARFRRRTVTCRASNGGGGGRGGENDGLLWLPRRDVMLNGLSSVAAGLAWYPGVASGVESPVLHGPDKLNKEKTVNVHRTRAGDKLSRGRSGWSPRPETPGGNLSKAGENTKGVNVRKFPVKYPGQAIPSPGKTPGESLLPMRR

SEQ ID NO: 91133 - DNA, 872 bp, Zea mays
  misc_feature: Ceres CLONE 1579339
  misc_feature: Encodes the peptide sequence at SEQ ID NO. 91134
ggagctccccgcggtggcggccgctctagaactagtggatcccccgggctgcaggaattcgtctcacccctagaaaaaacgatagtactgacaatcccattttcattaatgagcaaatccataaaaatgcacaagctaccactgttttgctagcatccttgtgcagggacgagtaccacaaggtgagcggcttggataatgccaagcaaatttgggacaccctcaagatctctcatgaggggaatgatgccaccatgatcaccaaaatggagttggtggaaggcaaactaggaaggttcgcaatgatcaggggggaggagccaacccaaacgtacaacaggctcaagaccccggtcaacaagatcaggagctatggaagcatgagatggacggaccatgacgtcatccgacttatgcttaggtctttcactgtacttgatccttatcttgtgatttctatccgtgaaaatcctaggtacaccaagatgacgcccgaggaaatactcgaaaagttcgtaagcgggcgtatgatgatcaaggaagcaagattggttgatgaggcattgaaatggtccaatgcccatctacgagcctcaaacggttgctctcaaagcaaacaagtagcaggggaggcactacctagcaaggtgggcgcaagtttgaggcgggccgaactaaatgggggatgtaaatggcccttcattatccgagtggctctcaagaacagcatttgaaaggtactgcaaggtagttacctcctaaccaaagaaacaagggcaaaaggggaaaaggcgtttccctggctttccaagtggccgtgttaagaaacagggttcatatttttatttggcctcacaaatgttccttacaaa

SEQ ID NO: 91134 - protein, 159 aa, Zea mays
  misc_feature: Ceres CLONE 1579339
MITKMELVEGKLGRFAMIRGEEPTQTYNRLKTPVNKIRSYGSMRWTDHDVIRLMLRSFTVLDPYLVISIRENPRYTKMTPEEILEKFVSGRMMIKEARLVDEALKWSNAHLRASNGCSQSKQVAGEALPSKVGASLRRAELNGGCKWPFIIRVALKNSI

SEQ ID NO: 91135 - DNA, 849 bp, Zea mays
  misc_feature: Ceres CLONE 1579344
ctccccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatggcttcgaagctcaagagtacacgtatctccacctcgtgctttcgcacaatggggttcgacgtggcggctcaaccgtcttcttagatcaccatctcggtgggagacggttgaagtcttcacaccctctcgacctctttgctgtctcattttttttaactgtcaaggataagcaagtgacctctgtgtgcataccaccaccaccatacgtagcatacacaggcacagatggcagagcataaaagggaaccgttctctttgcacaaggaatgaaaaggggggaaattggcttgggccaaagggcaacctttggccaagggtttaccaatggcctcggtaacacgggcggaaacttcgggaaaaagtggtccgcggaatccaaagaggggaattggaatatagac

SEQ ID NO: 91136 - DNA, 1107 bp, Zea mays
  misc_feature: Ceres CLONE 1579346
  misc_feature: Encodes the peptide sequence at SEQ ID NO. 91137
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
nttttgtttgnnnncnccgcgtacgttgtggtgatggggagggaaagaggtatattaatttaaacgcgtttttttatactggagctcccctcggtggcggccgctctagaatagtggatcccccgggctgctggaattcgtctcacccctagaaaaatccccccgcgtagaggagaggagaggatgaagaagaacccagccaaatcctcagtcctcaggctgctcacagctcgtgccgtccactctcccccgagccagtctcttgcgttcgctgctcgacatggcgctccaggcggcgacgtccttcctcccctctgccctctccgcgcgcaaagaggggtcggtgaaggactccgcgtctttcttgggggttcgtctcgcggcggatggcctccagctggacccaccgctctgggccctcctcccgtgagggggaagcaaggcggggggacatccgcgcgcagaccggaagcggggtcctcccccctcagggagaccccggcggcgcccgcctggggaagaaaaaccccccccgcaagggggacaagggggggctttacccggggggggttctttccggggccttgggccctccgccaccgggggaaaaggcccctccccccggaagaacacggggcaaaggggggggaccccttctctttcttttggggcctgtggcccccaaaaatttttccctctcaaagggggggttccccgggccggcggggcgccccaaagggagtgggcccccgggccctttgtggaaaaaaaagggagaaaagcgtttttctccccgggtggcgggggggaaccccctggggaaaacttttggccccttctccctttgggaaaagagggtctcccgcccacaagtttttcctccccgaggaaaaccctgggcgcccccaacccttgggaagatgggcccccattcccaaaaccgggggtggggtccttggcataacaccccccccccttggttctcctaaccccaaccccgcctaagggagagccggtcccttaacaccgccgcaaaagggctttcccaatattaaaaactttgggggataataaccaccctcgggggaccctttttcttccctgggg

SEQ ID NO: 91137 - protein, 49 aa, Zea mays
  misc_feature: Ceres CLONE 1579346
  misc_feature: SWISSPROT Homolog: EC 1.3.1.33 Protochlorophyllide reductase
MALQAATSFLPSALSARKEGSVKDSASFLGVRLAADGLQLDPPLWALLP

SEQ ID NO: 91138 - DNA, 875 bp, Zea mays
  misc_feature: Ceres CLONE 1579349
  misc_feature: Encodes the peptide sequence at SEQ ID NO. 91139
aaagctggagctccccgcggtggcggccgctctagaactagtggatcccccgggctgcaggaattcgtctcacccctagaaaaaaagaaagcgaccaccgctgtgaatcagcagagctgcagtgagagcaagtgagaggatcagaggaggcatccgtgaccaaagatcgagtagccaagaagaagagagatgaacgccgacttcggcgcgcccaaggagctcgcgggaggcctgcagcagcggcgggccctctaccagccccgcctcccgccatgcctccagggaccgacggtaagggcggagtacggtgacgcgaccacaaccatagatcccacctgtgcccaagccgtcgcgcaggccttcccgcacacctttggccagccgctcgtcagcttcgtcgcgccggccgccggcgccggcgccgttgaggagcgccacccgatcagggtgggcgtggtgttctctgggaggcagtcgccgggagggcacaacgtcgtctggggcctccatgacgcacttaaagcctacaatcctcagagcttgctctacggattcgtcggtggcacggagggactgtttgcaaacaagacgttggagatcacagacgatgttcttgcttcctataagaaccaaggtggtttcgatttgctcggtaggagtatcgatcagatccgcactactaagcaagtgaatgctgcaatgacaacatgccacagtctgagcttggatgggttggtcatcattgggaggtgtgaccctccaatcagatgctgcacaggctgcggagacccctatttcgaagtactggtaggaccagggttgttggtgtggcagtttacattgatggtgaccctcaagacccagtttgctggaac

SEQ ID NO: 91139 - protein, 228 aa, Zea mays
  misc_feature: Ceres CLONE 1579349
  misc_feature: SWISSPROT Homolog: EC 2.7.1.90 Diphosphate--fructose-6-phosphate 1-phosphotransferase
MNADFGAPKELAGGLQQRRALYQPRLPPCLQGPTVRAEYGDATTTIDPTCAQAVAQAFPHTFGQPLVSFVAPAAGAGAVEERHPIRVGVVFSGRQSPGGHNVVWGLHDALKAYNPQSLLYGFVGGTEGLFANKTLEITDDVLASYKNQGGFDLLGRSIDQIRTTKQVNAAMTTCHSLSLDGLVIIGRCDPPIRCCTGCGDPYFEVLVGPGLLVWQFTLMVTLKTQFAG

SEQ ID NO: 91140 - DNA, 2111 bp, Zea mays
  misc_feature: Ceres CLONE 1579354
  misc_feature: Encodes the peptide sequence at SEQ ID NO. 91141
acattgggatgcagcagactgatggttgtgcggcggacgaagtcgcagggaaaccaggaggaaggctagtgcagagaatcagagctgtctgggtgaaagggcaaaggcaagcagcagagggaggccattacgtgtctccttcctccaggttcctctctgggctgccatggatttgctcagcagaggggcggcggtgttcaaggccctggtgttcctctgcttcatcagatcgtctcaaggaggagatctgaatctccctcccttggtgaaggcaagcaggttccaaagcgaggcatacgactacatcattgtcggcggcggcacggccgggtgcccgctggcggccacgctgtcccacaagtacaaggttctcctgctggagcgaggtgggtctccatatggcaaccgcaacatcacgttgctggagaacttccacatttgcctggccgacgtttcaccgcagtcaccgtcacaagctttcatctccacggatggcgtgataaatgcccgcgcaaatgtcctgggtggcggaacatgtatcaacgccggcttctacagccgggcgaaaccaagcttcgtgcagcaagcaggctgggacgcagagctggtgaaccagtcctacccttgggtcgaagagaggatcgtccactggcccaaagtggcgccatggcaggctgcgctccgggacgggcttctggaagcaggggtctcaccatacaacgggtattcctatgaccacctctacgggactaaagtcgggggcaccatattcgacgacaccgggcgccggcacacggctgccgacctccttgctgctggaaaccctagcaacctccgtgtgctgctccatgctaccgtcgacaagattctcctcgcaaggaagcacggcggggggaggaagcagccgagggctactggagttcggttcagagacgagaacggagcgcaccaccaggccttcctcacaaggaagaggggtagcgacgtcattgtttccgccggcgcaattggcagcccacagctactgctgctcagcgggatcgggccgaggggtcaactcagcaggcacaacgtttctctagtgcacgccaacgaacacgtgggggaagggatgtcggacaatccgatgaactccatcttcgtgcctatgaagaaccccacggagcagtccttgatcgaaactgtcgggataacggacgctggggtgtttattgaagccagcagtggtttcagccagtcagacgatagcatccattgccaccacggaatcatgtctgctgagattgggcagatatctacaattccaccaaagcaaagaagtcttgatcaaatccaagagtacgtgcgtaacaaacatagcctgcccaaagaagtgtttgacggaggattcattcttgagaagatcgatggcccactgtcgaccggcagtctggtgcttgcggacaccgacatcgatagcaaccccagcgtgagcttcaactacttccagcatccacaggacctcaggcgctgcgtctacgggattcagacgatcgagaggatactcaagacaaaccacttcgccaaccttaccgccaacggtgccgggtacccgatggaaacgctgctcaatctgagcgtgtcggctaacataaacctgatacccaagcacacagatgacaccacgtccttggagcagttctgcagggacacggtgacaaccatctggcactaccatggtggatgccatgtaggcaaggtggtggatcgacactaccgggtgattggcatctccggcctccgtgtgatagatggatcaaccttgttcagttcaccaggaacgaatccacaggccacggtcctaatgatgggcagatacatgggggtgaagattctaagggaaagattaggacgagcagctggagtataatggactttatccagctcatcaagtatgaatgtgacttaggaggagacaagtatatagtgatttttgaaagcgattcattaaatcgccaaagaaacaaaacaaaattaagcaaggggttccatttgtcacagtgcgtgccccacacgtcaaaattaagcaaccgtttgacttaaaaaaaaaaaaagaaaaaaaaaaaaaaaaa

SEQ ID NO: 91141 - protein, 580 aa, Zea mays
  misc_feature: Ceres CLONE 1579354
  misc_feature (409)..(565): Pfam Name: GMC_oxred_C Pfam Description: GMC oxidoreductase
  misc_feature (44)..(334): Pfam Name: GMC_oxred_N Pfam Description: GMC oxidoreductase
  misc_feature: SWISSPROT Homolog: EC 4.1.2.10 Mandelonitrile lyase
MDLLSRGAAVFKALVFLCFIRSSQGGDLNLPPLVKASRFQSEAYDYIIVGGGTAGCPLAATLSHKYKVLLLERGGSPYGNRNITLLENFHICLADVSPQSPSQAFISTDGVINARANVLGGGTCINAGFYSRAKPSFVQQAGWDAELVNQSYPWVEERIVHWPKVAPWQAALRDGLLEAGVSPYNGYSYDHLYGTKVGGTIFDDTGRRHTAADLLAAGNPSNLRVLLHATVDKILLARKHGGGRKQPRATGVRFRDENGAHHQAFLTRKRGSDVIVSAGAIGSPQLLLLSGIGPRGQLSRHNVSLVHANEHVGEGMSDNPMNSIFVPMKNPTEQSLIETVGITDAGVFIEASSGFSQSDDSIHCHHGIMSAEIGQISTIPPKQRSLDQIQEYVRNKHSLPKEVFDGGFILEKIDGPLSTGSLVLADTDIDSNPSVSFNYFQHPQDLRRCVYGIQTIERILKTNHFANLTANGAGYPMETLLNLSVSANINLIPKHTDDTTSLEQFCRDTVTTIWHYHGGCHVGKVVDRHYRVIGISGLRVIDGSTLFSSPGTNPQATVLMMGRYMGVKILRERLGRAAGV

SEQ ID NO: 91142 - DNA, 832 bp, Zea mays
  misc_feature: Ceres CLONE 1579355
  misc_feature: Encodes the peptide sequence at SEQ ID NO. 91143
ctccccgcggtggcggccgctctagaactagtggatcccccgggctgcaggaattcgtctcacccctagaaaaagtaaaccacactccactccagcactgaacacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttcgcgcgcgagcgcatcccggagcgcgtggtgcacgcgcgcggggcctccgccaagggcttcttcgagtgcaccccacgacgtgacgtcgctgacgtgcgccgaacttcctgcgcgccgcccggcgtgcggacgccccgtgatcgtgccgcttctcgaaggtggaatccaccgagcggggggtcccccggaaaacgattccgcgaaccccccggcgggtttccccccggggaaatttcttacacccccccgaaggggcaactggggaaaccgggttgggggaaaaaaaattttcccccgggttttttttttaaatccccgggaaggggggattaaaaggtttcccccgcaaaggggggaatccccccggggtttttaaaggcccccaaacccccggcggggggccgcacccgtgtggcaagggaaataatcgggggggggggtgggttttaaaaaaattttcccgtgggtgggagaccctccccccccccaaaaagaagccctggggaacaaacccttttgtttttttt

SEQ ID NO: 91143 - protein, 164 aa, Zea mays
  misc_feature: Ceres CLONE 1579355
  misc_feature (18)..(164): Pfam Name: Catalase Pfam Description: Catalase
  misc_feature: SWISSPROT Homolog: EC 1.11.1.6 Catalase
MDPTKFRPSSSHDTTVTTTNAGAPVWNDNEALTVGPRGPILLEDYHLIEKVAHFARERIPERVVHARGASAKGFFECTPRRDVADVRRTSCAPPGVRTPRDRAASRRWNPPSGGSPGKRFREPPGGFPPGEISYTPPKGQLGKPGWGKKNFPPGFFFKSPGRGD

SEQ ID NO: 91144 - DNA, 868 bp, Zea mays
  misc_feature: Ceres CLONE 1579359
  misc_feature: SWISSPROT Homolog: EC 4.1.2.10 Mandelonitrile lyase
  misc_feature (846)..(846): n is a, c, t, g, unknown, or other
tggagctccccgcggtggcggccgctctagaatagtggatcccccgggctgcatgaattcgtctcacccctagaaaaaattgggatgcatcagactgatggttgtgcggcggacgaagtcgcagggaaaccaacaggaaggctagtgcacacaatcatacctgtctgggtgaaatggcaaatgcctgccgcagagggagggcattacgtgtctccttcctccaggttcctctctgggctgccatggatttgctcaccagaggggcggcggtgttcaaggccctggtgttcctctgcttcatctgatcgtctcctggaggagatctgaatctccctcccttggtgaaggcaagcacgttccaaagcgaggcatactactacatcattgtcagcagcgacaccccaccgtgcccgctggcggccactctgtcccacaagtacaaggttctcctgctggagcgaggtgggtctccatatggcaaccgcaacatcacgttgctggagaacttccacatttgcctggccgacgtttcaccgcaatcaccgtcacaagctttactctccacagatggcgtgataaacgcccccgcaaatgtcctgggtggcggaacatgtatccacgcctgcttcttgacccgggcgaaaccaaacttcacgcagcaagcaggctcgggaaccacagtttggttaaccaacccttaccccttggggtccaaaaaaaaggttctttccccggggccccaaatggcccccaatggcaaggctgccgcctccggggaaggggccttcttggaaacccgggggttctcccccacatccaaacggggttatttccctatttaactancctcctttcgcgggaactttaa

SEQ ID NO: 91145 - DNA, 980 bp, Zea mays
  misc_feature: Ceres CLONE 1579362
atagctggagctccccgcggtggcggccgctctagaactagtggatcccccgggctgcaggaattcgtctcacccctagaaaaaacaggcagtgagtgggcagcagccactcgctctccccacctcgtctctcttccactcatcccctccctcgccccttcgcctcgcctctcttcttcggatcgagcagcagtactgcactgcatgccgccgatacaaatcccatcctctccctcctctactggacctgcaccacagtagctagctagctatctttgctacggcggctctgtaatctgggccactagcgctccatcgaccccaccacagccatgggttgcgtgaccgcgggggacgtttttttggcctcttcttcttcctcccttggggcggcaaagccaaaggaggcccgggtccggttctccctggttttcatggggggcccccccagtttcccccgggggaaaaggggggcccccccccgggggggggtgtcccgtgcagggggtgcccccccccaaaaaccccgaaaaggggaaccccgccaaaaaaaaagggggggaaaggggggccccaaaaaaaacggggggggggggggggctccccccccccaaaaaaaaatacaaaccccccagagggggccccccctccccggggggggaggggggcgggggccccaaacccaagaaaaaacggcggggggaaaaaataaccccctccggggaagaaaaaaagtccacatttttttttcttcacaaaagaaaaggaggggggggcccccccctccaaaaagagggggggggggcccccccccgggtggtcttttttggggggggggggggggaaaaaaaaataaaagaaggccgccgccttacgggggggtggttttatttctccgcccaaaagaggccccccctggagaatattttttccccaccccaaaacaaatagatttttttataaaaaaaaaaaaaacaacc

SEQ ID NO: 91146 - DNA, 928 bp, Zea mays
  misc_feature: Ceres CLONE 1579365
  misc_feature: Encodes the peptide sequence at SEQ ID NO. 91147
aaagctggagctccccgcggtggcggccgctctagaactagtggatcccccgggctgcaggaattcgtctcacccctagaaaaaaatcacccgataagtagcaggggcagggagaacgaagacgacgacgacgtacgccggccgtaagtgagccgagagcccccgatataccagctagctagataaccagccagcgcgagcatggaggcggcggcggcggcggtccggcaccggacggtggaggcgaacggcatctcgatgcacgtggcggagtccggccccgacggcggcgacggcgcgcccgcggtggtgttcctgcacggcttcccggagctctggtactcgtggcgccaccagatggcgcacctggccgcgcggggctaccgctgcgtggggtctgaacctcgcggctacaggggttccgccgcgccggccggacgtcgagatcctaatcccgccttccacggtcatcggcgaacttcgcccccccggttcgaacgcgatttggcttccaccaactagggtgtttcgtgggtggggttcccgcaccggggcgcggcgcacccaccgggtggggggccctcctggccctgggcctgagtccgggcaatctgggtggggagggtcccttttgtttagatgaaccatgtgctcacacttgatatgtagcccataataattagctaaacaaccccaatgttataccagactccccatctaacgggccttacgcaattccctctcgacgcctgcaacattgttgggagtcccctggcgtgttttatttttcagctcgctctttacagggcaaacgatttttggggtggaccttacggtagttgcgcgaggacgtcgccgccagaaaaccagagaggaaattgtgggtacggcaggggcggaggtttgtgtgtgtagacagtaagtatcg

SEQ ID NO: 91147 - protein, 106 aa, Zea mays
  misc_feature: Ceres CLONE 1579365
  misc_feature: SWISSPROT Homolog: EC 3.3.2.10 Soluble epoxide hydrolase
MEAAAAAVRHRTVEANGISMHVAESGPDGGDGAPAVVFLHGFPELWYSWRHQMAHLAARGYRCVGSEPRGYRGSAAPAGRRDPNPAFHGHRRTSPPRFERDLASTN

SEQ ID NO: 91148 - DNA, 1187 bp, Zea mays
  misc_feature: Ceres CLONE 1579370
  misc_feature: Encodes the peptide sequence at SEQ ID NO. 91149
  misc_feature (35)..(35): n is a, c, t, g, unknown, or other
  misc_feature (67)..(67): n is a, c, t, g, unknown, or other
  misc_feature (68)..(68): n is a, c, t, g, unknown, or other
ggccgggcgtcgattaattttcttctcacgaccgncccctcccttcgtcgccttttccaaaccaacnnttccaactaggaactccccccggtggcggccgctctagaactagtggatcccccgggctgcaggaattcgtctcacccctagaaaaaaccaacgcctaccgaccaaattcggcgactgcttctccatccttccacgaattacacgagggaagaacgctgatgaacaaatggcgtaaatctctatcgacgaagctgtggaggaaaacgaaggatctccccgtgcttgtgcatgccagatcgcctgctctacgtccgcatcccgtccctcgcgaaactcgggcactcccagggtgtgcaaaattcatggcttcagacacccgcaagaagctcattcagatcgatgtgagctcggatacagtgtgcccttggtgctttgtcggtaaaaagaaccttgagaaagcaatggagcaaagcaagggcaagtttgatttcgaggtccggtggcatccattcttttctgaaccccgaacgcgcctaagtgaggggcgtcaagaaaatcttgactttcttccagaatgaaagttccgggccctggtcccaatattgaaggggtgcgaatggcctccgccatgaacttggagaaaattttccgaggggaactcgggggcgtttggaagtacccaaatagtggtttaaggggaattttgaaccaggggggaaaacacccggattgtggtaaattaggtgtcatgttaaggggccgttccagtaagaaccgcgctcgtgtggcgcgtgtggaaaacaaccccccgagggggcggccttcattgagacacacagggtccacaaaagaatggggttctcctttaggtttcgagaaaaaaaaaaatgtggtttctccctcgccaaggtttagccgccactttgggctgcaatgcggaaaaaagagtaaccagttttgggggtgagcccaagaggcacggggtttcttgttgcctggggaatgggccttggacaaagagaaaggcgaggtggggttatattggagaacgggcgcgcccaaaaggaaaacgctccctgtggagaagaacaccccatatctaaagagtggagggccagaaagaaggtgtcccgaggtaaacagactcccgagaaaaggtttctcccgtcggggaagca

SEQ ID NO: 91149 - protein, 71 aa, Zea mays
  misc_feature: Ceres CLONE 1579370
MASDTRKKLIQIDVSSDTVCPWCFVGKKNLEKAMEQSKGKFDFEVRWHPFFSEPRTRLSEGRQENLDFLPE

SEQ ID NO: 91150 - DNA, 837 bp, Zea mays
  misc_feature: Ceres CLONE 1579371
  misc_feature: Encodes the peptide sequence at SEQ ID NO. 91151
  misc_feature (603)..(603): n is a, c, t, g, unknown, or other
ggagctccccgcggtggcggccgctctagaactagtggatcccccgggctgcaggaattcgtctcacccctagaaaaaattccattccacctgtacggctgtaccccaccgccaccacccacggcacgctgcgcgcccaagcaaaccagggagcgcggccgaccgaccagccagacctgcgcaatcgaaaccgatcgactcccctattattggtccccatccccatggggcggcggctgagcgcgaccgccgccgccgcggcggcgtcggcggagccgctcctcccgccggcgctgaagcgcggggtgctgatcgagcggtgcgcgtcgcacgccgacgacgagctgcagtggttccgctcctgcctgcggtgggtgtgcatggaccactcgggcccaggccaggccgcgctgtcctggctcctcttcctcgtcctcgccgccatcgtcccggccgccgcgcacttcctcctcgccttacgcgactcgcggcgccccctttctcggacgtcgtgcagctctcgctctcggccgcctacgacggcgggcttcctctgcctctcctcctcccttcggccgcgtcggcctccgccgcctgctccanctcgataagctccgcagcaagagcgatcgcgtccgggccagctacacggcgcgcctcgccttctccttccgcctcctcgcctccctcgtcgcgccgtgcttcgccgccgaagccgcctacaaggccgggtgggtacgccaaccttcgccgaacggcgtcccccttcttcggccacgacgtccgtcagcgacgtccttcgtctgcttccttcgagaagggcctcctggaaagtac

SEQ ID NO: 91151 - protein, 128 aa, Zea mays
  misc_feature: Ceres CLONE 1579371
  misc_feature (127)..(127): Xaa is any aa, unknown, or other
MGRRLSATAAAAAASAEPLLPPALKRGVLIERCASHADDELQWFRSCLRWVCMDHSGPGQAALSWLLFLVLAAIVPAAAHFLLALRDSRRPLSRTSCSSRSRPPTTAGFLCLSSSLRPRRPPPPAPXR

SEQ ID NO: 91152 - DNA, 1330 bp, Zea mays
  misc_feature: Ceres CLONE 1579373
  misc_feature (47)..(47): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
gaaagagtaattttcataatatagaattaagttatagtgtgttcccncccccnnnntncctaaaacctgggactcaccccggtggcggccgctctaaactagtggatcccccgggctgcaagaattcgtctcacccctagaaaaagtcagagagagagccactgcgcagcaggtaggcaggcaggaggattagtcggcaaggaagctgcctgcttgcgcaaagagtcatagagatagttattaacatggcgttgttttcggctgcttgccctctccgtgctcttcgcagtggccactcctgtcagggacatcgcccagtatccctgctcgttacaagtgaaggatttccagcacctgtaacactgctcggggctccacctgacgctgtaccatccgaagatcccctgctccccggctctgctgtttgtccacctcactttccccgcggtgttcttgttttttcacccgcgcggttgtgtcgttcgccgcgcgttctcatctaaacgcggtcagtccctgcccatctttgttttacaattagtctcgctgctgttgttttttttttttccccctattgaaaagttcccatttcaacatttgatccattcggatccggggcccgttccgtccgtctatctgattatttaccttcaacttgggagtgtggtttttttgttcccaccgtgtccaaaggttcgtttattttcatgggctctgtggtacaatgggttgttcttacctctgtttattctaggtattttacgtgggtattttccccctgggggttgtttgtattttcatgagtctcattccctcattagttcccttagtgccacctcgcttgtttttctacatatctcttacaagtcgtatactaccccattttctgtcgttctttagccgtgtccccgacggattcctaggtctttcctagctcactattctcatatggtctcatctcaaactcttatttcatagatctcatcctaggagctctgcattcactcctcttgtatctccacgcgctcttctactacttcctatagactgctgggtgagctttttcctagtgcgtcgtctttttatgcggttcctgacttactctctgtttattcttagaccggggtatttttttgtatcactatgttattttgttttatcggttgttgttatcccaatccgttatcgcccgtgatgttttataattggttagctagcgtccgctgagttatttttgagtgcctcctgtctcactctatttatccctagtgtaatccatcgtgccgttatacgttataagctatattcctcttcaatgacagcatactgc

SEQ ID NO: 91153 - DNA, 967 bp, Zea mays
  misc_feature: Ceres CLONE 1579378
  misc_feature: Encodes the peptide sequence at SEQ ID NO. 91154
  misc_feature (511)..(511): n is a, c, t, g, unknown, or other
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (521)..(521): n is a, c, t, g, unknown, or other
  misc_feature (524)..(524): n is a, c, t, g, unknown, or other
  misc_feature (525)..(525): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (545)..(545): n is a, c, t, g, unknown, or other
  misc_feature (581)..(581): n is a, c, t, g, unknown, or other
  misc_feature (600)..(600): n is a, c, t, g, unknown, or other
  misc_feature (650)..(650): n is a, c, t, g, unknown, or other
  misc_feature (663)..(663): n is a, c, t, g, unknown, or other
  misc_feature (812)..(812): n is a, c, t, g, unknown, or other
  misc_feature (838)..(838): n is a, c, t, g, unknown, or other
  misc_feature (839)..(839): n is a, c, t, g, unknown, or other
  misc_feature (874)..(874): n is a, c, t, g, unknown, or other
  misc_feature (913)..(913): n is a, c, t, g, unknown, or other
  misc_feature (958)..(958): n is a, c, t, g, unknown, or other
  misc_feature (965)..(965): n is a, c, t, g, unknown, or other
ctggagctccccgcggtggcggccgctctagaactagtggatcccccgggctgcaggaattcgtctcacccctagaaaaaattttctcctctcctctcccctcgctagttcgtcgcgtcctcctcagatcaacaaaccgtgtcctgctgctgcctctggaaaccaccgggggatcgccccgcccttttcttcccgcaccccagatcctccgtcccaaaacggcagcttccggaggtctcccgtctccctgctccttccggcgcgacgggtggcccggctcgcggatccggcggtcttcggtcgacggcgaggcggcgctcgtcttggatcgggagtggttgctgaggcgcggagatggtggccgaggcggaagtcatgcatcagtcccccgttccggtgctggaggtgcagtaccaccggcgcgcgacgaccaagggggttgacgacgtcgtcgggatgtccgcgcccgcccccgcggaggttggggtggggttttggggggtttaaagtnnaannnnaanttnnaagtnnnnattggaggtggnttattttgggggggggaaaagttttgattgttgaantatgttttatttaatgaanaggataaaggaagtttgtggtttaatagtatgtttttggggagttttgtntaaaaattgggtntttggttaggtttttggtaggaaagtaattaattgtaaaatagatgtatttgtttggagtgttattgggtttgatggttttttttgtaaatttggttttgtgcattttatatggggtttttttaagtgttattgttggttgtggaaatntaatgttttgatataaaagtttttgnnaataaagattgttatttgaagaaaaaaatatttangtatgggatgtattgtgggatatattttatatttaatantttgtaagattttttttaatagtgatagtgagtgtgtaatatttnggagtgnta

SEQ ID NO: 91154 - protein, 50 aa, Zea mays
  misc_feature: Ceres CLONE 1579378
MVAEAEVMHQSPVPVLEVQYHRRATTKGVDDVVGMSAPAPAEVGVGFWGV

SEQ ID NO: 91155 - DNA, 947 bp, Zea mays
  misc_feature: Ceres CLONE 1579379
  misc_feature: Encodes the peptide sequence at SEQ ID NO. 91156
acccgcggtggcggccgctctagaactagtggatcccccgggctgcaggaattcgtctcacccctagaaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatttctgcacagcacccatcaagtatcagtttcgccaactactctgcgaactaaatctactggggcaaggggcagcatcccggctgcagctcaatcaaccagcgcttccgaactttctcctttcggccctctttaaccgggcggggcctcagcctaccccgaggtttgaatcccgggtgggtcggaagcccccattttcgttttcaagaaccccccaaggggcgcccccgtgtttcccgccgccccgggggcaagggaaccgttcccatgaaacaaaattgaccggtgtagttgggaccacgcgggcttcccccactctgatgaggggtcttccccggtccttggaatggtgggcgcccctggttctcccggcggggtgggtcccggaaacacccgggggcgcgccccccgtgggagcttccacttttaaaccgggtagtatttttgggtggagccccgtcccacccctctgggggggggggcccgcggtt

SEQ ID NO: 91156 - protein, 268 aa, Zea mays
  misc_feature: Ceres CLONE 1579379
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYFCTAPIKYQFRQLLCELNLLGQGAASRLQLNQPALPNFLLSALFNRAGPQPTPRFESRVGRKPPFSFSRTPQGAPPCFPPPRGQGNRSHETKLTGVVGTTRASPTLMRGLPRSLEWWAPLVLPAGWVPETPGGAPPVGASTFKPGSIFGWSPVPPLWGGGPAV

SEQ ID NO: 91157 - DNA, 854 bp, Zea mays
  misc_feature: Ceres CLONE 1579385
  misc_feature (854)..(854): n is a, c, t, g, unknown, or other
ctggagctccccgcggtggcggccgctctagaactagtggatcccccgggctgcaggaattcgtctcacccctagaaaaagtgcttgctagtagagcgcttattatgtttttgttcttgttcctgggtagatcgctctcgtgtggcggtgttgatgtacatgtcagggtcgtgttggatgcgctgggatgggagattacataagatgctacagagatcgattcatacgtagaaagaggaccggactccgccgtgtttccgtgtgttctggtctcagatctgttcgtggcagaaactagatgtaaatgaatcatgttcactactctctgtgtacaagccaagggaagctgcagtccactgtccacacacaccacgctaggattcagactcagaggcttcgtctctgtccgatgccgtcgcgcccagcgtcggcgtggccctggacgctgctgccttctcccggcgaaacctcctgaagtcggcgacgaggccgacgtccacgtcccgcttcatcttctccgccagcgtcgacaggacctgcactgcgttactgggctccagttttcaaggaaccggacgaggactacgtattttggatgcctggcgagagctgggtaccgattcggcgacgccgcgcaggacggtctctggcacgaggcgcaggggcggcggcaggacgcaggtgatggcgatctccaggtggcccctcatccggcacccgcggctcctgctccggtcggcgtacagcgacccgctcacgccgaggtcgaagctggatggcgcgtagctgacgtccagccccctcagctcccactccgtctggtacagtacaaagtcgcatcgattcacgctcgn

SEQ ID NO: 91158 - DNA, 1060 bp, Zea mays
  misc_feature: Ceres CLONE 1579386
  misc_feature: Encodes the peptide sequence at SEQ ID NO. 91159
ggatcccccgggctgcaggaattcgtctcacccctagaaaaaacaccacacctcacggcgtccattcgttcccgtctcgtcttccgctgcttgcctccgactcccccacgcgtcgtctcgtgcttcccaatccccatagagccggttgatccccaaaggcccatggttttctccgacgccgcgtcgcctctcgtagccactgccgctgactctgcttcctcctgcgtcgcccacctccgctgctgctgtcgcgttagttgttgctgttgttgctgaagacgcgttgctcgctagggttcgtgatttctcgcccatcgactcgggaactggtaagctacggatttctggcggcccccaccctcagaactttcgctcgggcttgcctcgcactcccactcccaatcttcatttgcatcctgaatccctcctcctttctctggttttatccaccctaattccgaaccgcctccgggtcccgtgtgggcccaaccctgaaaagggacatacggggaaggggggggaaaaacaaatttttttccccttctttggagaatttccccctttgcattaatagacccccgcccccgcccccttttatacccttgatgggggggtgggggggcccaaaaataatctttttctccggtgcccgtgcataccctttcccggggtgtggggcgcccccctttaatagcttccggtgttgcgcgtggtaaaaaatatatcgggcgcccgtttttctgttgataaacctccttcacccccggatgtcgtccccctggggggtaataccccttttcgtgggtgaggacattaacaacgctttgttctctttcctgtaatgtataacgactcgcggcctccacgtgaggcggggatcattactacccttagttaaaaataacttcttcttcggaggaactatcctttcttctttttcatctccccatttacttttctatgcgccccctcgtgatttgtcacatacgtagaatacccacttcttctctatctctatcccgctgtgcttactcttgttgttcgcactccgcctgagtgg

SEQ ID NO: 91159 - protein, 37 aa, Zea mays
  misc_feature: Ceres CLONE 1579386
MVFSDAASPLVATAADSASSCVAHLRCCCRVSCCCCC

SEQ ID NO: 91160 - DNA, 1333 bp, Zea mays
  misc_feature: Ceres CLONE 1579387
  misc_feature: Encodes the peptide sequence at SEQ ID NO. 91161
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (48)..(48): n is a, c, t, g, unknown, or other
  misc_feature (50)..(50): n is a, c, t, g, unknown, or other
  misc_feature (61)..(61): n is a, c, t, g, unknown, or other
  misc_feature (1331)..(1331): n is a, c, t, g, unknown, or other
gcgtgggagcgacnntnccctccactacccacggcgtcctctccttcntntaggaggaagnccccctcccttttaaactgggactccccgcggtggcggccgctctagaatagtggatcccccgggctgcaggaattcgtctcacccctagaaaaaataatgacgcgacacaccttgcttttcgtgcccactactctgtgttcaaggcgctggtggccgtcgaacgcctcctcggctgcgggggccatctcatggcgcagatctgcgccagaagaagcgcagtggtgtcatcaatgcccacggccatcctcccggatccgcccctccgagaagccagctccgcgtcgctgatcgcctgccgctggagttggcgccgagctcctcctccttgctgccgtcttcctccgctcgcaccgcatttctcgcagttgtgctcaggtcagcatacatccgagcgccggtgaaggcacttgccagagtgtgaccgtcagccaacacttgccgtaatcttaatttccctgtaagcctgaaatgccggtctggatccgcgcctagaattccctccccaccggccaacggggcaattaattgaggcgcccatttccccaagggcattcctcctttaagtcatccaggcaatgcgtgaaacggacatccggaggtgggaaaccccggggggtcccctcccgtccggatttccctgcggtggggacaccggctccgcacggaaataaaatgcgggtaatcgcaaccccttctcttgaaaaagaccacatgggtttattcttatcaaggagctacttaagagatgtggaaatctctgtcagctctcttctaacacgcaagggaacccccgtgggggcttaatacctgatgcacgcgcgcgctgactcctccgggatgtggatgttttacacaacagaacaagaggagacatttatccactagaatcgcgtggggggggctggaacaatagaagttcccccgcgtgggcgcccctccttattgggtttgctcgaaatttcgtgacaggggagctttctgagcacgaaataggacatatgtgacaaaaaaattggtgatgtggtccctcccggattttgctcgatggcactgtctccgcccgcacacgctgtgtgtgtaatatacactgcctcgtgttgggaaaatatgtgggggagctctatccagatagggtgtggagtgttgcaaccccccagcggtacactatgtgggatgtgtgcgattgccatgtcgacttggcggtgggcctgcgtgattatctccttgtgggcgaatgtgatattctatggatgagagaataatgctgnga

SEQ ID NO: 91161 - protein, 63 aa, Zea mays
  misc_feature: Ceres CLONE 1579387
MTRHTLLFVPTTLCSRRWWPSNASSAAGAISWRRSAPEEAQWCHQCPRPSSRIRPSEKPAPRR

SEQ ID NO: 91162 - DNA, 976 bp, Zea mays
  misc_feature: Ceres CLONE 1579390
  misc_feature: Encodes the peptide sequence at SEQ ID NO. 91163
ctggagctcaccgcggtggcggccgctctagaactagtggatcccccgggctgcaggaattcgtctcacccctagaaaaaaaaaacgaaacggcgaccacatacaaaacagcgactcccttgttgccggctatagcttttgcctccgtttcgctttgataaataaaagccataactcccggccgtccatcgctcgcctcccctccctccctccccgccgctgtctccggcgacagccagcctcatcgtccatggcctctacatgcctagcccccgcctccctctccacgcccctgctctccgactccatcgcgcgcgcgcccgccgccaacgggcacgccaccaaccaccgacaccaccaccacgacgacagcgacggtgctgcggcggtctccgcccgcgacgacggcggcggggacccgttcgcgttcctctcggaggaccggccgccgagggaccgagggccgtccccggccgacccgttccgcaacggcacgccggcgtggggcggcggcgtgtacgcgtggtcgaggacgctgctgctcctgccggtcgcgttggtgcggctggcactgttcgggctctccatcgcgatcggctacgcggccacgtgggtggctctccgcgggtgggcggacacgcacatgaggccgcgggtgggcggcgtgcctatgccggcgtggcgcccgcggctcatgtggatcacgcggatctcagctcgctgcatcctcttctctttcggggtacaattggatcagaaagaaaggaaggcccgctcgtaggaagctcgcacctaatgttgtttcaatcatatctcgtacatagaacccatattcttcttctatgaattgtcccaaccattgtttcgtcagagtcccaagatgcctaacctttggtgggacaattattcgagcgaagcaagttttattggtgaacaattccaaccagcttcccggaggggtgcgtaaatgaaaaaa

SEQ ID NO: 91163 - protein, 176 aa, Zea mays
  misc_feature: Ceres CLONE 1579390
MASTCLAPASLSTPLLSDSIARAPAANGHATNHRHHHHDDSDGAAAVSARDDGGGDPFAFLSEDRPPRDRGPSPADPFRNGTPAWGGGVYAWSRTLLLLPVALVRLALFGLSIAIGYAATWVALRGWADTHMRPRVGGVPMPAWRPRLMWITRISARCILFSFGVQLDQKERKARS

SEQ ID NO: 91164 - DNA, 830 bp, Zea mays
  misc_feature: Ceres CLONE 1579391
  misc_feature: Encodes the peptide sequence at SEQ ID NO. 91165
ctccccgcggtggcggccgctctagaactagtggatcccccgggctgcaggaattcgtctcacccctagaaaaaaaagggagaagctctcctgagaagcatatagcaccagcggaacacgggaacggcggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgaattccaggaatcaacaattggagcagccttcttttcccagaccttagcggtcaatgaccacactgttaagttcgaaatctgggatactgccgggcaggagaggtatcatagcttggctcccatgtactataggggtgcagctgctgccattgttgtctatgacatcacaaatccggttagtaatacactattgatgcctccattgtagataaaccaacgaattagaaatacacagtaatttccccaagattgtaattgttgatggccttgtgttaatgcaaaaagttttaaaactttgttttactgagatgccataaatgcagttagcaaaagtattctgatgggtgccttcatggtgtacttgttagttaaacagattaaactagatgttgattttggatatggcaagtgaccaagtctagtttggttatcctaaggtaattcaaaaaataatgttggaactttcaatggaagggtctaaaagttaccggg

SEQ ID NO: 91165 - protein, 106 aa, Zea mays
  misc_feature: Ceres CLONE 1579391
  misc_feature (13)..(105): Pfam Name: Ras Pfam Description: Ras family
  misc_feature: SWISSPROT Homolog: EC 2.7.11.1 Non-specific serine/threonine protein kinase
MAANAGNKIRNAKLVLLGDVGAGKSSLVLRFVKGQFVEFQESTIGAAFFSQTLAVNDHTVKFEIWDTAGQERYHSLAPMYYRGAAAAIVVYDITNPVSNTLLMPPL

SEQ ID NO: 91166 - DNA, 969 bp, Zea mays
  misc_feature: Ceres CLONE 1579394
  misc_feature: Encodes the peptide sequence at SEQ ID NO. 91167
ctgaactagtggatcccccgggctgcaggaattcgtctcacccctagaaaaactcgctcaccctctcaccaaatccttctcctccgcgccgccacagccgggcgcgcctctcgatctggatccaggagatatgcctcgttatgatgatcgccatgggaatacacgcttgtatgttggaagattggcccctcgcacccgttcccgcgacctagaatatcttttcagcaaatatggaaggttttcggttttttaccctaccatggaggtctgtggtggaagggtgcccttggtggaattggtggccattgttccgatatttgtggaggactttggtgaagggcgcccttggtgtaatcttattgaccgcccccccctgaagttgcaagttgacgcatttgagtacttgactcatgtctgcagcttactgtgtgtggaaactatttgcgcagaatacgtgaagtggagttgaagcgtgactatgcattcattgtatgttctactacactcaggctattgccaaccattccccctttcatatccccccagttgtactttctactcactagttgaatacattcgcctcaaccttttcttccccctatttttttctcctcctccaactatttccacccattttaagtctccccgcttctactctttaaactggagctattttgccgtttgtatatattacgttttccgcatcacctttgcggaattttccctaagcatatcctctccactgtttgccggtagccgtgacttacacgtttggttcttctacgttaagtatacctccatcaggatttatttcccaccgctttctagttctgtttctaactaattgtgggaaggaactttcagatttcccctctgtgtactcggtgtgcctcttgaaggctgataccccttctttggacgaccggtcctcctaaacatggcttccctatttggatcagctcctcgttg

SEQ ID NO: 91167 - protein, 112 aa, Zea mays
  misc_feature: Ceres CLONE 1579394
MPRYDDRHGNTRLYVGRLAPRTRSRDLEYLFSKYGRFSVFYPTMEVCGGRVPLVELVAIVPIFVEDFGEGRPWCNLIDRPPLKLQVDAFEYLTHVCSLLCVETICAEYVKWS

SEQ ID NO: 91168 - DNA, 823 bp, Zea mays
  misc_feature: Ceres CLONE 1579401
  misc_feature: Encodes the peptide sequence at SEQ ID NO. 91169
ctcaccgcggtggcggccgctctagaactagtggatcccccgggctgcaggaattcgtctcacccctagaaaaaaagccgaaatgtaccccgcacggccggcggcgcgtttgccaccgtcgagttccatgtcggccaccgtgctctttctgaccgcaaatccaagctcgacggctagtcccgctaacactttccggcaacttacgccggcttccacctccggaaagctccacttcccggcgttcccgctccgcctcccccgccatgcctgcgcaaggacctatcgctccgccgcattcgggaggggatcgcctgtggccgggcgtagagagaaggactactacgccacgctgaacatccgccgcgactccacgctccaggagatcaagtctgcctaccggattctcgcccgcaagtaccatcctgatatgaataagagtcctgaagcagaagaaaagttcaaggagatcagtgctgcatatgaggttctatctgatcaagataaaagatctttatatgatcgctttggagaagaggggctcagcggtgactacagaaatggagatattggcacacatgggattgatccatatgaactcttcaatgctttctttggtagttctgacaaactttttggggatagtatggggtcctggggggatttcgttatagtgcagaagcaaaggacaatagggcacttaacatcagctataatctgctcctttcttttgaagagtccatccctcggaggccaacgtggaaaacaatggtttttcgccatgaaaacatgtggcaccctgccatggaaactggaagctaatgat

SEQ ID NO: 91169 - protein, 232 aa, Zea mays
  misc_feature: Ceres CLONE 1579401
  misc_feature (70)..(131): Pfam Name: DnaJ Pfam Description: DnaJ domain
MSATVLFLTANPSSTASPANTFRQLTPASTSGKLHFPAFPLRLPRHACARTYRSAAFGRGSPVAGRREKDYYATLNIRRDSTLQEIKSAYRILARKYHPDMNKSPEAEEKFKEISAAYEVLSDQDKRSLYDRFGEEGLSGDYRNGDIGTHGIDPYELFNAFFGSSDKLFGDSMGSWGDFVIVQKQRTIGHLTSAIICSFLLKSPSLGGQRGKQWFFAMKTCGTLPWKLEAND

SEQ ID NO: 91170 - DNA, 813 bp, Zea mays
  misc_feature: Ceres CLONE 1579402
  misc_feature: Translation starting site: 159
  misc_feature: Pfam Name: dsrm Pfam Description: Double-stranded RNA binding motif
  misc_feature: SWISSPROT Homolog: EC 3.1.26.3 Ribonuclease III
ggagctccccgcggtggcggccgctctagaactagtggatcccccgggctgcttgaattcgtctcacccctagaaaaaaaccccaaccccaaccccccaagaagcaccgcgcagaaccctctgctcctctcaccctcacgctccaaggcggcggcgccatgcacggcggaggcgcggcctcgcccgatgccgccatatgcatctccccagaagctgggcccatcgtcggggtcgcccccgccgggatcagggtcgaaaactgctacgtgttcaagagccggctgcaggagtatgctcagagggttggcattccaaccccggagtaccacacgctgaaagaaggcccgtctcatgaacctgtcttcaagtccacagtgttcgttaataataccaagtatgaatcgctgcctgggttcttcagccggaaggctgcagaacagtctgccgcggaagttgcgctcatggagatagccatgtccgctccggtgaccgaaattaggaacatgccagcagttcaagaaactggactgtgcaagaatctccttcaggagtatgctcagaagatgaattatgccattccatcttatatttgcactaaacaagcttcgggtgtagctcctttcgtatgcagtgttgagattggtggcatccctatacattggtgctgcagctaggacaaagaaggaggcagaaataaaagctgcccgaaactgctcttccttgcaatccaaaagtcaatccagaagggggtggccaaatggctggccaaaaaagtaacattggttggttccctgggggcaaagggccaaaata

SEQ ID NO: 91171 - DNA, 888 bp, Zea mays
  misc_feature: Ceres CLONE 1579404
  misc_feature: Encodes the peptide sequence at SEQ ID NO. 91172
  misc_feature (737)..(737): n is a, c, t, g, unknown, or other
  misc_feature (738)..(738): n is a, c, t, g, unknown, or other
ctggagctccccgcggtggcggccgctctagaactagtggatcccccgggctgcaggaattcgtctcacccctagaaaaagctgttgcgttttcttcccactaccgtccgccacagcctacgcaccttgccggctcgcgggggttttgccgtgcgccttctccctcctcctcgctcgcggcgacgaccgggggaccgcagccaccgtacgccaggtgcgcaggtcttctttgggcccgtcgccggcgacgagcacccaccaggggcgtccgagtctggaatcctatctgatcggaaaatggttaaggtcgaagatcaggccgaggacggcggcgcagatgctgatgccaggggtctcagggagtctgctctggatccgctgcctgtctcggtgcatgccagcttgaaggaggaggaaggtcaaccaagttcttcatctggtaaactaagatcacagtttattggaatggggttttcatccaagctggtagacaaggttctccagagacatggtgatgatgattctaacacaattttggaatctcttctgtcctattctgaccttcagcagtctggatcagagtcatcagattctttcggaagtttttttgataatgataatgaagagaacaattctccttcagagtctaggagaggaatctaccaagacatcaagccagagcttgattctttctcagagaagtggtcatttttactcagaacgatgaacttttcacnnacagaagttgatttagcccttcagcaactagggaaagactgaattacttttatggtgtgatggagaaaacacttagcttgcttcagatgggctttacctgaggaagagtatcatcagctatttgacattttgaccagagagcaactgttc

SEQ ID NO: 91172 - protein, 160 aa, Zea mays
  misc_feature: Ceres CLONE 1579404
  misc_feature (147)..(147): Xaa is any aa, unknown, or other
MVKVEDQAEDGGADADARGLRESALDPLPVSVHASLKEEEGQPSSSSGKLRSQFIGMGFSSKLVDKVLQRHGDDDSNTILESLLSYSDLQQSGSESSDSFGSFFDNDNEENNSPSESRRGIYQDIKPELDSFSEKWSFLLRTMNFSXTEVDLALQQLGKD

SEQ ID NO: 91173 - DNA, 1150 bp, Zea mays
  misc_feature: Ceres CLONE 1579405
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
gggggggtgggnnntnnntccgttgtggggggtgtgttgagggtggggggaaacctnnnnaggagaaggggaaagctggaactccccgcggtggcggccgtttcaaaacagtggatcccccgggctgcttgcattcgtctcacccctagaaaaaacacaagtctgaacgcttgaacctgaacctccaaagcagcaaccccagcagctttagctcctcctcatcgcagccgcagcgccgtcccctactcttcctgcgaccaactgctgtctctccggcgacggcagaaccgtctctgcaggtgcagggaaggacccgggagatgagtctggggctgctcaacacaaagcggcacccaccttctctccccgaagccgcagaaccctccgggaagccgccgaggcgtcgctgctgaaggtcacccagggctccccggcgctcctggaaggcggaggcccccaacccgaagccccgccaggaaagggcgcaccgggggggccggagaggcgcctccctcaagctttaaaaaaaacgggggaggggcgaacaaaaagcccgggggggggggcaccaacggggagcgggggcccggggggcgcccctgggcggcctggcatgcaagcaggggggaagcccccccccgggcgggcggggggtctacggcggggtccccccctcaagggggccaagggggcccaggaaatcccaaaagaaaaaatatatttcgcccatggaggcccaaaaaaggggtgggggagacacgggggaacaacaagggggggggataaacccccacaggcgcgtagaaggaaaaagaaatgatttcacgagggggggggcagggagggaagggacggtcccataaaggcccatataaacggaaaagggggggcgacaaaattagaggaccgcgaaagaaaggacgcgtgtgggtgggaaaaaaaaaacggaccagaatctacgaaagggtagaaaccccgcgagagcaggcaagaaaggcacacaacaccacccgctgttcttccacaagaaacagagaaaacaaagcacggggggagagcgcgtacgcaccgtgtgcgccttgagggggtccaacagggggccccgggcggagaaagggatgaaccccccagcggagcgctcaaacagagg

SEQ ID NO: 91174 - DNA, 768 bp, Zea mays
  misc_feature: Ceres CLONE 1579407
  misc_feature: Encodes the peptide sequence at SEQ ID NO. 91175
  misc_feature (407)..(407): n is a, c, t, g, unknown, or other
tggagctccccgcggtggcggccgctctagaactagtggatcccccgggctgcaggaattcgtctcacccctagaaaaaacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcaggnacagttcccccagcgtttgggccatcgtcttcctctgcttctccgcatttctactctgcaacattggaccgcgtaaatatgaacattggctattctgcctaatgtcgccaaaatttgggtttggaacccaaaaaacggttgggtctccattccggtcatttttttctttgggggcttccttccaaaccccaaaaacttggagggaaaatggcccaaaactttttgaaagaaaaaattcccccctggttttgggggggggtttgggggggccaaaaaataaagtttttacccccgtgtggaaacccaattggggggggggccgttttttctttttggtggggggggcttttttgggggaaaa

SEQ ID NO: 91175 - protein, 120 aa, Zea mays
  misc_feature: Ceres CLONE 1579407
  misc_feature (96)..(96): Xaa is any aa, unknown, or other
MLLHLLPLSCPAPPFHLRRTGGSPRVRAGDRARTRGLRGTDVEPETAPRRRRSRDGDDPQAAGSGGDTGALLASVRRLLLSEAPAAAEGDSEEEQXQFPQRLGHRLPLLLRISTLQHWTA

SEQ ID NO: 91176 - DNA, 846 bp, Zea mays
  misc_feature: Ceres CLONE 1579408
  misc_feature: Encodes the peptide sequence at SEQ ID NO. 91177
aaactggagctcaccgcggtggcggccgctctagaactagtggatcccccgggctgcaggaattcgtctcacccctagaaaaaattttccacggagccttccggataggatttgtctcccctccactgcgcctctccgtttccgccatggctccggccgccgccttcctgtcggcgtgcgccgctggttccattccccgtgcgcccttcctgatcccgaggcctcttcttctcccaattccgctctcccctgcgcgctgggaccgctcccgcagctgcagcctctttggcgtaggcgccaacactcgccgcgcgccaacccttcgacggaacgcctccacggagacggtggttccctacgtgccgggctctggcaagtacatagcgccggactacctcgtgaagaaggtgtcagccgaggaggtgcaggagctggtgagggggcagaggaaggtgccgctcatcgttgacttctacgcgacctggtgcgggccctgtgttcagatggcgcaggacatcgagatgcttgcagttgagtatgaggacaatgccctgtttgtgaaggtggacacagatgatgaatatgaatttgcaaaagacatgcaggtaagaggggcttcgaccctttacctcttcagtccagaaccaaacaaagatgccatacgcaccgaggggctaaattcctagggatatgaatcagaaacatcattgaacaacagtttatgacagctgaatagatcactgtaatagggaccaaaggcaatgttttaatctttgaagcaaaaaaatttttgttcagaaggctaaccaataaccgctaggtggcaaagttggggtggcttgaagt

SEQ ID NO: 91177 - protein, 179 aa, Zea mays
  misc_feature: Ceres CLONE 1579408
  misc_feature (84)..(180): Pfam Name: Thioredoxin Pfam Description: Thioredoxin
  misc_feature: SWISSPROT Homolog: EC 1.8.1.9 Thioredoxin-disulfide reductase
MAPAAAFLSACAAGSIPRAPFLIPRPLLLPIPLSPARWDRSRSCSLFGVGANTRRAPTLRRNASTETVVPYVPGSGKYIAPDYLVKKVSAEEVQELVRGQRKVPLIVDFYATWCGPCVQMAQDIEMLAVEYEDNALFVKVDTDDEYEFAKDMQVRGASTLYLFSPEPNKDAIRTEGLNS

SEQ ID NO: 91178 - DNA, 1023 bp, Zea mays
  misc_feature: Ceres CLONE 1579412
  misc_feature: Encodes the peptide sequence at SEQ ID NO. 91179
  misc_feature (47)..(47): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (67)..(67): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
  misc_feature (1023)..(1023): n is a, c, t, g, unknown, or other
tttttggctttggggccggcatcaaataaatgacctgagagggggcncccgggtgtttggnnnnggnngggnnccaagctggagctccccgcggtggcggccgctctagaactagtggatcccccgggctgcaggaattcgtctcacccctagaaaaaactcgtgccgtgcactcgtcccgtccccctccaccctccaagacctcgcattgccaccgccgccgccgagccaggggagaggagagaggccagccgcgtcgcggcgggcggaggaggaggacgagcgggagagcggaacgagccggccgggcaggatgttcgggcgggatccctggggcgggccgctggagatctccaacgccgactcggcgacggacgacgaccgcagccgcgacctggaccgggcggcgctgatgcggcagctggacaagacgcagcagagctggctcctggccgggcccggcgaccaggccggcaagaacaacaagcggtacgtcgacctcggcttgcctcgtcgtcgaccgcaagggtcttcatgtgggaccgtcggcaaccgtccatcggcctcggacgtctttcatcgcgcttcggtcatcagtgatcggtccaggctccgtccccggcacaaaaagacccccccggccgcccggcccgccccgaaacagttacaacgccaaggccgcctggccaaaaagggggcgcgtacagtggttccgtgtccaaccgcggcccacccggagatccgggggccccgccctgcgccggaaagccaacaaaaaggcccctgtaaaaacctgagaagggggtcaaaacttccccggcctggtaaaaggaaaagggccttcttcccttaaaaagcctccggttccctggcccggaaagaccccgggtccggagaggcgcttccttacccacggccgggggggaacgcccccatcaagggtttccaaaaatgccccccaatgggcaattggggttcaatgaaacacatggcctcgggctggggaaagcggccacaccaaan

SEQ ID NO: 91179 - protein, 179 aa, Zea mays
  misc_feature: Ceres CLONE 1579412
  misc_feature: SWISSPROT Homolog: EC 3.2.1.4 Cellulase
MFGRDPWGGPLEISNADSATDDDRSRDLDRAALMRQLDKTQQSWLLAGPGDQAGKNNKRYVDLGLPRRRPQGSSCGTVGNRPSASDVFHRASVISDRSRLRPRHKKTPPAARPAPKQLQRQGRLAKKGARTVVPCPTAAHPEIRGPRPAPESQQKGPCKNLRRGSKLPRPGKRKRAFFP

SEQ ID NO: 91180 - DNA, 1282 bp, Zea mays
  misc_feature: Ceres CLONE 1579414
  misc_feature: Encodes the peptide sequence at SEQ ID NO. 91181
  misc_feature (14)..(14): n is a, c, t, g, unknown, or other
  misc_feature (53)..(53): n is a, c, t, g, unknown, or other
  misc_feature (1025)..(1025): n is a, c, t, g, unknown, or other
  misc_feature (1029)..(1029): n is a, c, t, g, unknown, or other
  misc_feature (1036)..(1036): n is a, c, t, g, unknown, or other
gtggttttccggtnccgtggggggtggggtgggaggttgtgggggccggtggnaaaattaaggaagggtttcaaaactggagctccccgcggtggcggccgtttctagaacagtggatcccccgggctgctttgattcgtctcacccctagaaaaaaagcgcaagccgggcaagaaaactccgctggccagtctgcgagttggatggccttcttcttggccctcgtgtgcatcctcatcttgctagccatcgcctcctacgtccagtacactcgctggcaaaaggggaaaggccgcttcggcggccatgggaggtctgctcccttgaagctgcctcctggctccatgggctggccttaccttggcgagaccctccagctttactcccaggaccccagcttcttcttcgcttccaaacagaagaggtacggcgagatcttcaagacgcaacttctggggtgcccggggcgtgaaccccccccaacccccgaagccagcgcgggttcgtgcctgggtgaacgccaggccgcacccggtttcaagcccgaacctaacccgccggaagacagggaggccccttggaactggggccgagcagggcgtctcctttcttgtccacccagggggaggaaattaaccaaaccttcccgccccttcccagaaaaagccgcccgtccccaaaggggggggccgatctcagaggccccccggaaatcaccagtcttgttcaagcgagcagagccccccagctatacctcttggaatgagttgtaggagagaggacccccctccgcacgagtgggcgcgggatgtcccacaaagatcttcatatagcggggagtgtatccctctttgggagagaaataacgcccccggggggccccaggcgagttttccagaagaaaagaggcaaagggggtgtttaccccaagcgctcgcccctgtgtgaaaagaaacagcgctcgtggctcggcatttttggatagaggttgcggggggccactacgtgcgcgataaccagcactntatnattagtnaaccggagaaccccgtgtcctgagatataacaaaacacgaggcgccccaagagggggcggagaatcctcgtgaaggtaatgaagaaatattattcaccccacacctcaatggagtagaaaaagaggaggttacaaataatgtccctgtatcccccagagaaggctctggaccccggggagaaccgccctcccattattaaagagggcgcaaatcctggggtgtaatcacacaccacgccgataacg

SEQ ID NO: 91181 - protein, 189 aa, Zea mays
  misc_feature: Ceres CLONE 1579414
  misc_feature: SWISSPROT Homolog: EC 1.14.13.93 (+)-abscisic acid 8'-hydroxylase
MAFFLALVCILILLAIASYVQYTRWQKGKGRFGGHGRSAPLKLPPGSMGWPYLGETLQLYSQDPSFFFASKQKRYGEIFKTQLLGCPGREPPPTPEASAGSCLGERQAAPGFKPEPNPPEDREAPWNWGRAGRLLSCPPRGRKLTKPSRPFPEKAARPQRGGPISEAPRKSPVLFKRAEPPSYTSWNEL

SEQ ID NO: 91182 - DNA, 931 bp, Zea mays
  misc_feature: Ceres CLONE 1579415
  misc_feature: Encodes the peptide sequence at SEQ ID NO. 91183
tggagctccccgcggtgggcggccgctctagaactagtggatcccccgggctgcaggaattcgtctcacccctagaaaaagaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgataaggcaatctgaaaacattggccgccaaacctccagagcgactcccgcgagccgtgaccaccatagccaaatcaacgcaccagaagctttcacggagctgtctcgtccacgagtgttccagctgactcctattccctgcgtcaatggcgagctctggcgatgaagggcgtgtggtgttggacctcggctccgcggcggagtcggtggctgccgacgaggaagcgcaccgcaccgctctccacgagattgagtccctttgcatgcgctgcggcgagacggcatcaccaagcttttgctgacgtgatcccgcctttccgggaagtggttctatgggcctcaaatggccacattgtggccaaaggaaaacaaaattcagttttgctgaaaatcccaacccaagaaagccgctcaccttggaagttccttgggggcaaaaggaataccaaaccccggggcggaacctttttcccccactcaaaattccaaaccggctttgaaacccccaaaaaccccggaaaactttctgggggaaaggatatttccgcccggggagaacccgcgcccttaaaaacaaaaaaagggtcccccaaggcgcaaattttatttttttaaaagaagaacc

SEQ ID NO: 91183 - protein, 51 aa, Zea mays
  misc_feature: Ceres CLONE 1579415
MASSGDEGRVVLDLGSAAESVAADEEAHRTALHEIESLCMRCGETASPSFC

SEQ ID NO: 91184 - DNA, 869 bp, Zea mays
  misc_feature: Ceres CLONE 1579416
  misc_feature: Translation starting site: 122
ctggagctccccgcggtggcggccgctctagaactagtggatcccccgggctgcaggaattcgtctcacccctagaaaaaacgtacgccagaacccctctctcccccctccttctgcagccatgctcctccacctgcttccgctctcctgccccgcgccgccgttccacctgcgcaggaccggcggctcgccgcgggtccgcgccggggatagggccaggacacgggggctccgggggacggacgtggagccggagacagcgccgcgaaggcgccgcagccgcgatggcgacgatcctcaagcggctgggagcggtggagacaccggggcgctgctggcgtcggtcaggaggcttctgctctccgaggcgcctgcggcggcggagggagacagtgaggaggagcagggacagttccccaagcgttgggccatcgtcttcctctgcttctccgcatttctactctgcaacatggaccgcgtaaatatgagcattgctattctgcctatgtccgcagagtttggttggaacccacagactgttggtctcatccagtcatctttcttctggggctacctcctaactcagatagctggagggatatgggcagatactgttggaggaaagactgtccttggttttggtgtggtttggtggtcatagctacagctcttactcctgttgcagcacatcttgggctgccattttctttctgtgtgcgggctttcatgggaattggtgaggggggtgcaatgcctgcaatgaaacatattctttccaaatggttcctgtatcagagaggagcagatcattgtctcttgtgtacagtgaaatgtaccttgggtcagttacaagaattgcattttccccc

SEQ ID NO: 91185 - DNA, 1064 bp, Zea mays
  misc_feature: Ceres CLONE 1579421
  misc_feature: Encodes the peptide sequence at SEQ ID NO. 91186
  misc_feature (72)..(72): n is a, c, t, g, unknown, or other
  misc_feature (73)..(73): n is a, c, t, g, unknown, or other
caacacttcacttactttttattgcatataactattttatatagttaccagccctaatttccactaaataanncaaaactggaactcaccgcggtggcggccgctctagaatagtggatcccccgggctgcaggaattcgtctcacccctagaaaatgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattggaaacatgtgatgacctactcccccatgctgaagacctccagattgtgaacagatgcatcgattcattggcatcaaaagctactagtaatccaaacctctttggatggccgataacgcaacatggcatgatgcaaagtcctggtggcagtgtactatggaatgggatcagcacgggtgcaaggcccagaaatttcaattcagactggtggtaccgtgatgcttcatcattgagttttcccatgtataagaggttaatctccaccatggagtctcgaggcatcccggcctgaaaaaattgcctggtttcctttaacctaactatgcccaaagaagtatttttcccaggaacttaaggcccgtcactaagttcataaccattggggccaccaattggcactcttgtaactggcttaactctaatcctggaagggtttggaaacaaaaaaacaaatttttcctttggaaggaagaaatcgaaccagggcgttttttggccctccccttcccccaggggggtaatatagcatccgaaccaaaaaagtttccctgcctttggggccctccctcttccgccacatggcccatgtaatttcctgaaaaagacccaagcccccccaccgctggccaattttcctaaaacttggggaaaaaaaaccaaaatttgggccgtgcccaacactaggaaccctgggcccacctttttgg

SEQ ID NO: 91186 - protein, 129 aa, Zea mays
  misc_feature: Ceres CLONE 1579421
MTEEVAEENLIAQSEMFLNQVVLRNWKDSLAALETCDDLLPHAEDLQIVNRCIDSLASKATSNPNLFGWPITQHGMMQSPGGSVLWNGISTGARPRNFNSDWWYRDASSLSFPMYKRLISTMESRGIPA

SEQ ID NO: 91187 - DNA, 1273 bp, Zea mays
  misc_feature: Ceres CLONE 1579426
  misc_feature (1260)..(1260): n is a, c, t, g, unknown, or other
cccctcttcgctgccgtttgcggcgttcttggtggttcactaccccccctcacggtgagccttgtagatttcaaagctggagctccccgcggtggcggccgctctagaatagtggatcccccgggctgcaggaattcgtctcacccctagaaaaaaactcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccataagtaccagtagttttacatttaagtagtagtaattgcagcagcaatctcttgtaaactgagactcgcctcccccccgccgcgagggccctttttgccgcttgcccagctcccccccattacttaaagaatcctccctaaatgtttctctcttccaaggccgcaaatccggcggaactgcgtagagtaatttccacaagggcctttcaaaaacccggtagcgcccctcttttcccctccccctaaccaaattgcaaaaagggcgagaggtgcacacgatggaatcgcttcacataccccataaaaaatgttgaaaataaccggccgccgcgtggttgaccctccctccgtagggtctgctccctccctatatttctgtggcaccgccgtgagcgcgtcctctttcgcgtgccaaaaagagctcccgccaacaaacatatttaaataaggcgccgcaacacagattcacttttcgggcgcgacaaacttctccgtcagaagtaccgcccgtgtgattgatggttgtgagggtgtctctgtctattgctccccccaaacttatcgatatagaacaattttacatttttcgggggtagacggtcgtccgcccacacgcttggccataattgattctgcacaccgctccctccagattgtgccctcacccacccatgctaagcatgattgtatacaatacaggtgtgacatctacccgcccgtggtggaggagagctccatcgtggaagagaagagcgtgatacttacagagcggtgtcgcatagagacgagagccaatacagcacgaaatacggagagagacagtacgaacatgtctccgctacctgtctgctgaagncaagaacgtagta

SEQ ID NO: 91188 - DNA, 1051 bp, Zea mays
  misc_feature: Ceres CLONE 1579427
  misc_feature: Encodes the peptide sequence at SEQ ID NO. 91189
  misc_feature (1006)..(1006): n is a, c, t, g, unknown, or other
ctggagctccccgcggtggcggccgctctagaactagtggatcccccgggctgcaggaattcgtctcacccctagaaaaagctcgcgccacagatctcgcctgccggaaccctaatgccgcaggtggacgcgccgggggagtaacgccgatgcagcgccgggtgggcatggcggacggcgaggccagggggcggacgctcggcgccgtcatcaaggagaaggatgaggagctcgcgctcttcctcgagatgcgccgacgcgagaaggagcgcggtgctgcggcggcggcggcggcggcggaccagctcctgctctctggcgactccgtggcgggggacgggatgctgcttctcggcccgccgccacccgccgagcccaaaccggtggcgtacaaaccggctggtggcggattttagagggcgcctggcggagcggacgatttcctccatgcagacgctggcgacaagaacgattacgactggcttctgacaccaccggaaactcaccttttccctcctctagaagttgaatcgaaaaggtgccccgggggagccaggctgggaccacaaaagactcggcccaccggccttaaaaaaccaagggtggcccaaccctcccgaatccttccttcaagaaaccaacccccccttttagggagaggctctttcgaaaaagcccggaaacctctttgtttcccaaaggtgtaagagggttttgaccccccccttttcgggagaaatgttttccgcacaaaaaaggggattcttgggggagagggggctcccaccccccttgtggaaaacaaactttccctccgcggggggaaaacaacccctcttaaaagggggtggtggcctcttataaaaaaattctccctcccctggagaaaaaatccgcccctcgtttttgtgtacccacccccttcggggagggaatatcgggtggggagaaaataaactttctctcccccccctccaacaaaaggaactttatggggggttctccngagaggcgtcttccctccccgcggggaggttgtggggctgatttc

SEQ ID NO: 91189 - protein, 88 aa, Zea mays
  misc_feature: Ceres CLONE 1579427
MQRRVGMADGEARGRTLGAVIKEKDEELALFLEMRRREKERGAAAAAAAADQLLLSGDSVAGDGMLLLGPPPPAEPKPVAYKPAGGGF

SEQ ID NO: 91190 - DNA, 894 bp, Zea mays
  misc_feature: Ceres CLONE 1579431
  misc_feature: Encodes the peptide sequence at SEQ ID NO. 91191
  misc_feature (796)..(796): n is a, c, t, g, unknown, or other
  misc_feature (797)..(797): n is a, c, t, g, unknown, or other
ctggagctccccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcattcgctgctgtactcctcctcgtctcttcagtatgcagtactttattactttcccgtccgcccgtcccaaccaaccaaattatatgacattaataatatatagcgcataataaataaacctcgaaaaaacactaaaacgtcttacgatttaaaacagttttgttgtaataataatttgtataaatttcagtttcgtctttcagccgtcctcttcttctccgctgatctggcactggcagggcagctgcagccccacctgtcctcttnnatacacagtctcacgtggaactttactgtacacggaacggcaacggctcgcccatctagagatggcccaatgggcctactgacggccagcccaggaa

SEQ ID NO: 91191 - protein, 58 aa, Zea mays; identical to SEQ ID NO: 46528
  misc_feature: Ceres CLONE 1579431
  misc_feature (6)..(56): Pfam Name: UPF0057 Pfam Description: Uncharacterized protein family UPF0057

SEQ ID NO: 91192 - DNA, 837 bp, Zea mays
  misc_feature: Ceres CLONE 1579438
  misc_feature: Translation starting site: 189
  misc_feature (639)..(639): n is a, c, t, g, unknown, or other
ggagctccccgcggtggcggccgctctagaactagtggatcccccgggctgcaggaattcgtctcacccctagaaaaacaccgttccggtcctcccgaaaagctaagggagacgagcagcctaaaaaccctagcccccgaatcagatcccaccgcccgccggagcgcggaaccctgcccccggccgccatggacatgagcgatgcggagcggctgttcttcttcgagatggcctgcaacaactccgaggtcgcgtacgagcagaaccccaacgacgccgacgtacgatgcatctcgagctcctctcctctactcgttcgctttcctgcagcatggctcgaaccctgtattgcgtgttcctgtgtctgcgcagaacttgacgcgatggggcggagcgctgctggagctatcgcagctgcgtaacggccccgacagcttcaagctcctccaagatgcggaagccaagctggaggaggcactgcaaattgatcccaacaagtctgatgcactctggtgcttgggaaatgctcagacttctcatggattcttcactccagacactgcaattgcaaatgagttctttgcgaaggcaactgaatgtttccagaaggctgctgatgtggtatgtgtagtccgctgntgtgttagctaaaattcgaacgtatttatattggtccctttattaggctgacccatagttacaaagttcttgagatgggtgggggtgtggaaatagggatcaaagaaatgtattcctctcttcgagaaatttttttccctttttcactgccggggacaagattgtttctgggttcgtgcctttcctgggtatgaggaa

SEQ ID NO: 91193 - DNA, 1225 bp, Zea mays
  misc_feature: Ceres CLONE 1579443
  misc_feature: Encodes the peptide sequence at SEQ ID NO. 91194
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (24)..(24): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
ttttatggtgcnnnncacatgcanaaggggggtagaacaagaggaggtgagaaaaaaaggcgggatnnnnnaaactggagctccccgcggtggcggccgctctagaactagtggatcccccgggctgctttgaattcgtctcacccctagaaaaatgccgcgcccgatggcctcctcctccgccagggaccgggcgaaggattccgacccctcatcatcctcggcagcggacggattcctccatggcatctctgatcgagcgcgccacctccaccacggcgcacggcgtcgacccggtgctcctccgcgccatcaaatcttcggcccgtgcctccgatgccgccatccgggacgcgttccggctcatcctctccctcatgtccaagccccactctcacgggcggggtctcgcctttcgcatcgccgaagagctcttcatgggctccaagctcctccggtccctcctggcggacccccctctaggggttcctcccgccacaacgttcggggttccgcccaaagaaaaccccctcctcgccgccgaaacggggggccgcctgcccttatctcccggaaagggcccccccggtccaaggcgccctccaaggcgcctggggaacccaatcctcctgtgggggggggggaaacttaacacggcgagggatttcccaaccctcggggcccgggaccgagagttaccccccccaaaagggaaatatcccctgccgcccggccgggtgcccagagtattccctcccggggggggcccgggggccgggggccccccaccacacaatatgggaaatgtgctcctccgctggggacaggaacctctcacattggaagaggccgcgtccccgcctctgggcacggggaaaaaaaaaccctcattgtgccccgggcgcaaaagagggatatggaagacacaagtctgggccgcgtggaaagagaaacccgtcggcgcctctccgtgttcaaaaaggtacaggaaagaatttctccggcgccccaccaagaagtgtgtaatgaagaagatctcgccgcaaggtggcactccgggatagaattaaaatccccttggcctggagacacttgtgggaaaaatttgtggaaggggttgtatttacattgtggggaagtgcgacacacggaaggggagaaattgggaggcccctgtggtacatagggccgcagaaatattagagaaccggccttcatttggaag

SEQ ID NO: 91194 - protein, 273 aa, Zea mays
  misc_feature: Ceres CLONE 1579443
MASLIERATSTTAHGVDPVLLRAIKSSARASDAAIRDAFRLILSLMSKPHSHGRGLAFRIAEELFMGSKLLRSLLADPPLGVPPATTFGVPPKENPLLAAETGGRLPLSPGKGPPGPRRPPRRLGNPILLWGGGKLNTARDFPTLGARDRELPPPKGKYPLPPGRVPRVFPPGGGPGAGGPPPHNMGNVLLRWGQEPLTLEEAASPPLGTGKKKPSLCPGRKRGIWKTQVWAAWKEKPVGASPCSKRYRKEFLRRPTKKCVMKKISPQGGTPG

SEQ ID NO: 91195 - DNA, 826 bp, Zea mays
  misc_feature: Ceres CLONE 1579447
  misc_feature: Encodes the peptide sequence at SEQ ID NO. 91196
ctggagctccccgcggtggcggccgctctagaactagtggatcccccgggctgcaggaattcgtctcacccctagaaaaatcaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatggtcgtcctcatcctcgtcctcttctgcttcaccgtcttcgccttcgtcgtcaccaacaggggcgccgggcgagccgtctccggccgccgatacaaggagtaccgcctcggggaacactccaactgggtggcaaaagcgcgtctagacaccaggaactgggaccggatcagggagcgcctccaagaactcaaagggctggcaaaaccctgcaagaaaaaaaacaaaaccgccccccagtttctggagttccagccctctccccccctcggaggtaaattattaactattctatcgggtcaacggcaaaaaccgtatggttattggaatcccgtatgttcctgccacttccaataaaatacccttccccgcggata

SEQ ID NO: 91196 - protein, 198 aa, Zea mays
  misc_feature: Ceres CLONE 1579447
  misc_feature (5)..(181): Pfam Name: Tetraspannin Pfam Description: Tetraspanin family
MAFRLSNNLIGVLNFVTFLLSVPILGAGIWLGHRADGTECERYLSAPVIALGAFLLAVSLAGLVGACCRVTWLLWAYLLAMVVLILVLFCFTVFAFVVTNRGAGRAVSGRRYKEYRLGEHSNWVAKARLDTRNWDRIRERLQELKGLAKPCKKKNKTAPQFLEFQPSPPLGGKLLTILSGQRQKPYGYWNPVCSCHFQ

SEQ ID NO: 91197 - DNA, 840 bp, Zea mays
  misc_feature: Ceres CLONE 1579449
  misc_feature: Encodes the peptide sequence at SEQ ID NO. 91198
ggagctccccgcggtggcggccgctctagaactagtggatcccccgggctgcaggaattcgtctcacccctagaaaaaaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaggtggtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctgggccagtccggcatcggcgacgagtcgtacatgccgcgctgcgtggtcgagccccacgccagctgcgccaccatgaaagagggcggcgccgaggcgtcacggccatgtttcgcgcgctggacgagctgttcgacaagtggcgcgtccgggccaagaacctggggcctgctgggg

SEQ ID NO: 91198 - protein, 108 aa, Zea mays
  misc_feature: Ceres CLONE 1579449
  misc_feature (1)..(107): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSRPRPVYLIDFACYKPADELKVSKAEFIDLARKSGKFDEDSLAFQSRLLGQSGIGDESYMPRCVVEPHASCATMKEGGAEASRPCFARWTSCSTSGASGPRTWGLLG

SEQ ID NO: 91199 - DNA, 1213 bp, Zea mays
  misc_feature: Ceres CLONE 1579450
  misc_feature: Encodes the peptide sequence at SEQ ID NO. 91200
  misc_feature (55)..(55): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (1157)..(1157): n is a, c, t, g, unknown, or other
aaaaaaaaataccctcctttataaataaaaccgaaccatcaacacacccagaccntttcgcgtgnnnnnccaaactggagctcaccgcggtggcggccgctctacaatagtggatcccccgggctgcaggaattcgtctcacccctagaaaaagagagaagctatgcactgctttcactgttacagtggatgcaaaagagggcacaactactggggtatctgccaaggacagggcaaaaacagtcatgactcttgcatctcctgactctaagcctgaggacctcaaccgccctggtcatattttccctttgaaatacaaagaacggggtgttctgaaaccggctggacacaccgaggcatctgttgaccttgccatgatagctggattacctccagtcgctgtccgttgtgaaattacagatgacgcggggggttgtagggctctcctacgggagtcgcagtgtaaatgttccaccccccccactagaagatgagatctattcgctgaatagatataagaataggaaggaaaacggaaaagactaaatttgaaaaagtgcttattgtgtccaactaatttccctttaggaataggggggtacgagggtccccagtggctttgtatgtcttaaccaaaaatcagatccaaatatgaaagaggaaactttgggagcaataatgtagacccagaacggcagaacacaacagcctgagaggaatttagagttagacactcaggaattaagggcaataacagaagtgcttataggtccacgccgagatgagcgttttacgtcacaaactacccagttcttcaccgtagggagccaacctatccaaaatcatatggacgagacaagatactctgtcgctgatcttcgttatctcgcagactaatagagatccacctgtgttcaatataagaattaggttacacaaaacttctgctctcgtcagagtaagtgagggtattgtcctaccgccgtggctataggaagactgaaatatggatagaccgcacaaacttacttttctaatatttaagagagagggagtatatgacattatgatctcggaaaaatcagcaatagacaggtagaatatcactaggagagagatataaactaggggctatcatatgtagagaaagtaggggntggcagatatgacctctctctgcttgtggaagtgggtggttgtactacgcactaaa

SEQ ID NO: 91200 - protein, 82 aa, Zea mays
  misc_feature: Ceres CLONE 1579450
  misc_feature (1)..(74): Pfam Name: DHBP_synthase Pfam Description: 3,4-dihydroxy-2-butanone 4-phosphate synthase
  misc_feature: SWISSPROT Homolog: EC 4.1.99.12
MTLASPDSKPEDLNRPGHIFPLKYKERGVLKPAGHTEASVDLAMIAGLPPVAVRCEITDDAGGCRALLRESQCKCSTPPTRR

SEQ ID NO: 91201 - DNA, 1008 bp, Zea mays
  misc_feature: Ceres CLONE 1579451
  misc_feature: Translation starting site: 159
  misc_feature: SWISSPROT Homolog: EC 1.4.1.2 Glutamate dehydrogenase
  misc_feature (378)..(378): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctcctcaaccgctgagtgagaagaagagatggccggcaagggcgatggcccggctatcggcatcgatctcggcacgacgtactcttgcgtcggcgtgtggcagcacgaccgcgtcgagatcattgccaacgaccagtgtaaccgcaccacgccctcgtacgtcgccttcaccgactccgagcgcctcatcggagatgcggccaagaaccaggtcgccatgttccccatcaacacccgtcttgatgccnagcgtctcatccgcaggaaggtcagtgatgcgtctgtcccgagtgatatcaagttgtgggcccttcaggtcatttctgggcctggttgaaaaccaatggatgtttgtccaccacaaggttgaggaaaaaccattttcacctaaaaaaaaccccccccattgggtcttaccaaaaagccgggaaattgccgaaacccttccctggggagccaccaacaaaaaaggggggggggccaagccccggccccttttttatggccccccaaggggcgggccccaaaagagtcccgggggggaatttccgggcccttaagagggggggggtataaaaaaaaaaagacaaaaagggggggatttcccccttttgtgttttaaaaaaaagcccccccctgggggggaaaaaaaaccccccccctttttccgggggggggggcccctttttttccccccccccccccccttgagagaatttctttttgggcgcgccccgtgggtgcccacccctggggggggggagggttttcaaaggggggcgccccccctccccttcttaaaagaaaaaaaatacaaaaattttcccccccccctccccgggggagatcttctggagaggaaaaaaataccccccccg

SEQ ID NO: 91202 - DNA, 926 bp, Zea mays
  misc_feature: Ceres CLONE 1579453
  misc_feature: Encodes the peptide sequence at SEQ ID NO. 91203
aggccgctctagaactagtggatcccccgggctgcttgaattcgtctcacccctagaaaaaactcttctgatcttctccatgtgccgcctccgtctcctcctccgccccatctcgcggcctcatctccatccccttccgcctcccatgtgccgcctccgtctcctccttcccttcttcctcctcctccgccccatcccacacgcgtcccaaccggccgccccctctccggcgctgcaatgcgctctcaacttcacggagctgctccccttcctcgcggcgccgctgccgtcggacgacgcctcccgctgcgcggtcggcacgcagttcgtcgactttcttcctctcgctccaactcggggggcacatcggtccttcctgctcccacccgaggccttcctcctggcctgttccccgtttccgggccgcggcttcccctaaccggtttccccggggttgggcctgggggccttctcgggggcctcgaagcccgccccttggccttcccccgggtgtggggggaaaacgtcttcccaccggtcggcccaaaatttcaaaaccgcctccgtcccccgccccaagctcgggggcggggggaaaatccaaacccccgggctggcggataccgggaatcctctctccggcccgttcccctgaaagtggaaaccgacctgggtttcaaacgggggccttagagaaaaggccgccccggcgggccctattctccccggggctgggatcccccgcaagcggccaggaagttaaaaaaacgtccacccgggggggcgctgcaaggtaaccccttcccatcctaaccctgggcgcccgaagagcttagcccggcaagggggccccgccctacccggggcaaccggcccttacgggccctcttttctactccaaggggggaaccccgccttcatgtccc

SEQ ID NO: 91203 - protein, 119 aa, Zea mays
  misc_feature: Ceres CLONE 1579453
MCRLRLLLRPISRPHLHPLPPPMCRLRLLLPFFLLLRPIPHASQPAAPSPALQCALNFTELLPFLAAPLPSDDASRCAVGTQFVDFLPLAPTRGAHRSFLLPPEAFLLACSPFPGRGFP

SEQ ID NO: 91204 - DNA, 888 bp, Zea mays
  misc_feature: Ceres CLONE 1579454
  misc_feature: Encodes the peptide sequence at SEQ ID NO. 91205
  misc_feature (609)..(609): n is a, c, t, g, unknown, or other
aaagctggagctccccgcggtggcggccgctctagaactagtggatcccccgggctgcaggaattcgtctcacccctagaaaaaagagctccacaacagttaccacgcctttcgctttttcttttgtcctccactccacttcccctcttcacgagaggagagagtgcgtgcgaatgcggagttactcggggactggtacgagcggagcaggggtgggcggtgggggaagcgagtggaagattgggagccaagagcacggagagtgccccgggatcttcacctcccatcattcgagtgtggagtttgtcctacttccgggagttgcttcgcttggtggcgcccagaattagcctggaagcagggtggagtgctgtctgcgcaggaatctgctcaccgggtgccaggaaacaggcggctgtagagaattgcttggggattcgtcaagaaactacccagtaggtggttgtgcacttgttatgctgagactgaatggaggctgtagacaagattgctgagcccaaagacccttttgtgctcactgcccagaaggttcagagctcagagccacctatacctataaaggcgtcatgtgaagggaatgactcccancagcaagaagagacgggatttgcagatgatggcgaagagagctttcggagcatgaattcttctgatgaaggtgtccggagcttcttctctggggctagtccccctccagagcctattgacatggatttcatgaagacggtctatgttgcaatcgacgagaagtccgagcccacgggtagtttaatgcgcaggatcttcgtgaaaggggcctttccaaaaagacactctcgaatcctggtttccaggcgccaaggccaattttggggtaagatcccagcc

SEQ ID NO: 91205 - protein, 133 aa, Zea mays
  misc_feature: Ceres CLONE 1579454
  misc_feature (40)..(40): Xaa is any aa, unknown, or other
MEAVDKIAEPKDPFVLTAQKVQSSEPPIPIKASCEGNDSXQQEETGFADDGEESFRSMNSSDEGVRSFFSGASPPPEPIDMDFMKTVYVAIDEKSEPTGSLMRRIFVKGAFPKRHSRILVSRRQGQFWGKIPA

SEQ ID NO: 91206 - DNA, 896 bp, Zea mays
  misc_feature: Ceres CLONE 1579455
  misc_feature: Encodes the peptide sequence at SEQ ID NO. 91207
  misc_feature (792)..(792): n is a, c, t, g, unknown, or other
ctggagctccccgcggtggcggccgctctagaactagtggatcccccgggctgcaggaattcgtctcacccctagaaaaagagttgaaattgggatatataaaatctccaccacctccgaccctcctgtcccgctcctcttctatctgttcgtttacagcccccagctcatcaaagatcacatttttgggcactgctatataaacaaagttggcaggagtcgtagattagcaggccgcccgtctatatttttttttcatgttttgaaagtgaaggaggatttgggtgggcaacgtctacctctgccaaaaataatcggcgtccatatgcaggcgtcgtatctttggaataagtgaatagcaggcagatggcaggcggcggattcgtggaggacatgaacatgatgagggagcagagcctcctcgaggcgacgtgcggcgacctcttcgaccacatcgacgacctcctcgacttccccaacgaggactccgccgccgccgtgctcctcctggacgcgccggcgccggggagcccgctgtcggcgcgcatcatcgacgtcggccgcgccggcaatgcgctcgccccgcctgctgcccccgcgcagcacgacgcttccgctagcgccttcttcgccgccgcggggaacgatgtgttcgacaccaaggacgtcgtcggcgcacacatcggctcgtgcgacgacattgacatggacatggcgcagctggagtggctatcggggctcttcgacgacgcctccatcccgcacgagccggtgttccctggcgcgacggcnggcggcgctgcgtctatcatgaagagctccgcgctggcggccggcgcgctgctgccgccggacaaaatggaagacgcgctgctgttccgcagctccagccccat

SEQ ID NO: 91207 - protein, 176 aa, Zea mays
  misc_feature: Ceres CLONE 1579455
MAGGGFVEDMNMMREQSLLEATCGDLFDHIDDLLDFPNEDSAAAVLLLDAPAPGSPLSARIIDVGRAGNALAPPAAPAQHDASASAFFAAAGNDVFDTKDVVGAHIGSCDDIDMDMAQLEWLSGLFDDASIPHEPVFPGATAGGAASIMKSSALAAGALLPPDKMEDALLFRSSSP

SEQ ID NO: 91208 - DNA, 835 bp, Zea mays
  misc_feature: Ceres CLONE 1579457
  misc_feature: Translation starting site: 193
  misc_feature: SWISSPROT Homolog: EC 1.4.1.2 Glutamate dehydrogenase
  misc_feature (764)..(764): n is a, c, t, g, unknown, or other
  misc_feature (769)..(769): n is a, c, t, g, unknown, or other
  misc_feature (821)..(821): n is a, c, t, g, unknown, or other
  misc_feature (826)..(826): n is a, c, t, g, unknown, or other
tggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctgggggtgattgctggcctcaatgtgctgcgtatcatcaatgagccaaccgctgctgctattgcctatggtcttgacnagaanggcaccagcgtcggtgaagagaatgtcctcatctttgacccctggaggtggntaccntcgatgtcc

SEQ ID NO: 91209 - DNA, 919 bp, Zea mays
  misc_feature: Ceres CLONE 1579460
  misc_feature: Encodes the peptide sequence at SEQ ID NO. 91210
ctggagctccccgcggtggcggccgctctagaactagtggatcccccgggctgcaggaattcgtctcacccctagaaaaacccaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgacaatgtcaaggccaagatccaggacaaggagggcatccctccggaacagcagcggctcatttttgccggcagcagctcgaggacgggcgcacgctggccgactacacattcagaagagagcccctccacttggtgctgcgtctcagggtgggatgcagatcttcgtgaagaccttactggcaaacaatccccctggaagtggagtctcgggacacatcgacatgtcaaggta

SEQ ID NO: 91210 - protein, 253 aa, Zea mays
  misc_feature: Ceres CLONE 1579460
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (158)..(227): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPEQQRLIFAGSSSRTGARWPTTHSEESPSTWCCVSGWDADLREDLTGKQSPWKWSLGTHRHVKV

SEQ ID NO: 91211 - DNA, 1211 bp, Zea mays
  misc_feature: Ceres CLONE 1579464
  misc_feature: Encodes the peptide sequence at SEQ ID NO. 91212
  misc_feature (17)..(17): n is a, c, t, g, unknown, or other
  misc_feature (18)..(18): n is a, c, t, g, unknown, or other
  misc_feature (39)..(39): n is a, c, t, g, unknown, or other
  misc_feature (44)..(44): n is a, c, t, g, unknown, or other
  misc_feature (97)..(97): n is a, c, t, g, unknown, or other
tttttttcctttccccnnccccgccgtttccccccccgnttacntgcgtgtgttattttctttaattttagataataataaaagctggggctccccncggtggcggccgctctagaactagtggatcccccgggctgcaggaattcgtctcacccctagaaaaactctcgaaaccctagtcctctgttacttctccagccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccccacttttgattgccaagcgttctcatttggcaggaggttttagtgaaggcctcctgtcccacaggttgatatctaagcttgatggccacctttccaaggttcatttccctgggccccccgtggaggaaagcccacaaatgacaaacgttggttccacaccacccaaggggggaagggtaagcaaaacccagtttttggccaaccccctaaaaaaagaaaactcttcccttgcccaaagtggggtttctcttccaagttctcttaataaaagtaccagtcgtggtaaagaaaaatatcctccctctgtaaaaaaccctctttaaaaacccccttttgtggtccctcggggtcctgcgcgcgatatcccaagaggataaacggaggccctggttttagggggacccacacgacgcggtgttcccccctatgtgtcgccccttatagacttttctcaaaaacgacacaatttcataaataagaaagaggcatggggttccgcacctgacaaatggataactgcctctcggggaggggtagaaaaattgtgacctgggtgccccctccaaaaagtgagggtcgctgccgcctcaactctatcgtaccatatgggaagccacaaaatacccccaactgctacgtccttaattgtgcccatatcggggtgtatccggataacaacacaaagaggcgaaactccagcgtatcggcgtgaattaaacaaaaact

SEQ ID NO: 91212 - protein, 176 aa, Zea mays
  misc_feature: Ceres CLONE 1579464
MAGKGDGPAIGIDLGTTYSCVGVWQHDRVEIIANDQGNRTTPSYVAFTDSERLIGDAAKNQVAMNPINTPLLIAKRSHLAGGFSEGLLSHRLISKLDGHLSKVHFPGPPVEESPQMTNVGSTPPKGGRVSKTQFLANPLKKENSSLAQSGVSLPSSLNKSTSRGKEKYPPSVKNPL

SEQ ID NO: 91213 - DNA, 1189 bp, Zea mays
  misc_feature: Ceres CLONE 1579470
  misc_feature: Encodes the peptide sequence at SEQ ID NO. 91214
  misc_feature (10)..(10): n is a, c, t, g, unknown, or other
  misc_feature (13)..(13): n is a, c, t, g, unknown, or other
  misc_feature (14)..(14): n is a, c, t, g, unknown, or other
  misc_feature (71)..(71): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (81)..(81): n is a, c, t, g, unknown, or other
  misc_feature (82)..(82): n is a, c, t, g, unknown, or other
  misc_feature (101)..(101): n is a, c, t, g, unknown, or other
  misc_feature (456)..(456): n is a, c, t, g, unknown, or other
tttgggggtnttnnttgggggggggtgtgtttctcgctttttttttttttttttttggtttttcaaaaaanccnnnnnntnntcaaaactggaactccccncggtggcggccgctctagaactagtggatcccccgggctgcaggaattcgtctcacccctagaaaaaagagcggttggcgcttcatcactcgtttcctttcgaaagcccgcgcacacacgtcggtcgtcccgagcaggacctcgatcggccgagatggcgacgccgaacgggcttgcgcggatccagacgaccgggaagaagaagcaggactacggcgtgcggtacgacgacggctcggcgccggtgcgcgcacagaccatcgacgagctgcactcgctgcagcggaagcggtcggcgcctagcacgcccaagcggtcggcgcccaccaggcccatcaagggaggcgattactcncccttcgccctcaccatctcctaggaggaggggcacactcagcacatgcagtccatcaaatgcgtctgatggcgtctcatgacacgtgaaaaacctggcctaaaagtgggtcaaggtgcggaccacggccggcgaaagggtaggaggcgagatcgccgccaagagaggcggacaatccgacgcccggaggggccgccacccaggcatggaaaactgagcgacctcgcggcccggaccccaccgatccgattcggcgccggtccagggccgaaggaagggcttccccacatacaaagagtttacaaacattccaattgagtgtgacttattataatacaaaaaacccattcgcgttgtggaccatatggcccttgtaagacacttgttgtatatctaaaagtcaaagtgagcgccgactcctatacgtgaaacctcatatcaaaaggggggtggttcccgcgttttccgattgccaaactgtggcgacttcccgtgggtctccacgctcttgtggcgtaaaataaccttttattctctgtagaggtgccctaatatgaacccgcgggacggggttgccctccgccccatgggggggaaacaaagggcgccgcggcgcccattctcaagggggtttaataaaagaggcccacccccctcctcacaagggtaaaacctttttttaagtatggggggcaccaagaaggggcttttacgcccccaaaaataatttata

SEQ ID NO: 91214 - protein, 74 aa, Zea mays
  misc_feature: Ceres CLONE 1579470
  misc_feature: SWISSPROT Homolog: EC 4.1.1.49 Phosphoenolpyruvate carboxykinase (ATP)
MATPNGLARIQTTGKKKQDYGVRYDDGSAPVRAQTIDELHSLQRKRSAPSTPKRSAPTRPIKGGDYSPFALTIS

SEQ ID NO: 91215 - DNA, 799 bp, Zea mays
  misc_feature: Ceres CLONE 1579475
  misc_feature: Translation starting site: 130
  misc_feature: SWISSPROT Homolog: EC 3.2.1.21 Beta-glucosidase
  misc_feature (589)..(589): n is a, c, t, g, unknown, or other
ctggagctccccgcggtggcggccgctctagaactagtggatcccccgggctgcaggaattcgtctcacccctagaaaaaattctctactcaaggcgctctttactctagctagctagcaaggggggaaatgggtccacttctcgccacattgatgatccacggtggccatccggtccgtagaactcttctgggaccctacaatgagagtttgtctggacgacacctatcttcttcaccggaaagcagtaagcgaaggtttaaactattctttactccacaatctgtcagactacgccatcaaaatggagtccaattgctgagcccttcagatatccctccaacggactgggtcgcctccaagttcatgtttggtgtcctgacttgagcgtaccatcattgtaagtgcttggaaccaacatggatagggggaaagcaattgggatcacgtcggcctcaattgtcctcgataggatgatggagcggagcaatgcacacattggagcgaattcgtaggatatgtacaaaactgatgtgagattgctgaaggaaatgggcatggacgcatagtggttctctatctcttggangagaatactgcctaggggaaccgtctaacgaggtatgaaccatgatggcatcgattactacagaaggctcatcaacttgttgctagagaatgggataaagccgtatgtaacaattctcctgcagtctcaactcaagagacgcgtctgtaatcaagatagtcactcgaggtatgagaattatgcatttctacgtcaatagtagcagacgat

SEQ ID NO: 91216 - DNA, 973 bp, Zea mays
  misc_feature: Ceres CLONE 1579478
  misc_feature: Encodes the peptide sequence at SEQ ID NO. 91217
  misc_feature (915)..(915): n is a, c, t, g, unknown, or other
  misc_feature (954)..(954): n is a, c, t, g, unknown, or other
ggagctccccgcggtggcggccgctctagaactagtggatcccccgggctgcaggaattcgtctcacccctagaaaaagtgggcgttggaatcttgacgggggctgctcctagtacgagaggaccggattggacgtaccgctggtgtacctgttgtctcgccagaggcatcgcagggtagctatgtacggaagagataaccgctgaaagcatctaagcgggaaacttgcctgaagatgaggattccctggagacttgatctccctgaagggtcgttcgagaccaggacgttgataggctgggtgtggaagcgcagtagacttgtgcgccatcacacacaagacacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattcgtaagctggtgaaggatggattcataattaagaagccacagaaaatccactcaaggtcccgggcaaggagggcccatgaggccaagcagaaggggaggcactctggttacggtaagcgcaggggtcccagggaggctaggctccccaccaagatcctttggatgcgcatgatgcgtgtcctcatgcgtctgctgcgcaagtatcgtgaagcatagaatatcgacaaacacatgtaccacgatatgtatatgaaagtaaaagggaaacatgtttaaaataagagggtactcatggagagcatccacaagtcaaaggccgagtatgccagagagaagactctctcggatcagtttgaggccagcgagccaggagcaggcttcccgtgagagaaagatgcaggnaggaagagagattggctcaaggccctgggtaactgcggnagcacagtttcagctactg

SEQ ID NO: 91217 - protein, 112 aa, Zea mays
  misc_feature: Ceres CLONE 1579478
  misc_feature (2)..(113): Pfam Name: Ribosomal_L19e Pfam Description: Ribosomal protein L19e
MVSLKPQKRLAAGVLKCGKGKVWLDPNEVYEISMANSRQNIRKLVKDGFIIKKPQKIHSRSRARRAHEAKQKGRHSGYGKRRGPREARLPTKILWMRMMRVLMRLLRKYREA

SEQ ID NO: 91218 - DNA, 1224 bp, Zea mays
  misc_feature: Ceres CLONE 1579480
  misc_feature: Encodes the peptide sequence at SEQ ID NO. 91219
  misc_feature (26)..(26): n is a, c, t, g, unknown, or other
  misc_feature (71)..(71): n is a, c, t, g, unknown, or other
  misc_feature (72)..(72): n is a, c, t, g, unknown, or other
gggtgtggtttggggggggggggcanttggggataagcaccaatttaatgaccccccccgcgaaaaggaanngaaaactggaactccccgcggtggcggccgctctagaatagtggatcccccgggctgcaggaattcgtctcacccctagaaaaaacctcaggttactggcagaaaagatttattagctcgccgcgggggtcgaaccgagactcctagctagctgatcgggcgcgcacaaggggagcggacaagaaagcttgctttgtgctcaccggcgggcggtggtacggaccccctgcgatggaagccgacggcgtcactcctgcccccgtggcggcgccggagaagaagaagctgcttgacctcaaggaccccttccccgccgccgcgaacggcggcaccaaggcgtccccggcgagtaagtgggcgatgaagaagaagctggtgggcggcgacaccggctacgtgctccaccacataccgcacctcatggattacatgccccagctcccgacattacccaaatcctcctccaaagaacaacccggcgtatttcagtcgcccaagcaattattttcggtcgaacccagaacaaacacccgtcaccgacaaaaagaattggtttgcttccattaagaaccaaggtggcccagagggggtcacctcaactttttccgggcgattggtttgggggtccccctggggacaagccggcgggtggtaaatttttccccaagttcccgcggaatcgagagggtgggtaaaaactggcgcggtctcaaattttgtgttcctcacccccctatcctcggagaatagtgaccacctcttccttatgctccccgcgaggggaagatttttgtaaaacgagacggtgtgtataaaatatcctccaccaaaaagactatttagggtttttgggggacggggcgccttgggctaagcaggaaataaaaggttatactggggcggggattttcccttcagaccgcgtgttcctttcggcgttattttgataaggggggtgggtattatccaaagggggggttttcccctgattatcccagaacaaacatgagtgcgtctttcccgcttttagcatcccaaatacaccagatggtgaaccgcaacccatgcccataataaataaaaaggctgggagaaatttatcctctggaaaaacctctcgaaaaggaggaggcatttttccctcttctaata

SEQ ID NO: 91219 - protein, 111 aa, Zea mays
  misc_feature: Ceres CLONE 1579480
MEADGVTPAPVAAPEKKKLLDLKDPFPAAANGGTKASPASKWAMKKKLVGGDTGYVLHHIPHLMDYMPQLPTLPKSSSKEQPGVFQSPKQLFSVEPRTNTRHRQKELVCFH

SEQ ID NO: 91220 - DNA, 984 bp, Zea mays
  misc_feature: Ceres CLONE 1579482
  misc_feature: Translation starting site: 880
acccgcggtggcggccgctctagaactagtggatcccccgggctgcaggaattcgtctcacccctagaaaaaaccaccaccttccattcccagtcgcaccaccacgtgtataaggatcgccatggcgtcctccagagcggactcgccgctcacctgccaccacctcggcagcgttggtgcccgccctcgcctcccgtccatctacatctccctccgccgccgctcgtcctcttcatctaagcccacctccctttcccactccctcccctccaagcactcgctggccccaccccccgccgcatccgcatcctcccgtcgcggtctcacccccgtacacgcctccgcctgcgccgccgcggctccagcgccagatccagtgccggttccagcaccggctccagcgccggctccagcaccgaccgccccaccgaagaagcccgcgctgcagggcgcggccatcaagccgctcctggcctccatcgcgactggcgtcctcatctggctcatcccgccccccgccggcgtgaaccgtaacgcgtggcagctcctagccatcttcctctccaccatcgtcggcatcatctcccagccgcagcacctcggcgcggtcacactcctcggtctcggcggctccgtgctcagccgcacgatcacgttcgccgcggccttctcggccttcggcgacccgatcccctggatcatcgggctcgccttcatcttcgccagggggatcatttagaccggtctcggggtcccgcgtcgccatacacgtcgtcgccggccttcggggttctcctcgcgcagcctcggattaactccccgtcttgggcataagcgatccccggcccccgccatttccctcggttcttggaacccggcatggaagatacttctaaccgcttggtaaagaccttctgggaaaggaaagcggttcccccaccccggggatgtaaccggaaccccggtctcggaacactggcctat

SEQ ID NO: 91221 - DNA, 841 bp, Zea mays
  misc_feature: Ceres CLONE 1579484
  misc_feature: Pfam Name: PAP_central Pfam Description: Poly(A) polymerase central domain
  misc_feature: SWISSPROT Homolog: EC 2.7.7.19 Polynucleotide adenylyltransferase
tccccgcggtggcggccgctctagaactagtggatcccccgggctgcaggaattcgtctcacccctagaaaaaattcaagttccatggaatatctattgaccttctttatgccagtgtctccctcttagtagtaccagctgacttggatatctcccaaggatcagtgctttatgatgttgatgaagctactgtccgtagtcttaatgggtgcagagtagcagaccaaatcattagacttgttccaaattttgagaattttcgcacggcattaagatgtttgaagtactgggcaaaaaggagaggtgtttactctaatgttactggctttcttggtggtgtcaactgggctttactggttgcgcgtgtctgccagctctatcccaatgctgtgccaagtatgctggtctcacggttttttagagtttttacacaatggcagtggccaaacccggttatgctttgttctatagaagaggaagaacttggtttccctgtttgggatccacgcaaaaatcctcgagatagatgtcatcatatgcctattataacccctgcgtacccatgcatgaattcaagctataatgtttccacaagcacactgagggttatgttggaacaattccagtttggtaatagaaattgccaggaaattgaaatgaataagaccagctggcctgctctgtttgagccttttcaattttttgaagcatacaagaattatctaacggttgaacatcattgcctgaggatgatgaacaaccttagcgcttttggaaagggaggggttggaatctccgattggcggcaacttaacttttgaaagattggaaccgtgataca

SEQ ID NO: 91222 - DNA, 829 bp, Zea mays
  misc_feature: Ceres CLONE 1579489
  misc_feature: Encodes the peptide sequence at SEQ ID NO. 91223
  misc_feature (572)..(572): n is a, c, t, g, unknown, or other
  misc_feature (784)..(784): n is a, c, t, g, unknown, or other
  misc_feature (786)..(786): n is a, c, t, g, unknown, or other
gcggtggcggccgctctagaactagtggatcccccgggctgcaggaattcgtctcacccctagaaaaagggccctggcccctgtgctctccttgccaccgaacgagagccaaaagcctcccgccccacgacgcgcccgccccggcggcgacgccccggaggacgtttcccgcagcgaccgacgaccaagccttgatcgcctccgccccatggctacccgggcgcgggcgtagccgtcgcctcggccgcagcaggctcggtccgcccctttcggcgatttctgttccagtcgcatcgcgcgacagctcgtcgtccgattccgatccccgccaccgcggcggaacgaggcgtctccggtccccgagggtattcggggaatttgagactgatacgtcgggatcctgtcgataatgcggggctacgagtacgagaccaatggttaccaccaggaagtggaagatgagtacggagatgagtactatgatcaagatgagtatgaggaggaaggttcgggtgctggggatgggtatgctgaggatgaagagcctacagagggacaaaaggagatccttngattgagagaacgattaatagagcagattaggcgaaaggcaaaggctgctgctgcctgcacatctggccgatcatcttcttcacaaatacctcaagccagggacaaatttggctctttctttggggcatccaagccggtgatttctcgtcgagtgatagaagaaagaaatcattgaaagaactgcatagcacggttgcaagggagcataggncntctggagtacataaggatattcatcgtccctctaagggcaaag

SEQ ID NO: 91223 - protein, 112 aa, Zea mays
  misc_feature: Ceres CLONE 1579489
  misc_feature (55)..(55): Xaa is any aa, unknown, or other
MRGYEYETNGYHQEVEDEYGDEYYDQDEYEEEGSGAGDGYAEDEEPTEGQKEILXLRERLIEQIRRKAKAAAACTSGRSSSSQIPQARDKFGSFFGASKPVISRRVIEERNH

SEQ ID NO: 91224 - DNA, 1057 bp, Zea mays
  misc_feature: Ceres CLONE 1579491
  misc_feature: Encodes the peptide sequence at SEQ ID NO. 91225
  misc_feature (85)..(85): n is a, c, t, g, unknown, or other
ggggggggggctaaaataataaaaaaaactaaaaagaaaggcccgttgccctccccagagaaaattttaaaactgggactccccncggtggcggccgctctagaatagtggatcccccgggctgcaggaattcgtctcacccctagaaaaaaaaataagccctcccaaaccccttccatttcccgtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccagtggacaaccccactggttcctgctaatggagatgaacaaattggtttttgacaccaaactaccaccttaattggcccccgaaattggggccccaaaacaccaaagtttctccctatggcattcttcaccaagggcttgtttaaccgaaatataaaggaaggcctaaagggcggctccgggtgggttggaatacccgctgagcccagttaacttttttttggaaccccagatccctccctaaccctgttatggttccttcaaaagacccggtccccaaggggtggtgggaaaaaaaaggggaatatccctctttttctttttccccctttcttaaagaaaggcaattcttttcgccaagtctaaaaagagagagggggcacaattgcgctgaaatattaaaaaaggcaaacctggggggcatttctaatgggaaatttacgcttttgtgaagtgaagccccaacctctctgtggtaccccccccaccccttttatatttcatgagcaaa

SEQ ID NO: 91225 - protein, 121 aa, Zea mays
  misc_feature: Ceres CLONE 1579491
  misc_feature (2)..(120): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMASGQPHWFLLMEMNKLVFDTKLPP

SEQ ID NO: 91226 - DNA, 801 bp, Zea mays
  misc_feature: Ceres CLONE 1579492
  misc_feature: Encodes the peptide sequence at SEQ ID NO. 91227
  misc_feature (254)..(254): n is a, c, t, g, unknown, or other
  misc_feature (255)..(255): n is a, c, t, g, unknown, or other
  misc_feature (259)..(259): n is a, c, t, g, unknown, or other
  misc_feature (264)..(264): n is a, c, t, g, unknown, or other
  misc_feature (268)..(268): n is a, c, t, g, unknown, or other
  misc_feature (457)..(457): n is a, c, t, g, unknown, or other
  misc_feature (466)..(466): n is a, c, t, g, unknown, or other
  misc_feature (467)..(467): n is a, c, t, g, unknown, or other
  misc_feature (494)..(494): n is a, c, t, g, unknown, or other
ggagctccccgcggtggcggccgctctagaactagtggatcccccgggctgcaggaattcgtctcacccctagaaaaagaacggttatatccccattttgttgaacataacaaaaattcattttctgcatcagccaagaaagataaggggaaaggcaaattgcccgttggagattctggatgcagcatgaggtcaccgttgttagattgtaacctgtgtggagctacagtcaggatgcgggactttagacctgnntatntatanttcncttctcgtttcagtccaaataacattgttgtgcctggaacaggcagaaagctaacactgacacatggagttagtgctgccagtggtatcaatgagtgggttactgatggggtgggaaagaagtcaaagaatgaagggggcgtggatgaagcagcaacataatgaggggaaaccactatcacttgttggnagtagaccnntaacctaacaatggctgggagattacngtcacctcaatctgccatgcctgctatgtcagaccgggttaataatggaggattgggaaggggaccgaataattgaaccccctacaggcaaggaaattaggggattgggaaaacccctattgaatcccggggcccaattcaaagaaaccgtacccttggagaaagggggaaaccacgttaaaatccccaaaaaaggggcccccaccgtgataaaaaaaaaaaaaaaattctttctccccggggggggagaaaaattttttattatccccccaaaattttaattttccccaaaataaaaaacccgggg

SEQ ID NO: 91227 - protein, 142 aa, Zea mays
  misc_feature: Ceres CLONE 1579492
  misc_feature (85)..(85): Xaa is any aa, unknown, or other
  misc_feature (87)..(87): Xaa is any aa, unknown, or other
  misc_feature (88)..(88): Xaa is any aa, unknown, or other
  misc_feature (90)..(90): Xaa is any aa, unknown, or other
GAPRGGGRSRTSGSPGLQEFVSPLEKERLYPHFVEHNKNSFSASAKKDKGKGKLPVGDSGCSMRSPLLDCNLCGATVRMRDFRPXYXXFXSRFSPNNIVVPGTGRKLTLTHGVSAASGINEWVTDGVGKKSKNEGGVDEAAT

SEQ ID NO: 91228 - DNA, 944 bp, Zea mays
  misc_feature: Ceres CLONE 1579495
  misc_feature: Encodes the peptide sequence at SEQ ID NO. 91229
gagctccccgcggtggcggccgctctagaactagtggatcccccgggctgcaggaattcgtctcacccctagaaaaaaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaagctcctcattaatggcaactttgttgattccgcatccggcaagacctttcccaactctgggaccctcgtacagggggaggtgattggctcatgtggcttgagggtgaccgcagaggaactttaacccgtgcagtaagctggcggctcgcaagggctttttgaatgaagggccatgggcccaaaaaagaactggcctaatggaaaggggtccccgtatccccaaccgggggggttgcgcggatttttgaaaagaaaagccccaatggaccaagcttggcctgccttttgggaaaacatggggaaacaccgggtaaagcctcttttgggcccaacccggcccccaaaattggaaaggtccccccggggggggggccccggtttttaagggcgttaactatagtcccggggttgggggctatgaaataaaaacccccacggggcgcctccatttgtggccccgccgcttaaatagggccccaccccacccccgtgttacagaaaatc

SEQ ID NO: 91229 - protein, 110 aa, Zea mays
  misc_feature: Ceres CLONE 1579495
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGNFVDSASGKTFPNSGTLVQGEVIGSCGLRVTAEEL

SEQ ID NO: 91230 - DNA, 1195 bp, Zea mays
  misc_feature: Ceres CLONE 1579499
  misc_feature: Encodes the peptide sequence at SEQ ID NO. 91231
  misc_feature (1)..(1): n is a, c, t, g, unknown, or other
  misc_feature (24)..(24): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (1056)..(1056): n is a, c, t, g, unknown, or other
  misc_feature (1195)..(1195): n is a, c, t, g, unknown, or other
ncccccgccccgccagcgtcaacntcctacacctgacaccacacccacttttattaattaagtcgctctctcnnnanaacctgaactccccgcggtggcggccgctctagaactagtggatcccccgggctgcaggaattcgtctcacccctagaaaaacttctcttcctcctcgtttcgtcctgcacagcgcacgcaactgccaccggccaccgcgcaaactccatcgcgcgcagatcaagacggccacacccaccaccagcgcttcagtgggagacgtgacgactgacgagacgaagcctctccccacgcccctctccacatggcctgggcccgccttgcctcccgctcccgtttgcgccccgcggcctccgccgccggccgatcccaacacgcctcaccaccggctccgcctccgtccccacctaccacacgcacggtacctgcggccacctccgcgccatcgctccggcgtctccccctgcttccgcggcacctggtttgctgacgccacgcccctcagcatcgacccgcgtgggctgctcgggtgcccgcttgggcgccagtgggcacgggcagggagggggcttttgccaagcggccgccctcccccgggcgaaaggccaaaaccccggggggggaagggcgtcctgaaaacctgggttgggaatggttggccaccttgggccgccaaaaactttgggggaaaggggctattctccccaaaaagtgggccgaagcctttttcgttacccgctaggggtttcttgctcccccccacaaaagggggggtggaccacaccaaagttctggagaatgtaaaaaatttctgtagagaccacacacatacttttttggaaaaaagcacacccacgatctggggtatcaactaatcccacagcctctttttgtggagaattcataaccacagatgtcgtctcttctacaagggtgggtaaaaaaggactctcttaaagtaaattccccccttttggtgcgccccccgaggtgcggacctacattttgggaaaggggttgtggaaagaaaaaaacttnttatcccgtcacaaaactatgtatttttttgggggggaaacacacgtcaaacattttgttttctccgccccaaaactatacaaagaatttcccacttctcccaactggggacaaaatctcccttgggggaaggacagan

SEQ ID NO: 91231 - protein, 50 aa, Zea mays
  misc_feature: Ceres CLONE 1579499
MVGHLGPPKTLGERGYSPQKVGRSLFRYPLGVSCSPPQKGGWTTPKFWRM

SEQ ID NO: 91232 - DNA, 1327 bp, Zea mays
  misc_feature: Ceres CLONE 1579502
  misc_feature: Encodes the peptide sequence at SEQ ID NO. 91233
  misc_feature (20)..(20): n is a, c, t, g, unknown, or other
  misc_feature (24)..(24): n is a, c, t, g, unknown, or other
  misc_feature (25)..(25): n is a, c, t, g, unknown, or other
  misc_feature (984)..(984): n is a, c, t, g, unknown, or other
  misc_feature (1163)..(1163): n is a, c, t, g, unknown, or other
  misc_feature (1183)..(1183): n is a, c, t, g, unknown, or other
ccggccgccccgttagaagncccnngcccctccttttaactcaacctcaatctaaaatatacaggatgattaaccggaactccccaccgtggcagccgctttatactagtggatcccccaggctgcttgaattcgtctcacccctagaaaaaacaaattcaggcattccttgagaaggagaagcaaaaaaaagaccgaaaggggggattccatcaaggacatagacggacgttaaagagcttcaagatgttgagacattccgacaatgcttaattgatgaggatttgctgccaccacagcccgatgattatcacatgatgttaaggttcctaaaagcccggaaatttgaacttgagaaagctaaaagtatgtggtcagacatgatcaattggaggaaggaattccgagtccacaaaatacaggaaatttgaactcacccagttatatgaagtgaaccagactatttccccccaatttgcacccccccccttataataaatagggaagatcctgactacattagaattaagaatgaaaaatttgaatgcaaaacaagcttattacacggtgaacaaccccctaaattcgggaatgtgtaaaaatacccattggttcaaaaaaaaatttgtaaaacagagccccttcctcaaaattaaaaattttttcccaaattttaccacccccatttgcccgtggcccaaaaaagaaggcccccgtggttgagattctcccttccccaccttataaccaaatttatgtgggagaaatattcatccaccaacggccagccgtgagcgcctttgatcttcgttcagcaacgcgcattatatcttttatcatgatggcgcccacaagaaacaataactatttgtggatatgcttctttactagagcacctagataagaaaaaaccgcacgcacgcctatcctatcttaaacctttcgtaatagtattgtactaaacgcacagacatatgagtgatntatcctcttatagactctcaatataaacagcgtataacacaatacacaaggcagtgatttctatacgacataaaaacttcctcttaccactcaaaagataattttcgcctgacgacaaaccacactaccaccacccaaattcacactactctacaacaagaatatactcactgcgcgantatctgaaataaaatctctnttttttgataccgcacaccctttacagcgaggtctaccctttaataaaatgtcatgagcgcgggccttgtagcgcccactcacaaacacttatgcggtacacaaatcacaaacatacctaagggattgttatataacaaaaaaa

SEQ ID NO: 91233 - protein, 38 aa, Zea mays
  misc_feature: Ceres CLONE 1579502
MMLRFLKARKFELEKAKSMWSDMINWRKEFRVHKIQEI

SEQ ID NO: 91234 - DNA, 950 bp, Zea mays
  misc_feature: Ceres CLONE 1579504
tggagctccccgcggtggcggccgctctagaatagtggatcccccgggctgcaggaattcgtctcacccctagaaaaagcccaaaacaacccaatccggaaccccaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccaggggcctcctccgccaccatgctcgacattgtgctcccgcaacgcgctacctcatcaacgcggctccgcctctaaaacgacgcccttctccccggaaaaacccatcccggttttccttcaacaattaaaaatgtctggtttaactctggctcaaacgccccgcttaccgaatcgagaaagccttattcccccaaccgccccccaagcggggctttgaaaattttttccaagaaaggaaggcccaaaggggttccaccccaaaaaagggcccccctccaccggggttgggggggccttggcgcggggcgaaacccgggaaaacccgggaagggggcttttctcccatattcccccccaaattggcccctttgggggaaaaaccccggggaggcgtttataaaaaataaaagggggcgccccctctctttgtttcccttttggtgtgtgtccccaaaaaaaacccctaaggggggccccaaaaaaagggtggggggaggggccttctcgtgtggacccacttctcctgggtggggtttttttcgcctcccacgaaaataacctccaccagtctttctccgaacattggtct

SEQ ID NO: 91235 - DNA, 917 bp, Zea mays
  misc_feature: Ceres CLONE 1579505
  misc_feature: Encodes the peptide sequence at SEQ ID NO. 91236
ctccccgcggtggcggccgctctagaactagtggatcccccgggctgcaggaattcgtctcacccctagaaaaagactcgccgccaattaccattcgcctctgcagacccgacacggcgcgcggctcctcgccgatttgttcccggcggctcatcagaaaggctgtctccttggggggatcgattactcgcgtggctcgcagttcgcacgatactcgggggttctgacttggttctaaacagcatctgcatcttctcgaccccccaggctttggatctggccttcgtctcagttcagcgagccgcgaagaacagccttgatttggtgccccaagcgatgtagtgtgagaggctaacttcttgagagcgcgatgagcagccagggattcggtgcggggagccccaagtccttccgctaccccagaggcggcgacttcgatctcgagtccgggtccccacgcaagggccgcaagcccaagaaccctcacctcgagacctcgatcgtcatgaggatccgctacttctacgaggcgcaccccgtggccgtcgccctcatcctcctctccttcgggctcagcgtgctcatcctcctctccgtgtacgagacccggttcaggacgatgaggagcgtcagtgcgtggtccagtgacggtggggattatccattgccaatgctcccggaccttggcctggtggctggggcattcaatctttaccaggctcaaaatgcgggggagacccgagagtgagaaattcttggttctttggaacccttacccaaagcacgctgggaaagggcgggcccaccttcctggcttccatcaaaggaaggggggtgggggaatcccccccaagagaatagagggggggcccctcgtggttttttccaccggccggggagaacccaggtaaagatgt

SEQ ID NO: 91236 - protein, 125 aa, Zea mays
  misc_feature: Ceres CLONE 1579505
MSSQGFGAGSPKSFRYPRGGDFDLESGSPRKGRKPKNPHLETSIVMRIRYFYEAHPVAVALILLSFGLSVLILLSVYETRFRTMRSVSAWSSDGGDYPLPMLPDLGLVAGAFNLYQAQNAGETRE

SEQ ID NO: 91237 - DNA, 796 bp, Zea mays
  misc_feature: Ceres CLONE 1579506
  misc_feature: Encodes the peptide sequence at SEQ ID NO. 91238
ctccccgcggtggcggccgctctagaactagtggatcccccgggctgcaggaattcgtctcacccctagaaaaaatcagttttctcatctcagctcagctagctttcccctcccttgcaactgcaagcttgcccaacccaataagctaagcaagcacgcaccatacacactctctagtagctagctaagctagccggccgcccctcctcgcacgcgtgcgcgcaccagcatctatcatcagagctagccacgaaacggatcggagcagcagatctcgatcggcggtccacatgggggatcacgctgagatgttgcatgccgctccgggcatgtacaacggcgctggcgctgccgctcatggcgggtggtcgaatacggcggagtccgcgacgacgtgctcgacgacggagctggctgggttcaccacgtgggcggtccgccctggggtggtagctaccaccttggaggccaaggggaacaaaggccaagagcccccgccgcctcttcggagtccccccggaaaaaaaactttcggggaaccttccaaaaaccggggcggggtaaaggaatcctccccgggggtcggaaacccccccgggggggaaaggtggaaacccccccttttggcccccggtttttccccccaagggggaaaacactcccttttttaaaaccaggggggcgcccaacaaactttgggaggggggtttttcccccaaaaagggggccccccccccggggggaggtgagggtcctggacaaatttgggaaaaaagaacctccccgaaaacacccc

SEQ ID NO: 91238 - protein, 126 aa, Zea mays
  misc_feature: Ceres CLONE 1579506
MGDHAEMLHAAPGMYNGAGAAAHGGWSNTAESATTCSTTELAGFTTWAVRPGVVATTLEAKGNKGQEPPPPLRSPPGKKTFGEPSKNRGGVKESSPGVGNPPGGERWKPPLLAPGFSPQGGKHSLF

SEQ ID NO: 91239 - DNA, 894 bp, Zea mays
  misc_feature: Ceres CLONE 1579510
  misc_feature: Encodes the peptide sequence at SEQ ID NO. 91240
ctggagctccccgcggtggcggccgctctagaactagtggatcccccgggctgcaggaattcgtctcacacccaggacaactatatcaccaactcttgtgcttgctaacatgtatcagcgccctgatatgataacccctggagttgatgctcaaggccaacctattgaccctgagaagatgcaggagcattttgaggacttctatgaggacatctatgaggagttggggaagtttggtgagattgagaatctgaatgtttgtgataaccttgctgaccacatgattgggaatgtctatgtccagttcagggaggaagagcaagcagccgcagcatacaacgctcttcaggggcgcttttactctggccgccctataattgttgagtattctcctgccaccgacttccgtgaagcaacctgtacgcagtttgaggagaacagctgcaaccgtggtggctactgtaattttcatgcatgtgaagcaaattggcagggatctcacgaagaagctgtatgggcgttctgcttccaggaggtaccatgggagaagccgaaacctaaacccgtcaccccaaaggaggggccaccgtgaaccggatgaacaccaccaccggaaccggaataactacccttgttggcggccggtggtgaaaagggaaaaaggaaccgggtattaacaggtacaataacgaaacccggcaaaagtgggcaagcattcccagtttttaaaaaatggaacaaggcgaaaagccgccaaaacttgacagggtttttaatatggaagaaaaaggccacagctttggttaccccccctcaaggggtggcaaaagggaccccccatccccggggaaaaacccctcagggaaaccacagagggccacaaatttataaccc

SEQ ID NO: 91240 - protein, 160 aa, Zea mays
  misc_feature: Ceres CLONE 1579510
  misc_feature: SWISSPROT Homolog: EC 2.7.11.1 Non-specific serine/threonine protein kinase
MYQRPDMITPGVDAQGQPIDPEKMQEHFEDFYEDIYEELGKFGEIENLNVCDNLADHMIGNVYVQFREEEQAAAAYNALQGRFYSGRPIIVEYSPATDFREATCTQFEENSCNRGGYCNFHACEANWQGSHEEAVWAFCFQEVPWEKPKPKPVTPKEGPP

SEQ ID NO: 91241 - DNA, 1280 bp, Zea mays
  misc_feature: Ceres CLONE 1579511
  misc_feature: Encodes the peptide sequence at SEQ ID NO. 91242
  misc_feature (74)..(74): n is a, c, t, g, unknown, or other
  misc_feature (922)..(922): n is a, c, t, g, unknown, or other
ttgtgtcgtcctctccccctccccccacaaaaaataaaaaaaaacaaaaaactaaacaaaaacataaaaaaaanccctaaaaactaatacttaacctcagaggctgccgtcttccaaacagtggatcccccgggctgcttgtattcgtctcacccctagaaaaaaggggtactcgaataatagccgcaaaaccctaaccttggcaccgtataaacgagccaacctgtccaccccgcgccgccgccactccgccgctcttctccgcttccaagatgtcaaaccgaggacgtggaggttctgctggtaacaagttccagatgtcactgggtctaccaatggcagccactgtgaactgtgctgataacactggagccaagaaactttacatcatttctgtaaagggaatcaaagggggccttaacaggcttacatctgcctgtgtcggatgacaaggttaaggaaactgtgaaaaaggaaaagccagaccccaccgaagaaagggaatatccaagtgccatttgattaagcaggcgccagggcaagggggcggcacaaaaggaaaggggatccgcgggaagaacctttaaaaaaaaaaaacacaaagggcgcgcattgggtgcaacccccccaaaatgggtcgaagggaaccaatacggggtgccgttgggccaatattcagggtggggaaaccccacagtgtagatgacaaaaagacaacggggggggccgcggtggagtactgcgcaagtgcggtcccgggttgtgaaggaattcgaacgcaacatacagatggcagctgataaaagaaaacaatggatacaaaagatcatttggtcctctaaaccacagggggacatgatatccatcgagaggctgcagagacgcacaagtaaaacagagaggatcttaatctactccctgngatggtagaacgaccgatatgagtacagaccaaacgatcgctagacgatgagcgccactgtgtcggaaaaacactacatggggtatctgtctgagggaggtgagcaacgagattacaatcactctagtggagaaaaatcgagcgcgtggacatgaagagatatgtaattgtctcgcggttgtaaagaggaccccaggactcggggaacgcggagggcgacagcacgacacgctaactcaaataggatacagcagacggaagaaggaggagcgcggcatggaggcgatatctactgtggctggatggtggtgcaagcatgaacgacacacagaagcaggaggaagagaggaggagcggg

SEQ ID NO: 91242 - protein, 58 aa, Zea mays
  misc_feature: Ceres CLONE 1579511
MSNRGRGGSAGNKFQMSLGLPMAATVNCADNTGAKKLYIISVKGIKGGLNRLTSACVG

SEQ ID NO: 91243 - DNA, 851 bp, Zea mays
  misc_feature: Ceres CLONE 1579512
  misc_feature: Translation starting site: 568
  misc_feature (531)..(531): n is a, c, t, g, unknown, or other
  misc_feature (596)..(596): n is a, c, t, g, unknown, or other
  misc_feature (602)..(602): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (698)..(698): n is a, c, t, g, unknown, or other
  misc_feature (837)..(837): n is a, c, t, g, unknown, or other
gcggtggcggccgctctagaactagtggatcccccgggctgcaggaattcgtctcacccctagaaaaaatcccgcgccccgaatttcccgagccaactccgccctgccctgtcgctttcccttccacacgcgccgttcgctttgatcgatcaggcaggcgtggccgacgagacgaagcaagaagccgccgccccccccgccgaggtggtcgtgacggaggatgagaagaaggcagaagagaccgccccggtggcggaggaaaaagccgtggaggcggctgtagagaaagccgcggacgcggaggcgggggcggaggaaaaaggccggaagcgggactcggaggaggagaagaaggcggaggaggccgaggaggccgccgcgggggatgaggcggcggtgatcgatggcactgggtcgttcaaggaggagagtaacctggtgtccgagctccccgaacctgagcgcacagcgctcgcgcagctcaaggagctcgtcgccaccgcgctcgcttaacggggagttcaacctggncgcccgcccccagccctaggagagggcaaaaattagatgaacccgcaaaggaagaagctcccgcngaccanggaggacgagcccaaggcagagggaagcggctgccccagagcccgtccagggagaaagcccaagcctgaggagccaagnnnnnnnnnagcgccgcngaagcagcgccccgaagaaggttaaggacgagacacccgtgcccggaagagaactatgactgaggctccccgcgcccgtatgagccccaaggccgaagaagcctgccaaaggaaggagctcaagggcaaaaggcgggcnacggaaagcggtcc

SEQ ID NO: 91244 - DNA, 931 bp, Zea mays
  misc_feature: Ceres CLONE 1579518
  misc_feature: Encodes the peptide sequence at SEQ ID NO. 91245
  misc_feature (776)..(776): n is a, c, t, g, unknown, or other
  misc_feature (792)..(792): n is a, c, t, g, unknown, or other
  misc_feature (794)..(794): n is a, c, t, g, unknown, or other
ctccccgcggtggcggccgctctagaactagtggatcccccgggctgcaggaattcgtctcacccctagaaaaaaaaaacctagctagatttagaaaaacaaaaaacctgtccccaacccgaaccgtgagatggctgagtacggcgagcgctaccagggcaacggcgaccaggccacggccgagggtggctatgcgcagaccgagtacgccgccggcgccggtggctcgccgccctccgacagcaatccctccgtgttctccgaccacgccgacggccgctcctcccagccccagcatgagacccaatcacatgacagtggttcctccaaatctcaagaaagggaccgagaacgtgataagggcaaggacagggagcgaggcagagaccgtgtccgcgaaaaggagaggggccgagacagggacaaggatcgtgaaagaggtgacagagacagggatcgtgatcgccaccacagggatcgtcgcgagcgcagcgagataagggaacaccgtgatcgttctgatgatcgtgaccgtcgcaggagtcatgattctgagaggagaagagatcgtgacagagatggccatcgtaggcatcgctcccgttccccttctaagggtcgtgaccgtgaccgcagatctagttctcattcacgctctagatcgaagagcaagcgtggtgagtggttttgaccaagcacctacacaacaggcagttcctattggttgctgctggtgttatccctggtcagctgcctggtgtcaccgctcctattcntggggggtggggtgcntncaaaacttgtataatttggctgcaggacagttcaacccccatgttatttcagcacatgcatgacactacaggctacccggcatgctcgggctgtctatgtgggcggacttcctcaacgtgctatgagcagacgttgt

SEQ ID NO: 91245 - protein, 186 aa, Zea mays
  misc_feature: Ceres CLONE 1579518
MAEYGERYQGNGDQATAEGGYAQTEYAAGAGGSPPSDSNPSVFSDHADGRSSQPQHETQSHDSGSSKSQERDRERDKGKDRERGRDRVREKERGRDRDKDRERGDRDRDRDRHHRDRRERSEIREHRDRSDDRDRRRSHDSERRRDRDRDGHRRHRSRSPSKGRDRDRRSSSHSRSRSKSKRGEWF

SEQ ID NO: 91246 - DNA, 931 bp, Zea mays
  misc_feature: Ceres CLONE 1579519
  misc_feature: Translation starting site: 161
  misc_feature: SWISSPROT Homolog: EC 1.4.1.2 Glutamate dehydrogenase
  misc_feature (776)..(776): n is a, c, t, g, unknown, or other
  misc_feature (912)..(912): n is a, c, t, g, unknown, or other
agctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacagaaggctaccagtgtcggtgaagaagaatgccctcatcttgatcntgggaggtggtacttttgatgtctccctctcacccattgagaaaggatctttgaggtcagggcacagctgtgacacccatccttggtgtgaggactttgacacaggatggtcacacctcttccagagttcagaggnagacaagaagattcccggc

SEQ ID NO: 91247 - DNA, 976 bp, Zea mays
  misc_feature: Ceres CLONE 1579520
  misc_feature: Encodes the peptide sequence at SEQ ID NO. 91248
ctccccgcggtggcggccgctctagaactagtggatcccccgggctgcaggaattcgtctcacccctagaaaaactttttccccttcacagccccgtactactatccccgctaccgctagccgccgcgctgctctctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaccacggatctgctgcagaagttgtcgctggattcgcagcccaaggcggcgggtgcgacagagcctgctgctgctgccgctgccgccaaggagggtgctgtgacaaaccagccgctgagtgtggccatcccgccagagcggtctatcacgccggtgcttcaggactttatggatcccaacctgttctatctaccagcgtattactatggaggctacgacagttccatgagcgagtgggatgattatccaagatatctaaattcagatggagtggagattgccccagcagtgtatggagatattatgggatatgggtatgctcctttacgggcatactctccggccacctccccagtttcaaaggttggatgtcaaatgtttggcgcacaccattacaagtttccaaccccgtattttcagcctcctacaccaattctttctaccactcaaaggaaacttcaggtcttccacaatcccgaaaagcccgcagctaaagcaaaatcctgccaagggaacccccta

SEQ ID NO: 91248 - protein, 210 aa, Zea mays
  misc_feature: Ceres CLONE 1579520
MAAVATPPAPAPAAPAPAPAPAAAPAPVTVAPAADQTTDLLQKLSLDSQPKAAGATEPAAAAAAAKEGAVTNQPLSVAIPPERSITPVLQDFMDPNLFYLPAYYYGGYDSSMSEWDDYPRYLNSDGVEIAPAVYGDIMGYGYAPLRAYSPATSPVSKVGCQMFGAHHYKFPTPYFQPPTPILSTTQRKLQVFHNPEKPAAKAKSCQGNPL

SEQ ID NO: 91249 - DNA, 997 bp, Zea mays
  misc_feature: Ceres CLONE 1579521
  misc_feature: Encodes the peptide sequence at SEQ ID NO. 91250
  misc_feature (77)..(77): n is a, c, t, g, unknown, or other
  misc_feature (78)..(78): n is a, c, t, g, unknown, or other
accttattttcatacataattttgcgtgttctttgtcttttccttatgaccaattgcctggggttaaattaattttnncaaaactggaactccccgcggtggcggccgctctagaactagtggatcccccgggctgcaggaattcgtctcacccctagaaaaagagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatattattggggtttcctgtagttgctcttgtcaggcatgttgtgggggccttatctagtggaaatgtggaatcactgtactgggctgttttgccgagacaatgctccttatatttggtttatgcctctaggatctcaaaagttgtgtttgttgagatttgcccctcgggttacccgttctgaaatctgacaaaatgatattttgatcccgggggcaaaaaaactttctcgtcccccgctccagtgggaatggcccccatcccttccaattcaaaggtttgggtgggccggggtgcccccccgtttttcctcctcctcaagcccccttcgtttaaccccggaaaagggtaaaaacttggccaaaggcccaattggtttacacacggagatgtaagttaaccgggcctcttggggaaattagcggaaccaccggtggaagggaaaaaacacacttttttttc

SEQ ID NO: 91250 - protein, 92 aa, Zea mays; identical to SEQ ID NO: 7812
  misc_feature: Ceres CLONE 1579521
  misc_feature (2)..(91): Pfam Name: Ribosomal_L37ae Pfam Description: Ribosomal L37ae protein family

SEQ ID NO: 91251 - DNA, 777 bp, Zea mays
  misc_feature: Ceres CLONE 1579528
  misc_feature: Encodes the peptide sequence at SEQ ID NO. 91252
ctccccgcggtggcggccgctctagaactagtggatcccccgggctgcaggaattcgtctcacccctagaaaaaatcgcccccgccaggcgccagcctcccgtatttgatgtttcacaaacgcgtgagcggctcgccctcctctccagtccctcctccctccggtccgcacaggggagcagccggcagcagctagctaccacagcaataagctaatcagctacgatggcggactacgtgtatggccccgggcggacccacctgttcgtgccgggccccgtgaacatcccggaccccgtgatccgcgccatgaaccggcagaacgaggactaccgctcgccggcggtgccggcgctgaccaaggtcctgctggaggacgttaagaagatcttcaagaccacgacgggcacgcccttcatgatcccgacgacggggacgggcgcgtgggagagcgcgctgaccaacacgctgtccccgggcgacagggtcgtgtccttcctcatcgggcagttcagcctgctgtggatcgaccagcagcggcgcctgggcttcgacgtggacgcggtggagagcgagtggggccagggcgccgacctggccgcgctggagcgcaggctccgcgaggacgcgccgcggcacgccatcaaggccgtggccatcgtgcacaacgagacggccacgggcgtcaccaacgacctggccgccgtgcgcgcgctgctggacaagcacgcgcacccggcgctgctgctggtggaacggcgtgtcgtccatctgcgca

SEQ ID NO: 91252 - protein, 184 aa, Zea mays
  misc_feature: Ceres CLONE 1579528
  misc_feature: SWISSPROT Homolog: EC 2.6.1.45 Serine--glyoxylate transaminase
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRLGFDVDAVESEWGQGADLAALERRLREDAPRHAIKAVAIVHNETATGVTNDLAAVRALLDKHAHPALLLVERRVVHLR

SEQ ID NO: 91253 - DNA, 805 bp, Zea mays
  misc_feature: Ceres CLONE 1579530
  misc_feature: Encodes the peptide sequence at SEQ ID NO. 91254
ggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgttatcggtgagccgattgatgagaagggtgatataacgacaaaccacttcctccctatccatcgtggagcccctgctttcgttgagcaggccactgagcagcaaattcttgttactgggatcaaggtcgtggatcttct

SEQ ID NO: 91254 - protein, 214 aa, Zea mays
  misc_feature: Ceres CLONE 1579530
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIINVIGEPIDEKGDITTNHFLPIHRGAPAFVEQATEQQILVTGIKVVDL

SEQ ID NO: 91255 - DNA, 768 bp, Zea mays
  misc_feature: Ceres CLONE 1579532
  misc_feature: Encodes the peptide sequence at SEQ ID NO. 91256
  misc_feature (641)..(641): n is a, c, t, g, unknown, or other
ctccccgcggtggcggccgctctagaactagtggatcccccgggctgcaggaattcgtctcacccctagaaaacaatggctctaagcaagatgaagcatttgatcttccatctgatgattcggatgacaatgattttgaccccaatatgcctgaagagcatgtggctagtaaggaagaaggatcttctgaagaggaagaggatgatgacggaggatcagactctgacgactctgacttcttaacctgttctgatgatttggaacctttgatagataaaaagaaggttgatgacctgggattaccttctgaagattcagaggatgatgactatgatccagcaggtcctgattcggataaagatgtcgaaaagaagtcaaattctgatgagtctgatttcacgtctgactcggatgatttttgtaaggagattaaaaaatctggtggacatgatgaagtttcatcgcctccattacccgatgtcagggtgggtgatatggaaaagaacactgctcagtctaacacaacaagttctgctgacgaccctatggagattgaaatagaccagagtgtggttttaccagcttccacttctcctcctcccgctcccgtttccgctcccgtcacccttgctgcaccagcntccacgccccctcctcccgctcccgttttcgctcctcttatcccacctgctcgcttccgggagcgcgatgagactgaggtgcgacctcctagctgcagatccctaagttggttggaccttcagcgtg

SEQ ID NO: 91256 - protein, 255 aa, Zea mays
  misc_feature: Ceres CLONE 1579532
PRGGGRSRTSGSPGLQEFVSPLENNGSKQDEAFDLPSDDSDDNDFDPNMPEEHVASKEEGSSEEEEDDDGGSDSDDSDFLTCSDDLEPLIDKKKVDDLGLPSEDSEDDDYDPAGPDSDKDVEKKSNSDESDFTSDSDDFCKEIKKSGGHDEVSSPPLPDVRVGDMEKNTAQSNTTSSADDPMEIEIDQSVVLPASTSPPPAPVSAPVTLAAPASTPPPPAPVFAPLIPPARFRERDETEVRPPSCRSLSWLDLQR

SEQ ID NO: 91257 - DNA, 851 bp, Zea mays
  misc_feature: Ceres CLONE 1579536
  misc_feature: Encodes the peptide sequence at SEQ ID NO. 91258
aaagctggagctccccgcggtggcggccgctctagaactagtggatcccccgggctgcaggaattcgtctcacccctagaaaaaaaatcccacaccaaccagagccaccctgccgtcgtaggcgcacgcgccgtagataggaagcttattaagctagcgcgtgtcgctgcgccatcctgccatggaggatcaggcgctggcgccgctgctgcagccgctcccgctcggcgaaacgggggccatcaaggggcgcgcgaggcgggcggcgctggagtggtgggtggagtcgaagaagctatggcacatcgtgggcccggccatcttccaacggatcgcgctgtacggggtcaacgtcgtcacgcagatcttcatcggccacctcggcgacctcgagctcgccgcgctctccatttgctgcaccgtcgtcgggggcttcaacttcgggttcctgctgggaatggcgagcgccctggagacgctttgcgggcaggcgttccggcgccaagaagcaccactggctgggggggtacctgcagcgttccgggatcgggcccccaattttcggcgcccgcctgaccccaatgtaatttttttgggaaggaccgtgttctcttaaactggcatcccccggaaatttccccggttgggggggcaaaaaaaaagtttattttcccccccgaatttttcccaggggaagagcgtcctccctcccccgggtccctaaaaaaccctttaaaaaaaagtggggaacgcaaaaacccgggggcgccgcgcccctccccaacccggtgggggccccccaagggggggagggggcccccacaaaatttgggaggttgggggggcgcccc

SEQ ID NO: 91258 - protein, 144 aa, Zea mays
  misc_feature: Ceres CLONE 1579536
MEDQALAPLLQPLPLGETGAIKGRARRAALEWWVESKKLWHIVGPAIFQRIALYGVNVVTQIFIGHLGDLELAALSICCTVVGGFNFGFLLGMASALETLCGQAFRRQEAPLAGGVPAAFRDRAPNFRRPPDPNVIFLGRTVFS

SEQ ID NO: 91259 - DNA, 942 bp, Zea mays
  misc_feature: Ceres CLONE 1579538
  misc_feature: Encodes the peptide sequence at SEQ ID NO. 91260
ccgctctgaactagtggatcccccgggctgcaggaattcgtctcacccctagaaaaaaccccagctcactcgtgccgtgcactcgacccgccccccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctggagatctccaacgccgactcggcgacggacgacgaccggagccgcgacctggaccgggcggcgctgatgcggcagctggacgagacgcagcagagctggctcctggccgggcccggcgaccaggccggcaagaagaagaagcggtacgtcgacctcggctgcgtcgtcgtcgaccgtaaggtcttcatgtggaccgtcggcaccatcctcggcctcggcgtcttcatcggcttcgtcatcatgatcgtcaagctcgtcccgcacaagcgccccccgccgccgccgcccgaccagtacacgcaggcgctgcacaaggcgctcttgtttcttcacgcgcagcgatccggcccgctgccgaagcacaatggggtgagctggagggggaactcctgccttgagggcggccctctccgaaaggcaccctccgccggaacccgggccggaggctcttcgaaccggggggaccccttctagttccattaccccttgggagggtcctttgaccttgtttcgtggggggggggtctcattcggggccaagtacaaaggcctcggggaacctggacccttcggggggcctctctagtggggaagggatccctccctcaaagcttttattcttcggccgaaccattataccgatcccgccccagggggggggggggaaccccta

SEQ ID NO: 91260 - protein, 168 aa, Zea mays
  misc_feature: Ceres CLONE 1579538
  misc_feature: SWISSPROT Homolog: EC 3.2.1.4 Cellulase
MFGRDPWGGPLEISNADSATDDDRSRDLDRAALMRQLDETQQSWLLAGPGDQAGKKKKRYVDLGCVVVDRKVFMWTVGTILGLGVFIGFVIMIVKLVPHKRPPPPPPDQYTQALHKALLFLHAQRSGPLPKHNGVSWRGNSCLEGGPLRKAPSAGTRAGGSSNRGDPF

SEQ ID NO: 91261 - DNA, 949 bp, Zea mays
  misc_feature: Ceres CLONE 1579539
  misc_feature: Encodes the peptide sequence at SEQ ID NO. 91262
tccccgcggtggcggccgctctagaactagtggatcccccgggctgcaggaattcgtctcacccctagaaaaatcggccatgcccgtgccgctaggagctgtaggcgcacccagaggccgcagcacagcagccacggatgaggaggcctccaatcgtggcgcgcgtgcgccgctcgctcttcctcctcctctgctgctgttgctgcctcgccgcctggtcgtcgccgccggccgtgcgcgcactcccgctgtgcaccgacgggcgggcgccggtgcctctgaacaggacgctgggcttctgctccgcttacggcgggggcggcagcagtagcagctgctgcgacgccgcagcggacgccgcgctgcggaagaggttcaacgccatgaacacctctgacgcggcctgcgctggcgtcatcaagtctgtcctctgcgcggagagcagaccattttcggctgagttggtcaattcaagctcaaagattcaggatggttcctctccggtgcaactatacttcttcatcaagttctgctcaatccaaagaattctacacgaggattactgtaaacctagtttgtggagacttgcaaaaaatgttgaccaatgtgaaactctcccttttccaagctccctttgcgagggaagggccaggactgccctaggttcattcggtcaaaagcttcacaggaatgtctggggcagtctgaaaacagaacttccgggcaagtcaatttggggggccccacctgggcgaaggagactctttaatgtttgcaatgggaaatacaaggttttcttttcaccagcaccgaaacccttaaccccccaccttaaaggggattttgccttttcaaaaaatcaaggcacggcatcctttatgtgaacagtggggttccacaagcgggaaggaaataacagtatgtttttcttttctagagcggaccttgg

SEQ ID NO: 91262 - protein, 248 aa, Zea mays
  misc_feature: Ceres CLONE 1579539
MRRPPIVARVRRSLFLLLCCCCCLAAWSSPPAVRALPLCTDGRAPVPLNRTLGFCSAYGGGGSSSSCCDAAADAALRKRFNAMNTSDAACAGVIKSVLCAESRPFSAELVNSSSKIQDGSSPVQLYFFIKFCSIQRILHEDYCKPSLWRLAKNVDQCETLPFPSSLCEGRARTALGSFGQKLHRNVWGSLKTELPGKSIWGAPPGRRRLFNVCNGKYKVFFSPAPKPLTPHLKGDFAFSKNQGTASFM

SEQ ID NO: 91263 - DNA, 1292 bp, Zea mays
  misc_feature: Ceres CLONE 1579540
  misc_feature: Encodes the peptide sequence at SEQ ID NO. 91264
  misc_feature (15)..(15): n is a, c, t, g, unknown, or other
  misc_feature (16)..(16): n is a, c, t, g, unknown, or other
  misc_feature (893)..(893): n is a, c, t, g, unknown, or other
ttttttcccccttcnntccccccttccttccgtccacgtttccgcgccggcgattttccctaggcttagcaaaccaaagctgggactcccctcggtggaggccgctcttgaatagtggatcccccgggctgcaggaattcgtctcacccctagaaaaaatacagttcggttagttgttaaactgctctcaccatctgatccaattgataattctggaagagagagccagttgataaagcttggtccaatgctctatgttattctctcacgaatatcggccgtggactatgctccaatcttctcattccatggcctgattccagagctggatgcttctcttatggaaatctgtgaagtatttgggtgttttactccaagtgtttcctggacactgagaactggcgaggaaatatctgctcacccattctttgcgaatgcatttattctccagccgagactatggaagttgtgaccatctagctcgtcgcacatttgcgccaacgggatacggacgctccaatcaggcgtctcagacctaaaccctgagattttaccaacctgccgcctaaatgaagttccccaagaggccgcactcctacacagtaacgaattgctccacccctcccctggtgagcgggaaccaaaaagccgagactcggccacaccgaggtgaaagcaatccaacatccgccagtccctcccgcgggtgacaattcccggatgtttgtttcatgtgggaaaacgttgtgttgtaaatcctaaacgacctctactaaacaaaaatatatactgtaaaatccacatgatcacgcgcctcatccaaagagacactctcagtcgtttccctatgtgtggcctgtagccccgcgatatttctgcttagtcctctactnctcgacccctttcttcatctagaccttgtcggacgaaatacagcgtcattgtgttaacaccctccaacccacatctattgttgatgagaatacgggggactcgttctgtccgtcagatagtgcaataatttgggagttaacggataaaaaaataccgaatatattaacatggggggaagtcccgacctcctatctctatttcaccgagtgaactcacgatatagatcaagtggggaagtagtataataccacgcaagataaaatgagcttagaacttctattaccagagagatagctctcgggtcttgcgggagtggatcgtaatgaacacaaaagtgtcaaaacagagctgatcccacaagtgttacccctccactgttttgtaggatatacgataat

SEQ ID NO: 91264 - protein, 74 aa, Zea mays
  misc_feature: Ceres CLONE 1579540
MLYVILSRISAVDYAPIFSFHGLIPELDASLMEICEVFGCFTPSVSWTLRTGEEISAHPFFANAFILQPRLWKL

SEQ ID NO: 91265 - DNA, 827 bp, Zea mays
  misc_feature: Ceres CLONE 1579545
  misc_feature: Encodes the peptide sequence at SEQ ID NO. 91266
  misc_feature (462)..(462): n is a, c, t, g, unknown, or other
  misc_feature (464)..(464): n is a, c, t, g, unknown, or other
  misc_feature (465)..(465): n is a, c, t, g, unknown, or other
  misc_feature (474)..(474): n is a, c, t, g, unknown, or other
  misc_feature (481)..(481): n is a, c, t, g, unknown, or other
ctggagctccccgcggtggcggccgctctagaactagtggatcccccgggctgcaggaattcgtctcacccctagaaaaacccctctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccggggaccnanngagtcatgnaagcccntgctgccggcgctgatgtgtccatgaattgccaggttcggcgtcgggttctactctggctacctcgtcgccaaaaaaagtttttcgggcccccccagccaaccattaacaaacaacctttgtggaatcccaaggggggggtcttttcctgttccctggaccctccgggaaacctttttgcgggggcccaaaaataccctgtttccaagggggaaaacccggggaacccttgggagagggcccccccagggttttggtgaaaaaaccccctagagttcccaagccccccccccctccctggggggggggaaaacccccccagagggagttttttttccccaacaaaa

SEQ ID NO: 91266 - protein, 114 aa, Zea mays
  misc_feature: Ceres CLONE 1579545
  misc_feature (104)..(104): Xaa is any aa, unknown, or other
  misc_feature (105)..(105): Xaa is any aa, unknown, or other
  misc_feature (108)..(108): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGDXXSHXSPCCRR

SEQ ID NO: 91267 - DNA, 819 bp, Zea mays
  misc_feature: Ceres CLONE 1579546
  misc_feature: Encodes the peptide sequence at SEQ ID NO. 91268
  misc_feature (501)..(501): n is a, c, t, g, unknown, or other
ctccccgcggtggcggccgctctagaactagtggatcccccgggctgcaggaattcgtctcacccctagaaaaaccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaagacctcctcctcctcttcttccctccactcgcctccaaatcttctctctcctttcctcctctcttctcaccgcatcacctctccctccggcgcgcgcgtccgggtacagcgctagagtcactcaccaccatgcaggcggcggcggcggcgaatggcgcgggcgacgtgcagaagcctcagcangcagccgctggtggcgggggcgccgcccccaccgccggcggcggccgtggtgccgccccattgggtcgccatgccgttcgcgccgcctcccggggccacggccatggtgatgcagccgcaccatatggcgcctccgccgccgcagttcgcgccgactcacttcgtgccggttcacgccgtcgcgcgggcaccgtcggtgccagcagcggtcgcactgggtttcccagcgccgcatcagcccgggcaggaagagaaacagagcgtgtgggtcggcgacctccattactggatggacgagaactatctgcacagctgctt

SEQ ID NO: 91268 - protein, 116 aa, Zea mays
  misc_feature: Ceres CLONE 1579546
  misc_feature (11)..(11): Xaa is any aa, unknown, or other
MARATCRSLSXQPLVAGAPPPPPAAAVVPPHWVAMPFAPPPGATAMVMQPHHMAPPPPQFAPTHFVPVHAVARAPSVPAAVALGFPAPHQPGQEEKQSVWVGDLHYWMDENYLHSC

SEQ ID NO: 91269 - DNA, 1238 bp, Zea mays
  misc_feature: Ceres CLONE 1579548
  misc_feature: Encodes the peptide sequence at SEQ ID NO. 91270
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (1206)..(1206): n is a, c, t, g, unknown, or other
tgggtagtggtttttcttttcatccgcggagtgttagggggaggaatggggagttatcaannnnnggannttntttaaaagctggagctccccgcggtggcggccgctctagaactagtggatcccccgggctgcaggaattcgtctcacccctagaaaaagtgttatccagtccagtatcctcgacggtcgacgccggcgcgagcagcaaatggccaccgcggcggcgacgatgaccatggcgacgcaccacccccgcgcccgcgcacccctccgcgtctgcgccgcctgggacatgaacccgggagccgccaccgtggccacgcccaagccctccaaggccaaggccaagccgccgcccgcgaccacaaccccggcccgcccgcctcctctgacccacgccgatctcttcgcgcgctccagcgaggcgcaaggtatcatctcctgtcctcaccatatgccccgtgctttgcttggccgcctgaaacttctgcgctttttgtgtgttggtgtggcctgccttaaagtaataaatgagaggggcaccaaaatcgatggagccccatttcccttaaaatttcctatccggtaatagggggctttaaaaaaggaaggttttgaaaaatgggaaatttaaggtttccacgggggaaaaaatatgggtggctcccaccttttgaaatcgaaaccttgcggaaaaaaaaaagggcgcgctatttttgggccccgctgcggaaaaatctgtttccttttatccagtatttttcaaaagggaaaacatatggacaaacccaccccccccgcctgtgtggtaaaatttttttttccccccgcgcaaaaaaaaagggggggggcgttttttttttgggcacaaaagagggagccctctcctcaagtaaaaaaatatttccaaaagggagggggaaaagcacctggcactaaaaaatttttcctcccttgtaaatattctttgtgcctcaggaggaaggtccgcaccgcctggccgctttaaaaaaaattccagaccacaaagaaggggccccctctgtttttttaaccacccaaaaacctcccccctaatgagccccttaaatgaggggggtctatgagggaggttttctcgccgggctttagggagcaccctgcacctcttttgaggggaggggaggggacacctttctaatatgtttataagaaccctacaanccccccctattgtggggtcccccctctcttaa

SEQ ID NO: 91270 - protein, 126 aa, Zea mays
  misc_feature: Ceres CLONE 1579548
MATAAATMTMATHHPRARAPLRVCAAWDMNPGAATVATPKPSKAKAKPPPATTTPARPPPLTHADLFARSSEAQGIISCPHHMPRALLGRLKLLRFLCVGVACLKVINERGTKIDGAPFPLKFPIR

SEQ ID NO: 91271 - DNA, 899 bp, Zea mays
  misc_feature: Ceres CLONE 1579549
  misc_feature: Encodes the peptide sequence at SEQ ID NO. 91272
  misc_feature (577)..(577): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
tccccgcggtggcggccgctctagaactagtggatcccccgggctgcaggaattcgtctcacccctagaaaaagaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaggagggtattcgttttaggggccctctcattccagaatgcaaaaagtgctgcaacagcagttaagagcggcggcgttnagaaggctgagcagaagccccgggaaccaaaaaggaaagtgaagagcagcaaacaggcggcggcggccaaaagtgacgtacagtacgtggtgagtgtaatggagcctccatgcctgagtggatccatgccagtgtttgaaccaagccttccctttctgggtcctcccagggaagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 91272 - protein, 115 aa, Zea mays
  misc_feature: Ceres CLONE 1579549
  misc_feature: SWISSPROT Homolog: EC 2.3.3.1 Citrate (Si)-synthase
MAFYRGLTAVSRLRSRMAQEATTLGGVRWLQMQSASDLDLKSQLQELIPEQQDRLKKLKSEHGKTQLGNITVDMVLGGMRGMTGMLWETSLLDPEEGIRFRGPLIPECKKCCNSS

SEQ ID NO: 91273 - DNA, 1005 bp, Zea mays
  misc_feature: Ceres CLONE 1579552
  misc_feature: Encodes the peptide sequence at SEQ ID NO. 91274
  misc_feature (805)..(805): n is a, c, t, g, unknown, or other
  misc_feature (827)..(827): n is a, c, t, g, unknown, or other
  misc_feature (828)..(828): n is a, c, t, g, unknown, or other
  misc_feature (885)..(885): n is a, c, t, g, unknown, or other
  misc_feature (886)..(886): n is a, c, t, g, unknown, or other
  misc_feature (889)..(889): n is a, c, t, g, unknown, or other
  misc_feature (896)..(896): n is a, c, t, g, unknown, or other
  misc_feature (899)..(899): n is a, c, t, g, unknown, or other
  misc_feature (988)..(988): n is a, c, t, g, unknown, or other
  misc_feature (989)..(989): n is a, c, t, g, unknown, or other
ctggagctccccgcggtggcggccgctctagaactagtggatcccccgggctgcaggaattcgtctcacccctagaaaaatagaacacagctcaacaaaggagcgcggcggcccctcattccttcctcccacttctctcgcgctgcgctcgcttacctcgcttcgcattccgttcgagcaggggagcggccgtgagaagggaagggagggaattaaggcaagatgttcatcgagagcttccgcgtcgagagcccccacgtgcggtacggcccgacggagatcgagtcggagtaccggtacgacacgacggagctggtgcacgaggccaaggacggcgcctcccgctgggtcgtccgccccaagtccgtcaagtacaacttccggaccagcaccgccgtccccaagctcggggtcatgcttgtggggtggggaggcaacaacgggtccacgctgacggctggggtcattgccaacagggaggggatctcatgggcgaccaaggacaaggtgcagcaagccaactactacggctccctcacccaggcttccaccatcagagtaggcagctacaacggggaggagatatatgcgccgttcaagagcctcctacccatggtgaacccagacgaccttgtgtttggaggctgggacatcagcagcatgaacctggcagatgccatgaccagggccaaggtgctggacattgacctgcagaagcagctcaagccctacatggagtccatggtgccacttcccggtgtctatgatccggaactcatcgccgctaaccagggctctcgtgccnacaatgtcatcaagggcaccanngaaagacaggtggagcagatcatcaaagatatcggggagtttaaggagaaagacaanntgnacaaggntanttgtgctgtggactgccaaccctgaaagggtacagcatgttggtgctgttctcaacgacccatgaagaatctgcttgcatctgggacanngacgagcggagatctc

SEQ ID NO: 91274 - protein, 233 aa, Zea mays
  misc_feature: Ceres CLONE 1579552
  misc_feature (62)..(234): Pfam Name: NAD_binding_5 Pfam Description: Myo-inositol-1-phosphate synthase
  misc_feature: SWISSPROT Homolog: EC 5.5.1.4 Inositol-3-phosphate synthase
  misc_feature (195)..(195): Xaa is any aa, unknown, or other
  misc_feature (202)..(202): Xaa is any aa, unknown, or other
  misc_feature (221)..(221): Xaa is any aa, unknown, or other
  misc_feature (222)..(222): Xaa is any aa, unknown, or other
  misc_feature (223)..(223): Xaa is any aa, unknown, or other
  misc_feature (225)..(225): Xaa is any aa, unknown, or other
  misc_feature (226)..(226): Xaa is any aa, unknown, or other
MFIESFRVESPHVRYGPTEIESEYRYDTTELVHEAKDGASRWVVRPKSVKYNFRTSTAVPKLGVMLVGWGGNNGSTLTAGVIANREGISWATKDKVQQANYYGSLTQASTIRVGSYNGEEIYAPFKSLLPMVNPDDLVFGGWDISSMNLADAMTRAKVLDIDLQKQLKPYMESMVPLPGVYDPELIAANQGSRAXNVIKGTXERQVEQIIKDIGEFKEKDXXXKXXCAVDCQP

SEQ ID NO: 91275 - DNA, 834 bp, Zea mays
  misc_feature: Ceres CLONE 1579554
  misc_feature: Translation starting site: 216
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaattcgagttgtccgcttccagtcagtcgccgccgccgccgtcgccgctgaaaccgaaacttgaaaaaccagctcgccgggggtccggccgatttcccccaaatttccctgctgctgctgataggaggccgcggcgaccaccatgggcaactgctgcgccacgccgtcgacgacggaggagagcggcaagagccgccagaagaagccgaagcagaagacgaacccctacaacgtggcgtacaaccgcggggcggcgccggcgccggcgcgcccgggcctggtggtgctgcgggacccgacggggcgggacctcggcgcgcagtacgagctgggcggcgagctgggccgcggcgagttcggcgtcacgtacctgtgcaccgagtccgccacgagggcgcgctacgcgtgcaagtccatctccaagcgcaagctgcgcacaccccgtggacgtggaagacgtgcgccgggagggggacatcatgcgccacatgcctccgcaccccaacatcgtcagcctccgcgccgcctacgaaggacgaggacgccgtgcacctccgtcatggagctcctgcaagggaggcgagctcctccaaaaggatcgtcgccccggggccacctaacccgaaacgtggccgccgcccgcccgtaaggcgaaccaatcgtccgaaggcgtcccaagattgggcacaaaggcatgggcggctttggcccccgggaattctttaaacccaaaaaaaccttttttatattggcaagccaga

SEQ ID NO: 91276 - DNA, 835 bp, Zea mays
  misc_feature: Ceres CLONE 1579555
  misc_feature: Translation starting site: 157
  misc_feature: SWISSPROT Homolog: EC 1.2.1.3 Aldehyde dehydrogenase (NAD(+))
  misc_feature: SWISSPROT Homolog: EC 1.2.1.9 Glyceraldehyde-3-phosphate dehydrogenase (NADP(+))
  misc_feature (519)..(519): n is a, c, t, g, unknown, or other
tggagctccccgcggtggcggccgctctagaactagtggatcccccgggctgcaggaattcgtctcacccctagaaaaaatccatctatccatcatcaccagctagcacctcctttcccacgactcccgagcgctctgcgtgtggcgcgcggcagcatggcgactgcgaacgggagcagcaaggggtcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggagacaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgngacatcccgggcgccgcgcacctgctgcgctactacgccggcgccgccgacaaggtgcacggcgcgacgctcaagatggcgcagcggatgcacgggtacacgctcaaggagcccgtggggcgtggtgggccacatcgtgcccctggactaccccacccacatgttctttctcaaggtagggcccgccgctcgccgcaggctgcgccgtcgtcgtcaagccccgcgagcagacgccgctgtccgcgctcttctacgcgcacctcgttcaggaaagcgggcgtccccgccggcgtgctcaaacgtcttgccgggatca

SEQ ID NO: 91277 - DNA, 1294 bp, Zea mays
  misc_feature: Ceres CLONE 1579559
  misc_feature: Encodes the peptide sequence at SEQ ID NO. 91278
  misc_feature (12)..(12): n is a, c, t, g, unknown, or other
  misc_feature (13)..(13): n is a, c, t, g, unknown, or other
  misc_feature (744)..(744): n is a, c, t, g, unknown, or other
  misc_feature (947)..(947): n is a, c, t, g, unknown, or other
attatttttatnncaaaaaaaaccatatttatttctctcctattattatctgccgcacaaaaaacaaaattctatcctggaactccccgcggtggcggccgctctagaactagtggatcccccgggctgcaggaattcgtctcacccctagaaaaaacccaatgcaagcaatttttgcggacagggggaccttcctcttcttcttcctcgtccccggcccctgcccctctcccctgcggagacggagcgccaccttcctcaccttctagaaagaactagaaccctccctccagaaccttgaagaccagcccagaccagaccagccccgaagctctccgccggccccgcccttgacgacatgaagcaccagccgccgcgccgctggggcgtcgtggcggcggtcgtcgcactcgtcctcctcgcctgcctccagatccagtaccaccacctcaaggtggatctcggcaaggccggctttgcctctgccacgcaagaaaataacgcgatccccagccgcaatacccattcgcttgggggccccgaacagggaaaccggcgccccacttcccttgcccgccccggggattggtccaaccggcccacttcccgaacatgtgtcccttcccgcgccgggcttctgggggaagggaacaaacacctggccttgtcccacccctaccaaaggaaaacaacaaaaacacaagtgtgaaatctacccaagtggggcttttcgtcccctctcgnaccccaattgtgggcccaaatttccaggggccatatatctttttcccccccccatcgagtttttaaaagaaaaacaaaacaccctctctttgggagaaccccccccctctaggtggggggggccgcccccccggtaaaataagagtcttcctttcccttttataaaaagggggaaaaaaaaaaacctcacacatgtaccgaangtaatacaaattggccccctcccttttaccccacactattcatacttcgcaaggggggaaaaaaaaatcgtgctcgaaaaaattgtggcaaaatgggggcggataaccgcttccatcttttaaaaaatagaggaaaaaaattgtatataaaagaggcgcccatactatcaacaacgattgccccattttgtcattgctacaacaacactcaatatacccacacaagtgggtgtgtggcgtgttggcgcagatacacccgattattctcttgagaagatacgcaggaaatgaggaaggcggcgtctgatcatgatgaggaattgtcaactttcttctccaatgagaga

SEQ ID NO: 91278 - protein, 116 aa, Zea mays
  misc_feature: Ceres CLONE 1579559
MKHQPPRRWGVVAAVVALVLLACLQIQYHHLKVDLGKAGFASATQENNAIPSRNTHSLGGPEQGNRRPTSLARPGDWSNRPTSRTCVPSRAGLLGEGNKHLALSHPYQRKTTKTQV

SEQ ID NO: 91279 - DNA, 875 bp, Zea mays
  misc_feature: Ceres CLONE 1579560
  misc_feature: Encodes the peptide sequence at SEQ ID NO. 91280
  misc_feature (875)..(875): n is a, c, t, g, unknown, or other
aaagctggagctcaccgcggtggcggccgctctagactagtggatcccccgggctgcaggaattcgtctcacccctagaaaaaacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatattcgacctgcctttctgctctcctgacaaagtgaaggaaaagagcgaggccccccggggagggtctcaatgggggatcggttagttgaagcgcccttacaagctttgatttcccgtggacaaatttgaatcccaagggcagtttggctccaaagaaactttactacaaaaggaatggagtggaaggttcccggaaaggcacgggggctaaaggacctacttccttcccaaatggacctaatgaaggaatccccccacgggtggggggctttccttccgggtaaaagtttgaaaaaaggggccggcaaagggattgatccccaacccaagtgggaaaaatccttttctggggtcgggggcacattaattctttcgaacattccctattaacaaaaaaccgaacccgggggggaatcccaaaaatccaatggggccccccaccgggatcagaaaggggcattgggggttgacccctggaccgagggagataaggggggaccccaaaggggggaaatttccccggggacccn

SEQ ID NO: 91280 - protein, 67 aa, Zea mays
  misc_feature: Ceres CLONE 1579560
MAALRAPAATLLVLLALAAAGGVAADGSDHRYKIREPVPLYANKVGPFHNPSETYRYSTCLSALLTK

SEQ ID NO: 91281 - DNA, 846 bp, Zea mays
  misc_feature: Ceres CLONE 1579565
  misc_feature (682)..(682): n is a, c, t, g, unknown, or other
tggagctccccgcggtggcggccgctctagaatagtggatcccccgggctgcaggaattcgtctcacccctagaaaaaatcactccctcgcctcccccgctgtgccggcctgcacacacagacacacacaccacagcctacagcgcttctgctgctccagctcctcgtactaccgcgcccgcgcgctgctcgttccccggcctctgcttgcttggctcgtcgagcccagaggttggtggagaggcggggcttattgccccagataggagatcggggacgcgggagggcgcgtcgcgctcgggccggtctcggttcagcgggatcacttggccgtggccgtggtcgggcctccggcgcccatgtggtgagccaagccaggcttttgttgcccggggggcagagatcttgcacttgcagcagtgaagccggcggtgcggtccggtccggtccggagccgagcggcgcccaccgccatggccggcagcgacgaggtcaaccgcaacgagtgcaaggtgcgcgcgcgcaagcggctaccgctgctgcttcctcctgtcccctggggcctgtacgtactagtttcttcgcgcgggcatgcgcgccgccgtccttgcgcgtttcttctgttgggatgcgccagggcggcgcgcctcccgatttgtgccgccgctttatgcatggttcngtggggcggttggtggggtcggggccagcgcccggcccggtgttttcccgggttcaatcgctccgctccttttccccttttgggctcaatcccaaaatttatcctccttctcggcttgccccccggttggtttttttttttggaagttttgggaggggagaagt

SEQ ID NO: 91282 - DNA, 1308 bp, Zea mays
  misc_feature: Ceres CLONE 1579567
  misc_feature: Encodes the peptide sequence at SEQ ID NO. 91283
  misc_feature (1100)..(1100): n is a, c, t, g, unknown, or other
cgatgcgatgtttttctcttttcctttttgggttgtggctcttcctccctcccacacagctttttttaatgctggagctccccgcggtggcggccgctctagaactagtggatcccccgggctgcaggaattcgtctcacccctagaaaaaagggaaaaggcgagagcgtagaaagcagtccggtcggagaagcggaagttcgcgttgctttgctgatccaatgggggagaccaacgagctaccgccgccacccgtggccgcgccgccgcccatgatgccgatgcagtccatgatggtcggcgcaggcgccatccacccgccccacgagcagttccaccatctcaactactgcgtccactcaaatccatcctgggttcaggtggcagcacttgcattccttcactatcttgtgatgttgggttctaacgtcaagcttgcaaccgctattgttcctgcgatgggtgccaaccctggtgacaaggctcgagttattcaatcgttcctctttatgagtggcatatacaccctgctgcaaatctttattgggaaccagacttccaaacaggttagtaatgcctccttttgccatttgtttgtccccagtggctttcaattggccaaatgaagattggaatcacattataccctccctggaaaggaatcctggaggagaatttcaaatcccccccccatgcgagtaacccggcacaataggggagcctttcttgtatttggtggggcactctcccattcccttctaaaacatgtgataatttcctttgggggtttttctagtccccaccccaatattggtgtggggggggcgtcatttattgcgcccactaaataaataaggtctctccatatctccccccggcgtggggatacttatagtgggaccccccccctcggtgacagggttttttggggaggtctggcgcttggggaggacactttggggcaacacttttttctcacatgatctttgtagggccttctcttcctctcaactttgttggtggtgagaaatccgcgtgtcggcgagaacaatatcggtgagatcttccgcataggtgcgcataatttttctttccacccncctattttaataattttaccacctcttttgtgttgtcccccatattctcttgtacagatgcattgttcccccatcctatcaggggggtgtccacctaccctcgtctctgtgaatgagaagcctctcagtatccttctcttgctcccattaggtctgctccgggtggagcctctattgccggttatcctgtatctacgttgtggcgggg

SEQ ID NO: 91283 - protein, 134 aa, Zea mays
  misc_feature: Ceres CLONE 1579567
MGETNELPPPPVAAPPPMMPMQSMMVGAGAIHPPHEQFHHLNYCVHSNPSWVQVAALAFLHYLVMLGSNVKLATAIVPAMGANPGDKARVIQSFLFMSGIYTLLQIFIGNQTSKQVSNASFCHLFVPSGFQLAK

SEQ ID NO: 91284 - DNA, 1035 bp, Zea mays
  misc_feature: Ceres CLONE 1579569
  misc_feature: Encodes the peptide sequence at SEQ ID NO. 91285
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (598)..(598): n is a, c, t, g, unknown, or other
  misc_feature (680)..(680): n is a, c, t, g, unknown, or other
nnnncccccccccnnnntttctgtaataaatagatataatagacatcgcaaccacgagggaggtgagtttgtgtattaataaaaacgggagctcccgcggtggcggccgctctagaatagtggatcccccgggctgcttgaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctctacggcgctcgaggtgctcgacaacgacatccngcctcgttgctcgagggtgggcgcagcaacccttgggcgaagaacattggtgccgccacccatcgcctattggaacgggcancgggaagggggcttcggtccggcggggcccagacgccgttccccttcaaacaacttggggcttctcccccaattcaacccggttgccccctggtttggtgcagggggccttaccccccttggggaccgtaaattcattttaaaaggtttctaatccgggtggaagcccccaatttggattgaaagaaaaaggggtggaattattaaccgcgaacaaaaacccaccctttcccctcccccctaattccatttgggtgggaaggcccccccggccccttttccgtttggaagcacagggccccacctggaaggcaagccaaaaattcccttttggtttaaccggggaaaaatccaac

SEQ ID NO: 91285 - protein, 186 aa, Zea mays
  misc_feature: Ceres CLONE 1579569
  misc_feature: SWISSPROT Homolog: EC 3.6.3.14 H(+)-transporting two-sector ATPase
  misc_feature (144)..(144): Xaa is any aa, unknown, or other
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILYGARGARQRHPASLLEGGRSNPWAKNIGAATHRLLERAXGRGLRSGGAQTPFPFKQLGASPPIQPGCPLVWCRGPYPPWGP

SEQ ID NO: 91286 - DNA, 916 bp, Zea mays
  misc_feature: Ceres CLONE 1579570
  misc_feature: Encodes the peptide sequence at SEQ ID NO. 91287
tccccgcggtggcggccgctctagaactagtggatcccccgggctgcatgaattcgtctcacccctagaaaaaacacaggcaaagatggcgagcgtgcacaaggccaccacccttgttctcatgttctgcctgctagcgctggggagagcggagtacctcaagtacaaggacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcagaagggcgctctctctacgcgtctgggtataccgatcatctacggtatcgatgcagtgcatgggcaccacaacgtctaccaagctactattttccctcacaaagctcgggctttggagctacccagggaccctggacctcgttaagaagaattggagaaagcaaccggctcttgaagttaggagctaactgggaatttcctttagcccttttgcctccccggtaaaaggcgggtttggtagaagatccccagaagggggggaaccccgacttatgtaaaagccttcaggggagggactccaaaggttgtggtccggtccagctggaaacttcaattccattcactgggcccctgccagggtgaaagcctcccgtgcagaatttcccccgagggaagggccccttaagtttggggggggaaaagtaaaaaaaggggtccacctggcttttcgccctaaaaacaacctttgtgtcccgtgtaatgggtgtggaaaccgcccttataccggtaaattctccactggggaaacaaa

SEQ ID NO: 91287 - protein, 147 aa, Zea mays
  misc_feature: Ceres CLONE 1579570
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMQKGALSTRLGIPIIYGIDAVHGHHNVYQATIFPHKARALELPRDPGPR

SEQ ID NO: 91288 - DNA, 1088 bp, Zea mays
  misc_feature: Ceres CLONE 1579575
  misc_feature: Encodes the peptide sequence at SEQ ID NO. 91289
  misc_feature (40)..(40): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (74)..(74): n is a, c, t, g, unknown, or other
  misc_feature (75)..(75): n is a, c, t, g, unknown, or other
tctgttattcctttttatttctagaagctatataagaganaagagaggatgaaaataagnnntncnntctcccnntctcaaaactggactccccgcggtggcggccgctctagaatagtggatcccccgggctgcaggaattcgtctcacccctagaaaagggctgttttctttctcgctcctatcatttcgttccgttcctgatacaggcgagcagggacgactgcaggcctccccctctttctcggcttccactcacccgccaccactggaccacccccaacggcgagggagtgagagagatcggcagcagctcgggggcctggcagggcagctgcattgcgctgcggcgggcggcggccatgggccgattcgtacggcgacggcaagggcccatcactcaagagccagagccagaaccagcagccgcgccctggcccccgcctcaagcccgccatcgaaaatggaggatctcatcaacctcctcccacgggatccgatcccagtccggggtcgaacttcacccctcctcgagaaacgaacctgcagtttcaaggaataaagaacctggggccaatgcgcaaggccggaagaatcaagggcttctttcgcctttggtcggaaccgcgccgcccctaagaagggcccttacaaggaaatctttaacccgaaagaaatttggccaaaaaggtgggggaatggggaaaagccttgaaaagcctccaacaaagaagttcccccctccccctttggaaaaagccaaaagaataccctccccaaagacccaaaaagaaaaaattccctaccgaaacctaaaaaaaaaaaaaaagccagccgcctttttggccccgccaaaaagtttttggcccaccttttaaaggtcaaacaccctttctccaaaaggggtgttccattgtcgcgggccccccaaaataggaattggaattaaaccctttgcccctccctaaatatggaagaggccatatcccctttggtacacccacctcgggaaaagcccttaaacctttaaaaacctgggcgcccccgttccaaaggaaatttgtcccaaaaattttccacaagaaggg

SEQ ID NO: 91289 - protein, 32 aa, Zea mays
  misc_feature: Ceres CLONE 1579575
MEDLINLLPRDPIPVRGRTSPLLEKRTCSFKE

SEQ ID NO: 91290 - DNA, 785 bp, Zea mays
  misc_feature: Ceres CLONE 1579576
  misc_feature: Translation starting site: 240
  misc_feature (670)..(670): n is a, c, t, g, unknown, or other
  misc_feature (726)..(726): n is a, c, t, g, unknown, or other
ccccgcggtggcggccgctctagaactagtggatcccccgggctgcaggaattcgtctcacccctagaaaaaaagtcgcagccaggtctctctgtccgccgaagtcctccctcgtcgcgagagacgagtcgcgttcctgttcgccgcccccgccgcccatctcccaatccggactcaggagatcgactcctcctctcggttgaggttgaaggggaaggaactagaaggctactcaagggatggctgaggatgcttctcacggggccagcagctcgactgtgatacctgctgatggtccagagtctaccatcgagatcaacatcaagaccctggattcacaagtccacaaacttcgcgtggataagaatatgttaatatgtgtgttatgcaatggttcggaagagcaagtaataaccgcctcatttttaggcgcctgtttccgttctaaaagagaaggttgttgaagcgactggagttccattggatcagcagcgcttgatttttcgaggaagagtcttgaaggatgaccacctcctatcagaataccatttggaggatgggtatacattgcatctggttgctcggcgtgcagcagagggccagacttcttctggggcttctgaaggaaacacaaatgctaatgtaaacgttactggaaatggaggattgnttggatgatatttccaggagtgttcgggatcttctgggttccttaggtgttgcaantgtctgggtggtgtcactaacacgggcattttcgggttcctttgactagcacaccagac

SEQ ID NO: 91291 - DNA, 840 bp, Zea mays
  misc_feature: Ceres CLONE 1579582
ctggagctccccgcggtggcggccgctctagaactagtggatcccccgggctgcaggaattcgtctcacccctagaaaaaacaccgcatgttaataccgagggcgtccaccggcgtcaccacgcctccgccctcgccctcgccctcgccctccccgtcccccgccaatctcacagcggactctcttcaccaccgcgtcgaagccattccccacttccccaccgcggtccccccttccccacgcactagagaccgtgcccttcccccttactcggcaatctcgcagcggtgcccgccccatccacgcggatctccctgtcgccccccaaccaccttccatccctcgtgacctgttcatgccgtcgccgcctcgatcctgtggatctccctgccgcctcccacgtccgtgctcatgacctgttccgcgtccgctgtcacccccagatcgcgcgaggcccatgtccacgcagtcatcgtcgccgccccctggccacgcgagatgctagcgccccctccaccttgcgtgagcgaccccttcatctaccttcaccaccatcttcaatccacctctgcatcaccgccaaaaccctacccacttccctgctgcccaacaatgaatccgcctccgcaccaccgccaaaactctagcaactatggcagtgaacaacatccgggtttcaagtctttggcagctatgctcatggaaaatacgtctatgttgatgggggaccgatctgttctcgcagaatcagcaaaggcttgaaatcaattggtgggttgggcttatcatttgggggcatttgaaggcaaagctcctaggggagaaaaaggcaggggaaat

SEQ ID NO: 91292 - DNA, 939 bp, Zea mays
  misc_feature: Ceres CLONE 1579585
  misc_feature: Translation starting site: 125
  misc_feature (840)..(840): n is a, c, t, g, unknown, or other
  misc_feature (895)..(895): n is a, c, t, g, unknown, or other
ctccccgcggtggcggccgctctagaactagtggatcccccgggctgcaggaattcgtctcacccctagaaaaaacccaacaccttccattcccagtcccaccaccgcttgtctcagcgacgccatggcgtcctacacagcggcctcgccgctcacctgccaccacctcggcagcgttggtgcccgccctctcctcccgtccatatacatctccctccgccgccgctcgtcgtcttcatctaagcccacctccctttcccactccctcccctccaagcactcgctggacccaccccccaccgcatccgcatcctcccgtcgcggtctcacccccgtaaccgcctccgcctgcgccgccgcggctcgagcgccggatccagtgccggttccagcaccggctccagcgccggctccagcaccgaccgccacacctaagaagcccgcgctgcagggcgcggccatcaagccgctcctggcctccatcgcgactggcgtcctcatctggctgcatccgccgcccgccggcgtgccccgcaacgcgtggcagctcatagccatcttactctccagcatcgtcggcatgatcaccagccgatgaccctcggcgcggtcagactcctcggcctctgcggcgccgtgctcagccgcacgattaggttcgccgcgggcttctgggccttcggcgaaccgatgcactggatcatcgcactcgccttgttcttcgcgaggagatcatcaagaacggcctctgggtcccgcgtgcatacaccgtcgcggcggctttcgggtctgctccctcagcctcgggtactcgctcgtcgtgcgcaaagcgatcccagnccccacattccatcggtctagagaccgcatgcgagatcctcctacgcatgtcagngccttcgggaggcatgcagctcccgacccgggatgcaccgatcc

SEQ ID NO: 91293 - DNA, 811 bp, Zea mays
  misc_feature: Ceres CLONE 1579596
  misc_feature: Encodes the peptide sequence at SEQ ID NO. 91294
  misc_feature (730)..(730): n is a, c, t, g, unknown, or other
ctggagctcaccgcggtggcggccgctctagaactagtggatcccccgggctgcaggaattcgtctcacccctagaaaaagaccgacgctcgagaagtcgagatagagacaaccggcacccgccgatcgctcgctggtgggatgaagaaatgctccggcgtgctcttcatcctcacactcgccgtcgtgctcttcctcctctcgccgtcgccctcccccactccaccccccaacaccgcacccaatggcccgatcaccgacctcctccccaccctccccggcctttcggacctctaccctcccgctcccaactccactgcacatctctcctggggcctcctccgcccgctcctctgccgctccgacgcgctcccgggaacctctgcaggcgtcctcgaggcagccgaagcctggcggaatctcaccctggctgtcaccgccgcggcaagcgaggaggaggcgcgtctccaaggactccgctgctcatcgtccgtgggaggggatctacgcacgggacgtgccacactcccctgcgggctctcggagggcgcggcattgacggtggtcgggattctcagggagggggcggccaagttctgggtggaaatgctgggtgcgaacggtgaggttgtgctgcacgtcaatgtgagcctgggagccgcgggggtgttggtggagcagaattcctggacccaagaggtggggggggaaaaaatggaaaacctttccnaaaatttgggaaacgggggaagcatatgaacaagcttgcccgcattgaaaaatcgaaggccgtgctccattaagacgaaaa

SEQ ID NO: 91294 - protein, 205 aa, Zea mays
  misc_feature: Ceres CLONE 1579596
  misc_feature (197)..(197): Xaa is any aa, unknown, or other
MKKCSGVLFILTLAVVLFLLSPSPSPTPPPNTAPNGPITDLLPTLPGLSDLYPPAPNSTAHLSWGLLRPLLCRSDALPGTSAGVLEAAEAWRNLTLAVTAAASEEEARLQGLRCSSSVGGDLRTGRATLPCGLSEGAALTVVGILREGAAKFWVEMLGANGEVVLHVNVSLGAAGVLVEQNSWTQEVGGEKMENLSXNLGNGGSI

SEQ ID NO: 91295 - DNA, 1149 bp, Zea mays
  misc_feature: Ceres CLONE 1579597
  misc_feature: Encodes the peptide sequence at SEQ ID NO. 91296
  misc_feature (97)..(97): n is a, c, t, g, unknown, or other
  misc_feature (766)..(766): n is a, c, t, g, unknown, or other
  misc_feature (781)..(781): n is a, c, t, g, unknown, or other
  misc_feature (1149)..(1149): n is a, c, t, g, unknown, or other
tttttctccgcttgtctttactgaagataattgttcggggcaataaatattggtgctcagacttgatttaagaattataaaaaactggaactcaccncggtggcggccgctctagactagtggatcccccgggctgcaggaattcgtctcacccctagaaaaaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacgaagaacgacggagcggcgccggccagcgaccccgacaagctcttgagccctgcttgccgtccgccgccccatgaagcctccccaatcaatcggggcaaccttgccaccctggaatggggggaacattcccccctaccgtggatccccttcggccggccggcttcggccaactcaggggtaacgagccccccgcggaacacctggaaatggcctggacttccccagcccccttcgaaggctggccctcaattggactccggagaacctcccgtntcggagattgagganttcctataccggatatggaggacccaggacgggctgcggttatcgaaccccgcgaagaaggaccccagcgtgtgtcatttccccgcgcaacccccttaaacacgaaccccaccccggggctcctttaccttccctattcccaccggaccccccggtgagtcttatccccccttggggagtggggcccgcgaaacaatttccaggtgcccggtttataaatggggcgtgcccaatcccggaaaccctaaggtggggcttattcagcggtccccctttacgcggggcgaaacccaaactcttcttcctcataaagcgatgccccggaaaacatcttgtggtcctccaccgtgtgcgccccggtggccatn

SEQ ID NO: 91296 - protein, 178 aa, Zea mays
  misc_feature: Ceres CLONE 1579597
  misc_feature (146)..(146): Xaa is any aa, unknown, or other
MAAQLHHALYELLHEAAAAQRALLLAIPFSLLLLPLLLRYLAASASASATKNDGAAPASDPDKLLSPACRPPPHEASPINRGNLATLEWGEHSPLPWIPFGRPASANSGVTSPPRNTWKWPGLPQPPSKAGPQLDSGEPPVSEIEXFLYRIWRTQDGLRLSNPAKKDPSVCHFPAQPP

SEQ ID NO: 91297 - DNA, 876 bp, Zea mays
  misc_feature: Ceres CLONE 1579602
  misc_feature: Translation starting site: 449
  misc_feature (838)..(838): n is a, c, t, g, unknown, or other
ggagctccccgcggtggcggccgctctagaactagtggatcccccgggctgcaggaattcgtctcacccctagaaaaactgactcccacgggccacggtcctgctgctcgcctgctcctcccaagaaatgcctgtctggtgcggttcctgagggagaggatcgttccatgatgcacgggaggaggaagaacacactggagatggctcgggagcatccgcaaccgccgccggtggcagcggcggcggcgtcggcggccagctccaaaggccaagcatggttctgcactcacaggattgcccaacgatgtagtgatccaggtgggagacatgacctttcatctccacaagttcccgttaatgtcgaggagcaagaagcttcaccacctcattacgaacaaggagtctcgcgaggccatccggagaggcagatgagcagagcaagaataggatgtgggggagatcagagaggatgaagcggaccttgtgctggatgaggaccagagaggcgggcgtgcaccgcatccacctcctggagttccccggcggctctgaggcgttcaagctggccgccaaattctgctactgcgtgaagctcgacctcacaccggccacagccgctccgctgctctgcgccgccgagcgcctcagcatgtctgactaccactcggacgacaacctcgtcatccgcgccgaccggttcatatcacacaccgtgcttaggaaccccacggatgccatccgcaccctcaagtcctgcagaggcctgctccccctcgcctacgacatacggctcctgtcgcgctgtttaggaactttcgccaccaaagccgcctcgtcnacgacccacggagtcatcagctggtccatcactgacta

SEQ ID NO: 91298 - DNA, 1330 bp, Zea mays
  misc_feature: Ceres CLONE 1579604
tttttgttgccttttttctttcgggacgcaaatggcgcgttacccaatttaaatagagggagcgcttgtttaaaaaaatcaaactgggactccccccggtggcggccgctctagaatagtggatcccccgggctgcatgaattcgtctcacccctagaaaaagcggctttaccctcctggcctcctgtcctgccctgcctttccccccgcatgctctcgctcgctctctcgttctcgtggttctcccgagtcccgtgccgctcgagtgcgccgtctgcgtctctagtggcgacgactgggcgaccgccgccgccgccctacgcaaggtgcccagctctccattttcggtcccttcgccggacacgagcacccgccaggataatatgttgtccacgcaatgaggcaaatgctgatcagtttgatcttctttcttatggtaatctaaggggactagaggctcagagaagttctgaggaatcttattcccgacacgacttcaaggatgggtcttcagttcctttctgagaacttgcggatccctcttgtcctgcctgggcgagagcctatcaaatcttgccccacgccgcatcactgaaaaaacccaaccctccttttcggggagtggttagaggaaatggccccaaagatgtagccttgggaaaaaccgtttcccaaaaagagtagaaaccagcgaattccacgcctgggtacccgcgtagcgggccatatatatatttacccctttcctatcgatagagcaatcaacacaccaccccccctctattgtgagacactcctagagcgtggcacaaacaagcgctgcgccggggaataaaaaatgaaaggtgctgccttcttggccggggttcccccagacggggcctgttcttgttaacctgatactgattctgaaatggggaggggaaaagttttgtgtgggtcttttctgggcaaaaggaaatgtttagagaaagaccccacacactcccgaccagaagaaagtgatagcctggcgttgccgcccgcggcgacccctgaaacggtcatcaaagttggggtgtaggccccccacccccacaataggaccccatggcccatagagagtgcggtcgtcgctgttttagcacgtgtggcagtgctcacccgccaatttgttgcactctcgtttgactgcaaacgcccacatctgcaatagggccaacaattgctcgcccggtgcgagggaaaataaattgtttgtggagcaacagcgaggcttgtgtcatatgtgggggggtgatatgtctacagggtgtcgcacgaagatgtgttagagctgtggtgacgagag

SEQ ID NO: 91299 - DNA, 940 bp, Zea mays
  misc_feature: Ceres CLONE 1579606
  misc_feature: Encodes the peptide sequence at SEQ ID NO. 91300
  misc_feature (835)..(835): n is a, c, t, g, unknown, or other
  misc_feature (861)..(861): n is a, c, t, g, unknown, or other
  misc_feature (871)..(871): n is a, c, t, g, unknown, or other
ctggagctccccgcggtggcggccgctctagaactagtggatcccccgggctgcaggaattcgtctcacccctagaaaaagtgccagccagtcactctcgtccgccgcagatcgagaagccaccaccaccaccaccaccaccgcatggccatggcagcccagcagcaccggcaccacaagcgccgccgcatcgccctctccccctccccgtccccgtccctcgcgcccatccccggcgcccccacgccgccgctcgactcgctggccgacgagctcctcttcctggtcctggaccgcgtggcccaggccgacccgcgggcgctcaagtccttcgcgctggcctcccgcgcctgccacgccgcggagtcacggcaccgccggacgctccgcccgctccgcgcggacctcctgcccgccgcgctggcgcggtacccgtccgcgacccgcctcgacctcaccctctgcgcgcgcgtccccgacgccgccctcgcctccgccgccgtctccggctcctccgccctccgcgccgtcgacctctcccgctcccgcgggttcggcgccgcgggcgtcgccgcgctcgccgccgcgtgcccggacctcgccgacctcgacctctccaatggggtccacctcggggacgccgcggcggccgaggtagcgcgggccagggcgctgcggaggctctcgctggtccgctggaagccgctcaccgacatgggcctcggatgcgtcgccgtcgggtgcacggagctgaaagacctctcgctcagtggtgccttggactcacggatctggggaatcagctcctcgccctcagtgcaggaagctcaccagnctggatctctcctacaccatgatcancaaggatagnctgccttctatcatgaagctacccatcttcagagctgaacctggggggggtgtatgggaaacgatgagg

SEQ ID NO: 91300 - protein, 239 aa, Zea mays
  misc_feature: Ceres CLONE 1579606
  misc_feature (229)..(229): Xaa is any aa, unknown, or other
  misc_feature (237)..(237): Xaa is any aa, unknown, or other
MAAQQHRHHKRRRIALSPSPSPSLAPIPGAPTPPLDSLADELLFLVLDRVAQADPRALKSFALASRACHAAESRHRRTLRPLRADLLPAALARYPSATRLDLTLCARVPDAALASAAVSGSSALRAVDLSRSRGFGAAGVAALAAACPDLADLDLSNGVHLGDAAAAEVARARALRRLSLVRWKPLTDMGLGCVAVGCTELKDLSLSGALDSRIWGISSSPSVQEAHQXGSLLHHDXQG

SEQ ID NO: 91301 - DNA, 872 bp, Zea mays
  misc_feature: Ceres CLONE 1579608
  misc_feature: Encodes the peptide sequence at SEQ ID NO. 91302
  misc_feature (599)..(599): n is a, c, t, g, unknown, or other
  misc_feature (605)..(605): n is a, c, t, g, unknown, or other
  misc_feature (753)..(753): n is a, c, t, g, unknown, or other
tggagctccccgcggtggcggccgctctagaactagtggatcccccgggctgcaggaattcgtctcacccctagaaaaagcctccgtctgctctgctgccctgctggcttggtctggcgttacggcggcctcgctgctggcgctgttcggtggtttggaccaaccgatcgaggaagactatcgtcatcacccctcctcggcgccactcaccatcaccaccaccaccgggcgtcaagggaagaaggcgtccccgaggccgagcctgctcttaccgggcttggggagcgagcgtccagcaccagcaggctaggccggcggccgattgaattcctcgtcgaggcccccctcggcaataaattggtgcggggatttcctccctgacctaaccggccagccagcaggtcgcggtcgaggttctcttctcggcttgatttcctcccgcggcggagggccggccggggtggagcatgcgtcgcgtgcgggtgtcctcgcaccaggcgcccgtccacaagctcggcgacggccagatgaagctgacgccgaggttccgcctggcggcgacccccgcgccgccgggtccggatccggacccgcagcangcgtcntgggaggcggcggaggcgctgatcccggggctccccgacgacgcggcgctgaactgcctgctgcggctgcccgtggagtcccacgcgcgtgcaggctggtgtgccggcgcttgcgccatctcctggcagacaaggcccggttctttcncgcaacggcgggcgctggggcttcccccgccctggctgttcacccctgcgttccacccctgccgggccaaaaccaggggaaggggctggacctggggcaacccaactggcccgccttct

SEQ ID NO: 91302 - protein, 135 aa, Zea mays
  misc_feature: Ceres CLONE 1579608
  misc_feature (44)..(44): Xaa is any aa, unknown, or other
  misc_feature (96)..(96): Xaa is any aa, unknown, or other
MRRVRVSSHQAPVHKLGDGQMKLTPRFRLAATPAPPGPDPDPQXASWEAAEALIPGLPDDAALNCLLRLPVESHARAGWCAGACAISWQTRPGSFXQRRALGLPPPWLFTPAFHPCRAKTRGRGWTWGNPTGPPS

SEQ ID NO: 91303 - DNA, 1199 bp, Zea mays
  misc_feature: Ceres CLONE 1579610
  misc_feature (46)..(46): n is a, c, t, g, unknown, or other
  misc_feature (47)..(47): n is a, c, t, g, unknown, or other
  misc_feature (61)..(61): n is a, c, t, g, unknown, or other
ggaggaggagaattaaaagccggggggttattggtaggggtggccnntattgttgtgtttnggcccgggcgggcccaaaatgggactccccgcggtggcggccgcttttcaacagtggatcccccgggctgcttttattcgtctcacccctagaaaaaaccacacaagctaagcgtgtctaccacactgtagccggaggccggagcaagttgtagatgtagcccaggacgatcctgcaggtagctagcagtgcaaagccgatcgatcagcaaggtactgctctcctagctagcttagctactaccagctccgatcctgtccgcgctgctgccgccatggagaatccctacacgagcttcttcaacagccatccgcagcaccaccgctactactaccaccccgcgccgccaccgccaccgtcggcgccagccgcctaccacccctccctgcctttcttcgctgcgcaccgccagccaccaccctgctccgacggcgcccgccccgccctcggcccccgctccggggaagccctgaccgctggctctccctgggcccccaccgcgggcattgagggagcggccgcgccccgagcccaccgggcaaccaagccgtttgggaagggattccttgaaagagaaaccgggcccggggaacgaagggggagaaaagaaagaaatctagggaagggaaagggttgggaaagggggcccccccaacccggcgcggaggccaaggcaagaccccaaccgggggccccaagacataacccaaaggccgggcccccttggggggaaagagttggggggggaaaccggaaacccaggcccgaaaaggggaggttttccctttgtcccggccccggaaacaccttgtgtaaaaacgcccccaaatccctgcccgggaccgggggggggggaaccaggatatggaaacccaacaccccggaatgggggaaacgcttggggaaagggccttgtaaacagggtctttcccgggggcgttcccaagaacttccacgcagagaccggggaggggggatcgaacagtgggaaaccggttggggacgtccctgcgcacacattcttggggcccgagccccgccctggccctggaaataccctggccctatggaaacagggggcgtcccgccggccccggaaaatctggggtgcctctggggcgcgtctccctccgtttcg

SEQ ID NO: 91304 - DNA, 1093 bp, Zea mays
  misc_feature: Ceres CLONE 1579611
  misc_feature: Encodes the peptide sequence at SEQ ID NO. 91305
  misc_feature (65)..(65): n is a, c, t, g, unknown, or other
  misc_feature (1093)..(1093): n is a, c, t, g, unknown, or other
attttctttatataccaattacacgaaggaaagatttaaaatcctgtaccacccaaaaaaacatnttaaaaaaaaaacaaaactggagctccccgcggtggcggccgctctagaatagtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcggccgctgaagggccgtccgtttgacccccccggccgattacagaccaccaaaaaagagggtggttccactttccgcaaaggggcaaagagccgaaggcgccaaccaagaaccatgaaaggaaaactggctggggcgggcaaaggggacgcggaaacccttgggcgcggagaaattgggcgaagccattcgggggcctgtttcggggtgggcccgccccaagggggtttccaacggggtggtttcaaaccggaaagggcctttgcccaacgcaagttaaccctaggggaacccccccggaggagggtgacccctgtccccccgagcggagggggctccttgggggccccgaaaaatttgttcgcacccggcgcctgtaaatatgggcgtggaaaagaaaaaacaatggggggcggccaaccctctggggggcgaaacctcggaaagggcgcccgcgttacctgggtgttttcccgttcgcgcttacctgggggcctgcccggttggtccaatggcccccgcgaatgaattgggaaaacacggggctcan

SEQ ID NO: 91305 - protein, 90 aa, Zea mays
  misc_feature: Ceres CLONE 1579611
  misc_feature: SWISSPROT Homolog: EC 2.7.9.1 Pyruvate, phosphate dikinase
MIVQPIELRAWTAFPGSAQEGIGRMTASVSRAICVQKPGSKCTRDREATSFARRSVAAPRPPHAKAAGVIRSDSGAGRGQHCSAAEGPSV

SEQ ID NO: 91306 - DNA, 852 bp, Zea mays
  misc_feature: Ceres CLONE 1579615
  misc_feature: Encodes the peptide sequence at SEQ ID NO. 91307
caaagctggagctccccgcggtggcggccgctctagaactagtggatcccccgggctgcaggaattcgtctcaccccctagaaaaagagttgaaattgggatatataaaatctccaccacctccgaccctcctgtcccgctcctcttctatctgttcgtttacagcccccagctcatcaaagatcacatttttgggcactgctatataaacaaagttggcaggagtcgtagattagcaggccgcccgtctatatttttttttcatgttttgaaagtgaaggaggatttgggtgggcaacgtctacctctgccaaaaataatcggcgtccatatgcaggcgtcgtatctttggaataagtgaatagcaggcagatggcaggcggcggattcgtggaggacatgaacatgatgagggagcagagcctcctcgaggcgacgtgcggcgacctcttcgaccacatcgacgacctcctcgacttccccaacgaggactccgccgccgccgtgctcctcctggacgcgccggcgccggggagcccgctgtcggcgcgcatcatcgacgtcggccgcgccggcaatgcgctcgccccgcctgctgcccccgcgcagcacgacggcttccgctagcgccttctttcgcggcgcggggaaacgatgtgttcgacaccaaaggacgtcgttcggcgcacacatcgggctcggggcgacgaacattgacatggacatgggcgcaaactgggagtggggtattgggggcttctttcgacaaacgccttcattcccgaaaagaagcccggggtttcccctgggccccaacacgggggggcgggcgacggacccccccatttattc

SEQ ID NO: 91307 - protein, 84 aa, Zea mays
  misc_feature: Ceres CLONE 1579615
MAGGGFVEDMNMMREQSLLEATCGDLFDHIDDLLDFPNEDSAAAVLLLDAPAPGSPLSARIIDVGRAGNALAPPAAPAQHDGFR

SEQ ID NO: 91308 - DNA, 1009 bp, Zea mays
  misc_feature: Ceres CLONE 1579619
  misc_feature: Encodes the peptide sequence at SEQ ID NO. 91309
ctcaccgcggtggcggccgctctagaactagtggatcccccgggctgcaggaattcgtctcacccctagaaaaaactctcgaaaccctagtcccctgctccattctcagccgccgccaatcccttcccgtgctccgcaaccgctgagtgagaagaagagatggccggcaagggcgatggcccggctatcggcatcaatctcggcacgacgtactcttgcgtcggcgtgtggcagcacgaccgcgtcgagatcattgccaacgaccagggtaaccgcaccacgccctcgtacgtggccttcaccgactccgagcgcctcatcgggagatgcggccataaacctggttcgcccggaaccccgtcaagagcgtgtgttgaatgccatgtgtttcattgtgcaggacgtccagttgatgcgtctggttcccagatgttatcatgggtgtgggctgcttccaggtgcagttatagggggggctgggtgtagaaccccattgttttggtggttccacacctcccacgggtggaaaggagaatccaatgtttgtggcgaactgaatcgaaggatgccccctctcccttgggccgacccacccacccgaaagttcttttggagactactgttaggggataacaagcgcctccccctgctgtggtggttcctctcatgactgccgaaagtaatagggtgcccggcgcggggggtgaggagttagtctcctgtgtggggtcagcgtcgtttagcactttctctctcgcccggtggaacagtgtcagtctccccccatagcagtgttcttctggcggggggtgggggtgtagcatcgggggcgcccctctatttgttagtgcgtgggggccaccttcctgcttcatgaaagggtgtggaatcttttgtttatgatatgctgccgcatgtttggagtgccgtacgtaatagtgggcttcaccattcgagagtcgcagtagagttagagagaaattcctccttactgcctatgtgtctggaa

SEQ ID NO: 91309 - protein, 108 aa, Zea mays
  misc_feature: Ceres CLONE 1579619
MAGKGDGPAIGINLGTTYSCVGVWQHDRVEIIANDQGNRTTPSYVAFTDSERLIGRCGHKPGSPGTPSRACVECHVFHCAGRPVDASGSQMLSWVWAASRCSYRGGWV

SEQ ID NO: 91310 - DNA, 936 bp, Zea mays
  misc_feature: Ceres CLONE 1579620
  misc_feature: Encodes the peptide sequence at SEQ ID NO. 91311
cctagctggagctccccgcggtggcggccgctctagaactagtggatcccccgggctgcaggaattcgtctcaccccctaaaaaaagagttgaaattgggatatataaaatctccaccacctccgaccctcctgtcccgctcctcttctatctgttcgtttacagcccccagctcatcaaagatcacatttttgggcactgctatataaacaaagttggcaggagtcgtagattagcaggccgcccgtctatatttttttttcatgttttgaaagtgaaggaggatttgggtgggcaacgtctacctctgccaaaaataatcggcgtccatatgcaggcgtcgtatctttggaataagtgaatagcaggcagatggcaggcggcggattcgtggaggacatgaacatgatgagggagcagagcctcctcgaggcgacgtgcggcgacctcttcgaccacatcgacgacctcctcgacttccccaacgaggaactccgccgcccgcgtggctcctcctgggacgcgcccgcgccgggggaccccgcctgtcggccgcgccatcatccaacgtccggccggcgccgggaaatgtggcttcgcccccggcctggctgtcccccccgcggcagcaaaggaacgctttccggctagacggcctttctttccccgcccggcgggggaaaccgatgttgtttccgaacaccaaaggaaatttcgttccgggggccaccaacatcgtggttcgtgtgcgaacgaacaatttgaacttgggaaactgtggccgccaaccttgggaatgtggcgtaatccgggggggttctttctgaaggaaaaggccttgccaatccccgaagaagaagacggggggggtttccccctggggagacgaaacggggggggtggaggggctcggtctcccccccattactgttaaaa

SEQ ID NO: 91311 - protein, 92 aa, Zea mays
  misc_feature: Ceres CLONE 1579620
MAGGGFVEDMNMMREQSLLEATCGDLFDHIDDLLDFPNEELRRPRGSSWDAPAPGDPACRPRHHPTSGRRREMWLRPRPGCPPRGSKGTLSG

SEQ ID NO: 91312 - DNA, 900 bp, Zea mays
  misc_feature: Ceres CLONE 1579626
  misc_feature: Encodes the peptide sequence at SEQ ID NO. 91313
caaagctggagctccccgcggtggcggccgctctagaactagtggatcccccgggctgcaggaattcgtctcacccctagaaaaagctcgcaccgcttaatcaacaacctgacaagttagctacccgcgcagcgccgcgcgccatggccacgatgacgaaccaccgcattgtgcccctcctgctggtcgcggccacactgctcgcgcaggccgcggcctgcccgtactgcccgacgccgaagccgccgccgcctccgccgccgtcgtcgtccacgccgtgccctcccccgccctactcgctgtcgccgtccacgccgacgggcaagtgccccgtgaacacgctcaagctgctcgcgtgcgtggacgcgctcaacggcctcgtgcacgccgtcatcgggaccaaggccagcgacacctgctgcccgctgctctccggcgtggccgacctcgacgccgcgctctgcctctgcaccacatcaaggccaggcgctcagcgtcagcctcgtgctccccgtcgccatctcggtgctcgttaacgaagtgcggaaagcacgtgccctccagctttccagtgcccgtaatcaaaaggacaacaataagccccatactgatcatcggcggcaataattggctagcccccttggagggtcccccccccttaaccttattccccgggctggcctcagggctggggggaaaaaaggggttaaaccgcggccaaagttttcccccccccattttttccaaaatttaatagtctttataagccaaaaatgtggtctctcccgggagccctggggtggggggctttttttaaaaagggccccggtgttaatatttttactacaccccccccctaaaaaattggcctctttgagggcccctcttaaaaacctccaa

SEQ ID NO: 91313 - protein, 130 aa, Zea mays
  misc_feature: Ceres CLONE 1579626
  misc_feature (62)..(125): Pfam Name: Tryp_alpha_amyl Pfam Description: Protease inhibitor/seed storage/LTP family
MATMTNHRIVPLLLVAATLLAQAAACPYCPTPKPPPPPPPSSSTPCPPPPYSLSPSTPTGKCPVNTLKLLACVDALNGLVHAVIGTKASDTCCPLLSGVADLDAALCLCTTSRPGAQRQPRAPRRHLGAR

SEQ ID NO: 91314 - DNA, 871 bp, Zea mays
  misc_feature: Ceres CLONE 1579627
  misc_feature: Encodes the peptide sequence at SEQ ID NO. 91315
ctccccgcggtggcggccgctctagaactagtggatcccccgggctgcaggaattcgtctcacccctagaaaaaaggtgtccctccctttactccctccgccctcccacagtcccactgcccttctcctcggtccatcgcaagctcctgcggacctgcctacggccgtacggcggcatccacccttctgccgcatcgtctttctcaagacgctgccccaggtccatcgcgcctagggttcgccgagtccggcggcgctaagataatgagtgggcaccgaaacagtcatggaaagcgctactctgattatactgaaactggaggcggtaagagaagaaatcctggtgatgatacctatgcccctggtcctgatgacactgtgtatcggtacctccgcgcctctagaaaaattgggagtatcattggcaggggtggagaaattgcaaagcagttgaggactgagacccaagctaagatcacgattggtgagagtgtccctggacgtgaagagcgagttagttacaatattagctcaagtcgaagaacgtataccatctatgatgctgaagataaggtttgccctgctcaggaagccctctttaaagttcatgagaggcttggccactgatgaaaattttggtaacaaagacaccaaaaaaatctcacctcaagttactgtttccccgcctttggccataaaacccgattgggaagccttccttggaaaaaagggggggacttcttcccaaggaaacccccgtggggaaactggtggcgaaaaatccccccgctataaaaaagggaaccaatccccgggggaggtcccctatggggggggagaaaaaacttccccccaaaaatttgggggggac

SEQ ID NO: 91315 - protein, 120 aa, Zea mays
  misc_feature: Ceres CLONE 1579627
  misc_feature (39)..(104): Pfam Name: KH_1 Pfam Description: KH domain
MSGHRNSHGKRYSDYTETGGGKRRNPGDDTYAPGPDDTVYRYLRASRKIGSIIGRGGEIAKQLRTETQAKITIGESVPGREERVSYNISSSRRTYTIYDAEDKVCPAQEALFKVHERLGH

SEQ ID NO: 91316 - DNA, 1121 bp, Zea mays
  misc_feature: Ceres CLONE 1579632
ggagctccccgcggtggcggccgctctagaactagtggatcccccgggctgcaggaattcgtctcacccctagaaaaatgccgtacgagaagaactcgcctatgattaccgacaaaagcttgtagcaggcgatggctgcttctgccattgtcgggggaaccaattgcctaggccgtgtctatagacttagcatgaagacactatactgttcaacgcttggatgcagaactagaggtttctacagctgtgtaagctgctgaccgatttaggtggtacatttacttatcctggatcctaatgcccatcttgcacctctgcagtagttttgacaaccatgtactgaccatgatagaacactgacatattcatgcacatgactttatattttcgttcaccaacaacaacctatctaatccccttttacaaacaaaaaaaccctccgacgtcaactgctaaattgaagaatgttatcaacctttatttattcttggggcctagatccaaaaaagtgggaaccggaaccttagaagcttgaaacatccacaaagggagcccgactttgccccttttttccaccctcctttgttttttcccctagcccccctgggaatggttttttaaatcctcccccgcttatgttttcccctacaccaagtgtgatttctttagacctccacaccctttaatcttgttgtttcgcttcccctacaaaaatatatacccctttccccctcctctagatttgtttaaaataccgcacctcgtgttttacaaaaaaactctcaaaactcccccacaaagcgacaatggcttctttatatattgagaacatttggagggcgacctaatacccccagtgtatatcctccctgtttcgcccttccatattcttttagaaggctctttctcacaccccccccttatatataactattcgagccgctggtttctcttcatctcgaagagcacatttttaccctcactattaatcacttttacatcccctctatttaccttcttgctgccccgccttatactccgataaataagaggcttcgccccctcttctttaatataaaatactctcgctaactttgttgtattatcgtaaataataacag

SEQ ID NO: 91317 - DNA, 896 bp, Zea mays
  misc_feature: Ceres CLONE 1579636
  misc_feature: Encodes the peptide sequence at SEQ ID NO. 91318
  misc_feature (828)..(828): n is a, c, t, g, unknown, or other
ctggagctcaccgcggtggcggccgctctagaactagtggatcccccgggctgcaggaattcgtctcacccctagaaaaacccgcatgatgggtacaccatctgcaccacttccaccattgccacatggatctgttagcgatagagagagccactctatgcctgaagcagcaaaatttataaatagccaatcagtaatggccatgtcatcgctaatgccatctgcttcaatgcagtcaatgactgagatagcagagaatagtgatggcactggcaggaaaatggcacacaacagaagtgtttctgagccagacttcggtagaacatcaaaacagggtggtggatcagatggcacacagagcagtgcagcaggatctggcagttctcgatttggttggctagtgcagaagactatgggattagtgtcaaaatctcaccgccaggcaaaattaggggatcagaacaaattttactatgatgaaaagttgaagcggtgggtggaagaaggtgctgtggttcctgccgaggagcctcctcttcctccccctccaacaaaatcatctttccagaatggtatgccagaccataagttgaatggccacatgagcgtaggccatgctcccagtggagtcacagaatggaaatcctcaaattattcagagcaaggtctgggtatgccgccaattccacctagccaaaaccagttttcttctcgtgggcggatgggtgtccgatccagatatgctgacacattcaataaatcaggtgcatctggagcggtgccatcatataacaaagcagctgctccatccgtgacaacacccagctntgcccaggtccttcatacgaactgcagcacctgttgctgcagatcagatgatgccacaccaagcagca

SEQ ID NO: 91318 - protein, 269 aa, Zea mays
  misc_feature: Ceres CLONE 1579636
  misc_feature (247)..(247): Xaa is any aa, unknown, or other
MGTPSAPLPPLPHGSVSDRESHSMPEAAKFINSQSVMAMSSLMPSASMQSMTEIAENSDGTGRKMAHNRSVSEPDFGRTSKQGGGSDGTQSSAAGSGSSRFGWLVQKTMGLVSKSHRQAKLGDQNKFYYDEKLKRWVEEGAVVPAEEPPLPPPPTKSSFQNGMPDHKLNGHMSVGHAPSGVTEWKSSNYSEQGLGMPPIPPSQNQFSSRGRMGVRSRYADTFNKSGASGAVPSYNKAAAPSVTTPSXAQVLHTNCSTCCCRSDDATPSS

SEQ ID NO: 91319 - DNA, 842 bp, Zea mays
  misc_feature: Ceres CLONE 1579643
  misc_feature: Encodes the peptide sequence at SEQ ID NO. 91320
  misc_feature (765)..(765): n is a, c, t, g, unknown, or other
tggagctccccgcggtggcggccgctctagaactagtggatcccccgggctgcaggaattcgtctcacccctagaaaaaactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggtgtcctccctctcaaggacctcttcctcatctggctcgtcaccatcacctgcaccctgccgatccagtctctgttccccttcttgtatttcatgataagggatctgcatattgctaaacaaacacaagacattggattttatgctggttttgttggcgcttcttatatgtgtgggagggcagtctcctcaacagtatggggaatcgtggctgataagtatggaaagaaaacagttattcggacttgacccttattggcaaaaattatcttccaaaaccaaggtttggaactaagccccaaactattggaaagggctttaaatcaaacaaatggcctggcttggaaaacaaaggggaggggttaatnccgggggccaaattaaagaggttaaagcccaacagaaaaatttggcccccaaaaaagaaaacccaaaccccccccgg

SEQ ID NO: 91320 - protein, 122 aa, Zea mays
  misc_feature: Ceres CLONE 1579643
MGGGNGETTQLGEPLLAKKAKAYRPRCPGCRVDRLNAEREGVLPLKDLFLIWLVTITCTLPIQSLFPFLYFMIRDLHIAKQTQDIGFYAGFVGASYMCGRAVSSTVWGIVADKYGKKTVIRT

SEQ ID NO: 91321 - DNA, 822 bp, Zea mays
  misc_feature: Ceres CLONE 1579646
  misc_feature: Translation starting site: 242
  misc_feature: SWISSPROT Homolog: EC 1.1.1.22 UDP-glucose 6-dehydrogenase
ctccccgcggtggcggccgctctagaactagtggatcccccgggctgcaggaattcgtctcacccctagaaaaagcacacaggcccgctacactggtcgtcgtaggcagcgagcgtctctcctctcccacgcatcccgccaaggaagagagagagatcgccgctccccttctcggcgtcggtggtgcgggtgccctccctcctcgagcgagatctgtctggtcacagatctatctgacaaaatggtgaagatctgctgcatcggtgctggatgtatcggtggcccagccatggccgtcattgccctcaagtgctcagacattgaggtcgtcgtcgttgacatcatcaagccccgccattgcagactggaatcagtgacactctgccaatctacgagcctggtctcgatgatgttgtgaagcattgcaagggcaggaacctcttcttcaccactgatgatgagaacacgtcgctgaggctaaataatctttgtctcggggaccccccccccaaaacccggggctttggactggcaaggttgcccaacctccctacggggaaagggctccccgcagaattccgaatgtccccagtctaaaaaaaattttgtttagaaattcaatggccccttcaaaaccctttaggcttttggaaaaaaattttgcccccaaaaagaagggggttcaacttcccaaaacttttttcccccccagattttctttggggggggggcctttctctttttgggcaattttttccacccctctaaaaaggggtttttttgggggggggcggggagcaccccttctgggggggagagggg

SEQ ID NO: 91322 - DNA, 1320 bp, Zea mays
  misc_feature: Ceres CLONE 1579648
  misc_feature: Encodes the peptide sequence at SEQ ID NO. 91323
  misc_feature (1283)..(1283): n is a, c, t, g, unknown, or other
  misc_feature (1320)..(1320): n is a, c, t, g, unknown, or other
tgtttccttgttgtgatcacattttacctccttgtaattttctttagagtcttattccgttggcgttttttccaaaactggactccccgcggtggcggccgctctagaactagtggatcccccgggctgcaggaattcgtctcacccctagaaaaaaccaccagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccatgtccgcggtggcagcgctgccgtccgtgagggtgggcaggaagaggtcgtcgtcgcagggcatccgctgcgactacatcggctccgccaccaacctgatcatggtgacgacgacgacactgatgctgttcgcggggcggttcgggctggcgccgtctgcgaaccgcaaggcgacggcggggctgaagctggaggcgcgcgactccggccctgcagacgggtgacccccgccgggttctcccatctccgaaacactggacctgcgggcgcctgtcggaccaaatcacttcaggcgttcggcattcgttgcttcggggcttcaaagaaacaaccgggccgccccctccgaacaagaatttaatgccgggcttaagaattcccctttaacctcccagaccaatgtggttgtaaaaaaatctatataacccactggccacaggttttactcaaaatcctgcgtgcctagttgtgtagtaacaccatgtataagtcgtatttgctatagggtcatatgtcggtgcgcgtcggtggacccccgtattcggtcatggcacatacttaaagggggaccgtatgaatgtctgctcacgccatagaacactgggtccatgtattatttatgtgcactactacccgtaatgtactgtttcgcgacttaatactactagtgggagattgtctatgcgattgccagtctatctgtgttatactgcccctatcctgtctgttcgagatagtgtgtgatcactccttttgtcttgtctggcacatagttcagcccactctgttgtgcctcgcccgcggatgagttcttttgtgactaatccacgcattagtgccatgtccgaaagaatcgatgtgatatttatacttatccgcttgtgatgagcaagccacactcccttgtttcgtgtcaacgctgagatcgatatccgtcagtgccgtctatgagttagggcagatcggctgacantcgcccgatgttactagcaataatcttctctactaan

SEQ ID NO: 91323 - protein, 95 aa, Zea mays
  misc_feature: Ceres CLONE 1579648
MASQLSAAVPRFHGLRGYAAPMSAVAALPSVRVGRKRSSSQGIRCDYIGSATNLIMVTTTTLMLFAGRFGLAPSANRKATAGLKLEARDSGPADG

SEQ ID NO: 91324 - DNA, 881 bp, Zea mays
  misc_feature: Ceres CLONE 1579651
  misc_feature: Encodes the peptide sequence at SEQ ID NO. 91325
  misc_feature (821)..(821): n is a, c, t, g, unknown, or other
ctccccgcggtggcggccgctctagaactagtggatcccccgggctgcaggaattcgtctcacccctagaaaaaacgcttcgtccacagcccaactacccaagagcagagggcagaggatgcctcttgccgcaatggcgtcggcatcctcctcgccctgctcgcggcatcctctgatcttggtcgttctcttgtgcgccattgccgccatctctttctcttcctctgcggctgctggaaccgttggcggcggcacaggcggactgggccccatcagcaccaacgggaagaactacaccaaggtgtgcgaccccgcacggttcgtggcgctggggctcgacatgtcacgcttccggtactgcgacgcgtcgttgccgtacgccgaccgggtgcgcgacctcgtgggccgcctcgcgctggaggagaaggtgcgcaacctcggggaccaggcggagggcgcgccccgcgtcggcctgccgccgtacaagtggtggggggaggccctccacggcgtgtccgacgtcggccccggcggcacgtggttcggcgacgtggtgcccggcgccaccagcttcccgctcgtcatcaacagcgccgcggcgttcaacgagtcgctgtggcgcgccatcggcggcgtggtgtccacggagatcaggggcatgtacaaactgggccacgcggagctccactactggagccccaacatcaacgtggtgcgcgaaccacggtgggggcgcgccagcgagaaccccggcgaggaccccttcgtcgtcgggcgctacgccgtcaacttcgtccgcgaatgcaggagttgacgaacgnccctacccgccgccgcagacccgtttttccggcccataagggggccagctgctgaaacat

SEQ ID NO: 91325 - protein, 226 aa, Zea mays
  misc_feature: Ceres CLONE 1579651
  misc_feature: SWISSPROT Homolog: EC 3.2.1.21 Beta-glucosidase
MASASSSPCSRHPLILVVLLCAIAAISFSSSAAAGTVGGGTGGLGPISTNGKNYTKVCDPARFVALGLDMSRFRYCDASLPYADRVRDLVGRLALEEKVRNLGDQAEGAPRVGLPPYKWWGEALHGVSDVGPGGTWFGDVVPGATSFPLVINSAAAFNESLWRAIGGVVSTEIRGMYKLGHAELHYWSPNINVVREPRWGRASENPGEDPFVVGRYAVNFVRECRS

SEQ ID NO: 91326 - DNA, 870 bp, Zea mays
  misc_feature: Ceres CLONE 1579652
  misc_feature: Translation starting site: 359
ctccccgcggtggcggccgctctagaactagtggatcccccgggctgcaggaattcgtctcacccctagaaaaattttgggaagtttgacgaggtcctagagcctggatgccacttcttgccatggtgcatagggaagcaaattgctgggtatctgtcactgcgtgtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtttttgatgtcatcagggcaagtgttccgaagatgaacttggatgatgcctttgagcagaagaatgaaatcgccaaagctcccccaaaatgaacttgaaaaggcaatgtctatgtatggatacgagattgtgcagactctgattgttgatattgagcctgatgagcttgtgaagagaagctatgaatgagatccatgcagctgctaggctgaagttggctgccaaccagaaagctaaggcagagaatatactgcagatcaagaaaagccgaaagtgatgcaaaaaccaagtacttggcggggctgggtatccccaagacgcgcccaggctttatgtggaatgggctccaaagacaagtggtccttgctttcctccaaagaaagtgcccggggaaacctctgacaaagaatgtccatggaacatgggttttgtggtttacccccagtccttctccacacccctttaaaggaaatatttggggcgccctcctcacaagaaaccccggggcggaggttttttctaccccccctcagaggaaaacacagggtgtgttg

SEQ ID NO: 91327 - DNA, 971 bp, Zea mays
  misc_feature: Ceres CLONE 1579658
  misc_feature: Encodes the peptide sequence at SEQ ID NO. 91328
  misc_feature (889)..(889): n is a, c, t, g, unknown, or other
  misc_feature (906)..(906): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
agctccccgcggtggcggccgctctagaactagtggatcccccgggctgcaggaattcgtctcacccctagaaaaacaatggagctgtcaaagtcagattgggcttcaattagaaaatcacccccgtgggccattgattcttggggactagggtgtttaatctatgaactattttctggtgcaaagctggctagaacagaggaccttcgaaatactgcttcaatcccaaagtctctacttccagattaccagaggctcttgaattccacaccttctcgtagactaaatccttcaaaacttattgacaacagcgagtttttccagaacaagttagtagagaccatccagttcatggaaattcttaatttgaaagacacctttgagaaagacagcttttttcgtaaactccccaatatagctgaacaacttcctcgtgaaatagttctgaaaaagctgcttcctgtattggcttcttctcttgaatttggttcagctgccgctccagccttaactgttttgttaaagatgggttcctggcttcctgctgaccaatttagtatcaaggtcttgccaactattgtcaagctttttgcctccaatgaccgagctatccgagcatgtcttttgcatcacataaatcagtttggggaatcaatgtcagctcaaattgttgatgaacaagtttttcctcatgtagccactggcttctctgatactgatggtactattcgtgaactgacattgaagtcgatgctcgtattagcaccaaaatatctcagcgtacaatctcaggatctctcttaaaatatctctctagctacaggtggacgaagaacctggtatcagggacaacacacatttctcttggcatattgcaggctacatgacnatgggacaagaataaanattcnnnnnnnnnnnnnnnnnnnnnnnnnnnnnnnnnnnnnnnnnnnnnnnnnnnnnnnnnnnnt

SEQ ID NO: 91328 - protein, 241 aa, Zea mays
  misc_feature: Ceres CLONE 1579658
MELSKSDWASIRKSPPWAIDSWGLGCLIYELFSGAKLARTEDLRNTASIPKSLLPDYQRLLNSTPSRRLNPSKLIDNSEFFQNKLVETIQFMEILNLKDTFEKDSFFRKLPNIAEQLPREIVLKKLLPVLASSLEFGSAAAPALTVLLKMGSWLPADQFSIKVLPTIVKLFASNDRAIRACLLHHINQFGESMSAQIVDEQVFPHVATGFSDTDGTIRELTLKSMLVLAPKYLSVQSQDLS

SEQ ID NO: 91329 - DNA, 821 bp, Zea mays
  misc_feature: Ceres CLONE 1579660
  misc_feature: Encodes the peptide sequence at SEQ ID NO. 91330
ctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacaagcctatccgggtgatgtattcaaaccgtgatccaagcagccgcaagagtggatctgctaacattttcataaaaaatcttgacaagacaatagacaataaaacccttcatgagaccttttcttcatttggtaccattctctcatgtaaggtagccgtggatgaagcaggccaatccaaaggctttgggttttgtcagtatgacaaagaagaagctgcgcagaacgctataaaaagtcttaacgggatg

SEQ ID NO: 91330 - protein, 185 aa, Zea mays
  misc_feature: Ceres CLONE 1579660
  misc_feature (36)..(107): Pfam Name: RRM_1 Pfam Description: RNA recognition motif. (a.k.a. RRM, RBD, or RNP domain)
  misc_feature (124)..(185): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNKPIRVMYSNRDPSSRKSGSANIFIKNLDKTIDNKTLHETFSSFGTILSCKVAVDEAGQSKGFGFCQYDKEEAAQNAIKSLNGM

SEQ ID NO: 91331 - DNA, 963 bp, Zea mays
  misc_feature: Ceres CLONE 1579663
  misc_feature: Translation starting site: 165
  misc_feature: SWISSPROT Homolog: EC 1.4.1.2 Glutamate dehydrogenase
ctggagctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaacaggtcgccatgaaccccatcaacaccgtctttgatgccaagcgtctcatcggcaaggaggttcagtgatgcgtcctgtccaaagtggatttcaagttgtgggccttcaaagtcattttctggggccgggggaaaaacccaatgaatggttgtccaagcccaggggggaagagaaaaaccatttgccccccaaaaaaaatccccctccaggggtttcttttcaaaatgggcgggaaattgctgaagccttacccttggggaccccaatcaaaaaatggggggggtccacagtctcccgcgcctttttaaatgactccccaaaggggggccccaaaaaatatccccgggggggaatttccggccccctaaagggggggtgggtataacaaaagaacccaaaagcttggcggttttttccccttggggtttaaaaaaaaagggccccacggggggggggagaaaataaggccccccctctttttcttctgaggggggggcccttcttttttctcccccccccccccttaggaaggaaacttcttggaggaacggcgccccgggtggaacacccaccctctgtggggggggagggtgtttttccccaggagggggctcacccc

SEQ ID NO: 91332 - DNA, 905 bp, Zea mays
  misc_feature: Ceres CLONE 1579665
  misc_feature: Translation starting site: 277
ctcaccgcggtggcggccgctctagaactagtggatcccccgggctgcaggaattcgtctcacccctagaaaaaagagagccactcgtcacaggcttgacatgcctgaggatcggactagtcggacgaggaagctgcctgcttttcagatagagttcattggagatggcgttgcttccgctgcttgccctgatctccctgctcttcgcagaggccactcctgtccgggacatcgcccacgatgcctgctcgacagaagtgaaggatttccatcgccatgaacaacagctcggggctccacctgacgctgcaccacccgcagagcccctgctccccggcgccgctgcccgccgacctccccttctccgcggtgctcgcccacgacggcgcgcgccccccatcactcgccgcgcgcctcgccaagacgccgtcctctcggcccaccttgcttgacgagagccgcgcagggtcatcttctgcatcccccgatgactagtccctcgcatccgtgccgctacggaccgggcacgtacgtcgacgtgggcaactacgtcacccgcatgggcctcggcacaccggccaagtcgtacgtcatggtcggtggcacacggagacctcgctcacctacctccagtgctcccccctgcgtcctggcttgacccctccagtaccgcccgggtgttaacccccaggcgtccagctcctacacctccgtgtcctgcgtcggcctacactgcaacgacctcaacatcagccacggttaaccccggcctcctggtccgtcttcgaagatcggcctctaccaaggcaaactacgggggaacggttccttcctaggaccgggtatcttaaaccaggaaaaccaatgtgccttcttcgttcaccaaagggggccccagctttctt

SEQ ID NO: 91333 - DNA, 1159 bp, Zea mays
  misc_feature: Ceres CLONE 1579666
  misc_feature: Encodes the peptide sequence at SEQ ID NO. 91334
  misc_feature (1)..(1): n is a, c, t, g, unknown, or other
nttttcccacaattcattacacaaaaaaattaatatttcctttttccgtctctgcgtcaaggcccgccgttacaagctggagctccccgcggtggcggccgctctagaactagtggatcccccgggctgcaggaattcgtctcacccctagaaaaagcgagacgagccctacctaccactaccactcttgagcaccagccctctcgccttccgctcctccgtcctcgccgaaccccatggcccaaaaaccctgaactgagcccgtcgccgcttctccagtccgcacgaagcgccccacaaaatgcggcggctgacgccggcgtacgtgaccctcatcctggaccacgtcctgggcgacccctcgatccccaccgcagccgccatcgcggttaatcgccggtctcccctctccctccgatccgaccccgctcctccgccgcggggaccttctccgccgcctcgccgccgaccccgtctccgaaatcctctctcgaaaacctccacctcctgggcctcgctcccggccctgcgccctctcccatcgcaaccgcccaacatggctcgtcggcggaattatctcgggggccctccggccccccaaaatttcgaaccccggacgccccgggggatttttttttcgagggcggcccccctaacagggccccccgccgggggccccaaagcgggggcctcaaggggggcggggagagggtttccccccccagaaggcatttccctaaatcccgtaaaacaaagtgtccccaatgtcttatttcaaccacaaatgtgaaaaccccacaagttttccgaagagggattgtgcgcccctttaatggagataaaagagtcccctccctttttcctccaagaaaacccccccctcctttaggggggagaccctcagatggggtggagaaaaaaacgggggtgccccaccctcgtatggaagaagcaacaccgggggttcccacaggacaactttctccttccctacggccttgaaaaaaggggcccccccgccaattaggtgccccgcttctaaagggcttccaaagagccctgtttgatcatagtcgcggatatcccacaaggggaaagtgggccccgatttaaaaaaaagggggcctcccgcccaaaaaaaaagctcacaaacattctc

SEQ ID NO: 91334 - protein, 40 aa, Zea mays
  misc_feature: Ceres CLONE 1579666
MGWRKKRGCPTLVWKKQHRGFPQDNFLLPYGLEKRGPPAN

SEQ ID NO: 91335 - DNA, 836 bp, Zea mays
  misc_feature: Ceres CLONE 1579669
  misc_feature: Encodes the peptide sequence at SEQ ID NO. 91336
ctccccgcggtggcggccgctctagaactagtggatcccccgggctgcaggaattcgtctcacccctagaaaaactttggattgcagccgccccgccgcatcggcaccgcagccgccgcagtgccgcacagccgccactctcgtcttggtcttgcagccagttgccctccggtcgcggtcgtcggcccctcgcccgcgcgccgagacaccgagtcagcgtcgaccgtcgtcgtgtctcgccgagtcgctgtcgtcaccgaggtccagcgcccagcggcccagctccaagcctccagccatcggcgaccgccctcctccgccgagacgccgagtgccgagcgcccgagcaccccagtccccagcgcccaacaggctagcaagctacaagtatgcgctctttgttgatgcgtccaaggagttgagctgaatgcccagcaggctagcaggctgcagaaactgaaggaaaagccggcattcaggaacccggatgagttctattttaaaatgatcaatagtaggactattggtggaattcatagacctaagtatgtgcaatgtagcccctcggctcctattaactctagtattgtaaagtttggtctaccctgcattttagttttgactgtgtcatgcatttcaggcctgaagataataagtatactaaagaggaacttcttctgttgaaaaataaagatatgagatatatcccttcagagcgttcaaagtggaaaaaaaggttttaactttttaaagtattcattaggcaaaaaagtaccatttgggtgtccttggtgggtgaaaggttttacctaggttttaaaattggaatgggaact

SEQ ID NO: 91336 - protein, 59 aa, Zea mays
  misc_feature: Ceres CLONE 1579669
MINSRTIGGIHRPKYVQCSPSAPINSSIVKFGLPCILVLTVSCISGLKIISILKRNFFC

SEQ ID NO: 91337 - DNA, 1029 bp, Zea mays
  misc_feature: Ceres CLONE 1579671
  misc_feature: Encodes the peptide sequence at SEQ ID NO. 91338
tccccgcggtggcggccgctctagaactagtggatcccccgggctgcaggaattcgtctcacccctagaaaaatccgccctcttcccctcttcgactcacggcccacccactgcacgcgcaagcgagagggcggctccgcctccgtcccatggatggccgccggcgccacctcatggtgttcacggacgcggtcactgctaggtggtggtcccggcgtgctacatctcacgcctccagggcaggctccctcacatgggtcaccgtttcctcatggtgttcacgggcgcgctcatcgctcgcatcgtggagacgtccatctgcatctatgatccggaggtcttatgcgaggtggataatgcctcctcctctctggccaatacttctctaccagccccctgctcccgaggggaggggcgctgggatacaagcccgcagatggcgtccactgtgcaggcggtcttgatcgaccaagccacctcagatccgggctcatctacacgagggtgatagcctttgtatctcgatcctgctcagcatctcggaggtcttgcggagccagatggattcagtgccgggtaacaaggggttccctgactcccctccttatcccctaggggcgggaccaaaggggggcccaccgattgaggaagtcttaaagggtccaaaaatttgagtgtgaattgccgtttgccaggggtttagtaacctaaatttccctgagtgaaaattgaatgggtcaacctctccttttgacaaaggtacccaacatttgccgcaaaattttttttgctgttatatcaactcggttgcccgtttatgtcggccaatttcccggcttgtgtctgcctttttatgccctttaaaatttgataagcggtggctttccaataccaggacccttactccttagagtggggaatttttggaaggcaatacccgctcttggtgggattttccgaatacactcgtctttgtatggcgaatttcgcccctcgggttttaaagtaaaaaagaataaatatttctgg

SEQ ID NO: 91338 - protein, 104 aa, Zea mays
  misc_feature: Ceres CLONE 1579671
MDGRRRHLMVFTDAVTARWWSRRATSHASRAGSLTWVTVSSWCSRARSSLASWRRPSASMIRRSYARWIMPPPLWPILLYQPPAPEGRGAGIQARRWRPLCRRS

SEQ ID NO: 91339 - DNA, 845 bp, Zea mays
  misc_feature: Ceres CLONE 1579672
  misc_feature: Encodes the peptide sequence at SEQ ID NO. 91340
ccgcggtggcggccgctctagaactagtggatcccccgggctgcaggaattcgtctcacccctagaaaaaattgccattgccatcccattctcatcctagctgcagcgctctactaccgggagaatatcgtggcgtgagcggctccattaagtacagcaatgatgataatcccgagagggcgggcggcgccggcgcatggtccatggcggtgccggtggtgctcgtcctcgtcatgctctgcgcacttctacttctacgtgggctgcatctacagcacgggacggagactgatggactccatccagccagcgccgatggctctcctcgccctcggcgccgccaagaagaccctccgtaactacgacgacggtcagtctcggccggcactggctttcatggccgccatggcgttccccgagtgctccaccgattacctagactacttccggtgcatggaccccgagctctggtcgaggtacggttactacagcttgagcttcatggaacggtactgaacctcgtctctctaaacagtagtgttgctgtgtgcacgcgcataagggtacaagtctcccatcctgtgttccaattactaagaccagtggctgttccccgaactcccccttgagactggatgggcaaccaaaaatccttgccttcagtgggcttcataaaaaaagtgagaacggtttttctggtttcccgggcgtggggcaactatttttcccaaactagctttagggtcccctttaccttgggaactttccatttaaaggacctttttttcccggggctttttcagcgataaggggtttcctaggccgaacaatcccgcgggaatttg

SEQ ID NO: 91340 - protein, 118 aa, Zea mays
  misc_feature: Ceres CLONE 1579672
MMIIPRGRAAPAHGPWRCRWCSSSSCSAHFYFYVGCIYSTGRRLMDSIQPAPMALLALGAAKKTLRNYDDGQSRPALAFMAAMAFPECSTDYLDYFRCMDPELWSRYGYYSLSFMERY

SEQ ID NO: 91341 - DNA, 813 bp, Zea mays
  misc_feature: Ceres CLONE 1579673
  misc_feature: Encodes the peptide sequence at SEQ ID NO. 91342
  misc_feature (641)..(641): n is a, c, t, g, unknown, or other
  misc_feature (647)..(647): n is a, c, t, g, unknown, or other
  misc_feature (723)..(723): n is a, c, t, g, unknown, or other
  misc_feature (759)..(759): n is a, c, t, g, unknown, or other
  misc_feature (760)..(760): n is a, c, t, g, unknown, or other
ctggagctccccgcggtggcggccgctctagaactagtggatcccccgggctgcaggaattcgtctcacccctagaaaaaacccacccaaaattaaaatcctcccggaaatcagagacgcgaatccctcgccccaggccccgaaacctccgagttctctcgccaattcgatccgcctcaccgccgccgcccgtccgccggtcggccttgactgctccgtcgcacgtggcggttcgcagcgcggaatctaccttgtgttgagagatccggggaaacccttgttcccggtcgttccggctcgaatcttctgcggactggcaatgtaagcgttctccatcggagggcgacgatctacggggcggttgttggcggggttgagggaatggagcacgtgttcggagggaagtttaagcttgggaagaagatcgggagcggatctttcggcgagctctatctcggcgtcaacatacagagcggcgaggaggtggctatcaagttggaatctgtaaaatcaaggcatcctcagcttcattatgagtcgaaactatacatgcttctccaagggggaactggaattcctcatttgaaatggtttggggtgggatgggggagtacaatgtcatggtcattgatcttcttggntcaagntctggaagacgtattcaaccagtgcaacagaaagttttctcttaaaacagtacttatgctagctgatcagatgatnacctagggtagagtacatgcacacgaagggggtccnntcatcgtgatatcaagccagacaatttcccttgtggggcttaggtcgtaaaga

SEQ ID NO: 91342 - protein, 115 aa, Zea mays
  misc_feature: Ceres CLONE 1579673
  misc_feature: SWISSPROT Homolog: EC 2.7.11.1 Non-specific serine/threonine protein kinase
  misc_feature (87)..(87): Xaa is any aa, unknown, or other
  misc_feature (89)..(89): Xaa is any aa, unknown, or other
  misc_feature (114)..(114): Xaa is any aa, unknown, or other
MEHVFGGKFKLGKKIGSGSFGELYLGVNIQSGEEVAIKLESVKSRHPQLHYESKLYMLLQGGTGIPHLKWFGVGWGSTMSWSLIFLXQXLEDVFNQCNRKFSLKTVLMLADQMXT

SEQ ID NO: 91343 - DNA, 862 bp, Zea mays
  misc_feature: Ceres CLONE 1579674
  misc_feature: Encodes the peptide sequence at SEQ ID NO. 91344
ctcaccgcggtggcggccgctctagaactagtggatcccccgggctgcaggaattcgtctcacccctagaaaaagaccgccgcagcgtccccgccacgaccacgagcgaaaggaggtcgccggaagagggggcgcggagatgagcgggagcgcgttcaacgcgttcaagtcgcgggtgccggtggcgtggagtccccggctgtacatcacgctggtgcggggcctccccgggacgcggcgcctccaccgccgcacgctcgaggccatgcgcctccgccgctgccaccgcaccgtcgagcaccgcaccacgccgtcgctcctcgggatgctcacccaggtgaagcgcctcgtcgccgtcgagaccgaggagatgtacaacgcgcggaagcaggccgacgcggagaggcgcgcgcccagacccccgctcgtcgtctcccaccagccacagccgccggctccgaagccggcagccgccgccgcagtgggtgccgctaccactgcgcagtagcctctggtgagctcctcaagtcccgatttcgtcctggtgcgctctggttttccattttgtttgtttgtccattgattcaagcgtctgatgcaatgactcaaatcagtgcgcgtagattggcagtcaatataccgaattcagatgtttgtttccgatccaacattctaacacaatgaaatgtcttagtttcctggtgggttattatagctcttcccctagttcgtcatgtaacagaatgtaaggtgcagctctaaccacgttagagcaactcccaggagtagtctaaaatattagcctctcatggctggtggggtggatttgctagagtatccaagcagctgatttctattcgaa

SEQ ID NO: 91344 - protein, 122 aa, Zea mays
  misc_feature: Ceres CLONE 1579674
  misc_feature (20)..(71): Pfam Name: Ribosomal_L30 Pfam Description: Ribosomal protein L30p/L7e
MSGSAFNAFKSRVPVAWSPRLYITLVRGLPGTRRLHRRTLEAMRLRRCHRTVEHRTTPSLLGMLTQVKRLVAVETEEMYNARKQADAERRAPRPPLVVSHQPQPPAPKPAAAAAVGAATTAQ

SEQ ID NO: 91345 - DNA, 809 bp, Zea mays
  misc_feature: Ceres CLONE 1579680
  misc_feature (129)..(129): n is a, c, t, g, unknown, or other
  misc_feature (130)..(130): n is a, c, t, g, unknown, or other
  misc_feature (153)..(153): n is a, c, t, g, unknown, or other
  misc_feature (154)..(154): n is a, c, t, g, unknown, or other
  misc_feature (180)..(180): n is a, c, t, g, unknown, or other
  misc_feature (181)..(181): n is a, c, t, g, unknown, or other
  misc_feature (345)..(345): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (366)..(366): n is a, c, t, g, unknown, or other
  misc_feature (367)..(367): n is a, c, t, g, unknown, or other
  misc_feature (387)..(387): n is a, c, t, g, unknown, or other
  misc_feature (388)..(388): n is a, c, t, g, unknown, or other
ggagctccccgcggtggcggccgctctagaatagtggatcccccgggctgcaggaattcgtctcacccctagaaaaaattgcattgtgcattgcattgcataaacctctcgtgggaagtgcaaacaccnnaaatccgcaatctatctatctanntcagccattcaggggcctgcagggcnntgcagctctctccactgcacactagaagcgagctgccacagacaaggacacaatgccacccatacccaagagaggcgagcatctcctggtcctcctaattgtcgcatgcgctgccaccgcccgccacccgccgccgggcacccgtcccccttctaccccgtccngcggaagtcnnngccgccgcnncgcgcaactggcgacgggcnnacgctgtaccccgggaggctcctgccctggtcggacaacctcgccgggaacattcccgggaaccttaacaacaaagaaagcccggttcccccggaaacgttcaattcttgccggccgggcccgggggaaaccccccccacccccaaagggaaaccttgggggtgtggtctcccccccacacgtttcccaaaggaaaaaacctggggcctccgggaaaaatataaacccctggggcaaggggaaaaaaagggggttcccccctttgttttgggggcggccccccgggggaaaacccccccccccttgggggggccccaattttaaaaaaaaaaaaaaaatttggtgcccctttgggggaaaaaaatttttttttcttttgtttcccccaccccccccccccccaaatatatgtgggaggaat

SEQ ID NO: 91346 - DNA, 833 bp, Zea mays
  misc_feature: Ceres CLONE 1579681
  misc_feature: Encodes the peptide sequence at SEQ ID NO. 91347
  misc_feature (707)..(707): n is a, c, t, g, unknown, or other
  misc_feature (776)..(776): n is a, c, t, g, unknown, or other
ctccccgcggtggcggccgctctagaactagtggatcccccgggctgcaggaattcgtctcacccctagaaaaagtgttggtcgcctgtgccaaattccgctgcccggcggcgaatttactcctctcagcctctacttctcgggttcgagctcaacccggcgggccactgctgcgacaaaggactagcaaggtttcattgcgctcaattgctatggctaccacacaagcctcagaagcagctgctgacaaaggattgcctctggcagtggacgctaccatggttgatgagtatgcctcccagtcaaagttgctgcaagaatttgttaaaatcccaactattggcaaggcttggatcttcaattccaaggatgacgacatgtcaaaagcagtggtttcgattggcaaatcagatcttttggccaataagaggagacaattccttttgaatactcacatttcaaagagtccctcaaagtctgtcgattttcagtggtcccccttccctactgaaataagtggagtgtcagcaatagttccatctccatctgggagaaaacttcttctagtacgcaattctgaagatgatcccctacaaaactagagatttggggcccatgtcaagtagagatgagatacatattgcaaaatctgttcatggatcactctatactgatgaatggtttgaaaggatatcatgggacccggnagagactttcatagcttatgttgccgaagaacctctcaaccaaagccagggtttaatgattatggattncaaaaagaaaggtttttcaaaaaagactgccaaaactggaagggacaaggggattgg

SEQ ID NO: 91347 - protein, 129 aa, Zea mays
  misc_feature: Ceres CLONE 1579681
MATTQASEAAADKGLPLAVDATMVDEYASQSKLLQEFVKIPTIGKAWIFNSKDDDMSKAVVSIGKSDLLANKRRQFLLNTHISKSPSKSVDFQWSPFPTEISGVSAIVPSPSGRKLLLVRNSEDDPLQN

SEQ ID NO: 91348 - DNA, 896 bp, Zea mays
  misc_feature: Ceres CLONE 1579682
  misc_feature: Encodes the peptide sequence at SEQ ID NO. 91349
ctggagctccccgcggtggcggccgctctagaactagtggatcccccgggctgcaggaattcgtctcacccccccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgacgggctccctcaccgccgcgctcctcgccccgctggccgagctgcgggtcctcagcctcaagtccaacgccctcacaggccccatcccggaggccctcccgcgcgcgctcccaaacctcaagctgctgtacctcgccgacaaccgcctccagggccgcgtccccgccaccctcgccatgctccaccgggccaccgtcatcgtcctctccggcaaccgactcacgggccagatcccgccctccctcgccgccctgccacgcctgacctcggctgctccttcgaccggcaaccctggttcaccggtggccccgggccccccctgggggcaaccgtaacccccaggggggctctaaaggtttcggggcaaaccccctggtgggggggagaaaacccgcggcgcgcctctcccccccaggtgttaaaaaccccggtgtttttctccccccaatgggcggggcccttggggggggccccctctttaacacggccccgtgg

SEQ ID NO: 91349 - protein, 193 aa, Zea mays
  misc_feature: Ceres CLONE 1579682
  misc_feature: SWISSPROT Homolog: EC 2.7.11.1 Non-specific serine/threonine protein kinase
MPRRAGAAWPCFLLLHIIAHLHLAVNAADADALLTFKSSLDRSDRLPWRPDTAPAFCASWPGVRQCAPAGRVTKLVLEGLNLTGSLTAALLAPLAELRVLSLKSNALTGPIPEALPRALPNLKLLYLADNRLQGRVPATLAMLHRATVIVLSGNRLTGQIPPSLAALPRLTSAAPSTGNPGSPVAPGPPWGQP

SEQ ID NO: 91350 - DNA, 810 bp, Zea mays
  misc_feature: Ceres CLONE 1579686
  misc_feature: Encodes the peptide sequence at SEQ ID NO. 91351
gagctccccgcggtggcggccgctctagaactagtggatcccccgggctgcaggaattcgtctcacccctagaaaaaaaaaacgacctcctccgcccgcccgtcggcgttgtttcgtctccaccgccgctctcctttccagtctccaccaccgctcgtctccccgtaccgcccgcaacccccctcccctgcgagatccggggcgcgatgtggcgcatctgcgtctcggggggcctctccaggggcaagggctccgcctccaggctcctctccacggcgtcgtcgtcctacacggtggtcgaccacacctacgacacattggtggtgggggccggcagctcggggatccgggcggcgatcggcctctccgagcacggcttcaacaccgcgtgcatcaccaagatgttgcccacgcgctcgcacaccgacagcggactcagggagagcataaatgctgcacttggaaacatgagtgaagatgactggaggtggcatatatatgacactgctaagggaagcgattggatgggagaccaggattctattcagtatatgtgcagagaggcaccaaaagctgttatagagattgagaactatggactatcatttgtcagaactgaagagggaaagatataccaacgtgcctttggagggcagagcttacatcttggcaaaggtggacaagcctatcgttgtgcctgcgctgctgacagaacaggacatgctatgctgcacacactatatggtcaaagcataatcgacacactcaattttttgtgaatactctgctattggacttccatggacacga

SEQ ID NO: 91351 - protein, 190 aa, Zea mays
  misc_feature: Ceres CLONE 1579686
  misc_feature: SWISSPROT Homolog: EC 1.3.5.1 Succinate dehydrogenase (ubiquinone)
MWRICVSGGLSRGKGSASRLLSTASSSYTVVDHTYDTLVVGAGSSGIRAAIGLSEHGFNTACITKMLPTRSHTDSGLRESINAALGNMSEDDWRWHIYDTAKGSDWMGDQDSIQYMCREAPKAVIEIENYGLSFVRTEEGKIYQRAFGGQSLHLGKGGQAYRCACAADRTGHAMLHTLYGQSIIDTLNFL

SEQ ID NO: 91352 - DNA, 1246 bp, Zea mays
  misc_feature: Ceres CLONE 1579687
  misc_feature: Encodes the peptide sequence at SEQ ID NO. 91353
  misc_feature (14)..(14): n is a, c, t, g, unknown, or other
  misc_feature (15)..(15): n is a, c, t, g, unknown, or other
  misc_feature (54)..(54): n is a, c, t, g, unknown, or other
  misc_feature (57)..(57): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (1103)..(1103): n is a, c, t, g, unknown, or other
  misc_feature (1104)..(1104): n is a, c, t, g, unknown, or other
gttggtggtggttnnttttttttattttttttagtggggggggaagggcgtacnccncanntntttatttnnnnnaaaaactggagctccccgcggtggcggccgctctagaactagtggatcccccgggctgcatgaattcgtctcacccctagaaaaagtgttggtcgcctgtgccaaattccgctgcccggcggcgaatttactcctctcagcctctacttatcgggttccagctcaacccggacggccactgctgcgactaaggactagcaaggtttcattgcgctcaattgctatggctaccacacaagcctcagaagcagctgctgacaaaggattgcctctgagcatggacgctaccatggttgatgagtatgcctcccagtctaagttgctgcaagaatttggtaaaatcccaactattggcaaggcttggatcttcaattccaaggatgacgacatgtcaaaagcagcgccctcgattgggaaatcccatctttttggccattaagaggagacaattcccgtttgaagactcaccatttccagagagtcccctcagagtctggtgggatattcaagtgggtccccccttcccctacttggaaataagtgggagttgtacaatctaattaattcccattcctcccatcctgggaggaaaaaaacttttcttcctatgctaaccaccaaattcctccgaaaaaaatggatttgcccccccttaacggaaaaaccttgaggaagtactttttgggggtggtcgcccatctgtgtttcaagttctttatcctgagaaaatgtggaaggaggatggcccctctattattttgtccaaaaataaaaatcccatcgggtttcccgctcgggggagtttcccgccgctcctttaatgatgatcgtcgagcgtgcgaaaagtgggagtctctgtacaaaaggagggcgagatatgtcgcttctcggggaacagtccctcgagggataagaagaaaagacgtttttcaatttgaggactgatatattgttttttgccgccccgaggggggatcccctcccccgccacagatacaattaaaatcactaaggtgtggtcttattanntgtaaatataaagttctgggtgtcctcacagaaaaaagggaataggggtttctttctcaccacaagaagaagtgtcgcgcacataaaaaaaccctgggatagaggggggctacgagtggtgaatttgtcggagcattctatc

SEQ ID NO: 91353 - protein, 71 aa, Zea mays
  misc_feature: Ceres CLONE 1579687
MATTQASEAAADKGLPLSMDATMVDEYASQSKLLQEFGKIPTIGKAWIFNSKDDDMSKAAPSIGKSHLFGH

SEQ ID NO: 91354 - DNA, 998 bp, Zea mays
  misc_feature: Ceres CLONE 1579691
  misc_feature: Encodes the peptide sequence at SEQ ID NO. 91355
  misc_feature (998)..(998): n is a, c, t, g, unknown, or other
ggagctccaccgcggtggcggccgctctagaaatagtggatcccccgggctgcaggaattcgtctcacccctagaaaaacccctcccccaccgccattgctcagcagcagtagtaaagccacgcctgacagacagctggttcatttcttcttgctgccttgctggtggtagccctcggcgcaggcagccaaaaacagagagagcgagatggatgtgaacgacgtgctgcaagtggtgctggcggcggcgctggctgccatgtggtggcgtcggtgctccaagaccggcggtgtcgacggcctcccgccggggcctccgggttggccggtggtggggaacctgttccaggtgatcctgcagcgacggcccttcatgtacgtggtgcgcgacctcccggagaagtacgggcccatcttcaccatgcggatggggcagcgcaccctcatcgtggtcacctcggcggagctcatccacgaggcgctggtgaagcagggccccatgttcgcgagccggcccgaggacagccccacccgcccgctcttcagcgtcggcaagtgcacccgtcactcggcgccctacggccccctgtggcgtgctctgcgccgcaacttcgtcgccgagattctgtcccccgcacgcgtcaagggcttctcctggatccggaaatgggccgtgggacgcccacttgcggcccccctctgttcctaagctctcggcggaacggtgcccgggcggtgtcatggcccgtcggccgccctcaccattttggagcattcccccacctgattttggtttgggcgcccaattccccgaataacttctcccgggaaaatcgagggagggcgccagggacctgtttattattaacctggcccaagttcccgagattctggcccctttctaaaacgttctttaggatatatctcaccggggtccgtgtcctggggtccacacaagttatattgtctttgtggccttgctctccgccggggtggaan

SEQ ID NO: 91355 - protein, 166 aa, Zea mays
  misc_feature: Ceres CLONE 1579691
  misc_feature: SWISSPROT Homolog: EC 1.14.13.89 Isoflavone 2'-hydroxylase
MDVNDVLQVVLAAALAAMWWRRCSKTGGVDGLPPGPPGWPVVGNLFQVILQRRPFMYVVRDLPEKYGPIFTMRMGQRTLIVVTSAELIHEALVKQGPMFASRPEDSPTRPLFSVGKCTRHSAPYGPLWRALRRNFVAEILSPARVKGFSWIRKWAVGRPLAAPLCS

SEQ ID NO: 91356 - DNA, 835 bp, Zea mays
  misc_feature: Ceres CLONE 1579693
  misc_feature: Encodes the peptide sequence at SEQ ID NO. 91357
ctggagctccccgcggtggcggccgctctagaactagtggatcccccgggctgcaggaattcgtctcacccctagaaaaactcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcaccggtgagactgaggagttcttcacttcatatgatgaagtttttgagagttttgatgatatgggcctccaagagaatcttctgagaggcatttatgcttatggttttgagaagccatctgcaattcagcagagaggaattgttcccttctgcaagggtcttgatgtcattcagcaagcacaatctggtacaggaaagacagcaactttctgttctgggatcttgcagcagctggactatggcctgggtgaatggcaggccctggtccttgctcccacccgtgagcttgcacagcaaatcgagaaagtcatgcgcgcgccttggtgatttaccttggtgtttaaggtcattgcatgtgtgggaaggaacatcccgtccgtgaaggaacaaaagaattccttgggcagtgggtggtggcatgttttggttgttgggtaccccctgggccccgggtggtttgaaaatggctgcgggcagaacaggtcccctccggcccctggaaaaacactccaagaagggttttggttccctaaaaatgaac

SEQ ID NO: 91357 - protein, 133 aa, Zea mays
  misc_feature: Ceres CLONE 1579693
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLGEWQALVLAPTRELAQQIEKVMRAPW

SEQ ID NO: 91358 - DNA, 1198 bp, Zea mays
  misc_feature: Ceres CLONE 1579694
  misc_feature: SWISSPROT Homolog: EC 2.7.9.1 Pyruvate, phosphate dikinase
  misc_feature (784)..(784): n is a, c, t, g, unknown, or other
  misc_feature (1022)..(1022): n is a, c, t, g, unknown, or other
gttttttttttttttttttttgcgtgtggttgatggttggatgtcgggagggggcagagggtcatgcctgtaaaaaaaataactggagctccccgcggtggcggccgctctagaactagtggatcccccgggctgcttgattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggtaggatgacggcatcggtttccagggccatctgcgtacagaagccgggctcaaaatgcaccagggacagggaagcgacctccttcgcccgccgatcggtcgcagcgtcttaacccccgcacgccaaagccgccggcgtcatccgctccgaactccgggcgcgggaccggggccagcattggttcgccgcctgaggggccgtgcgttgaacgccgcgcccgattaccggacgcaacccaaaaaaaaggggtgtttccaccttcccggcaaagggggcaaagaagccgagggggcaaacaaaggacccatggaaaaggaaaacctggcttgggggcggggcaaaagggggccggcagaaaacccctgggcccggggaaaataaggggccccaagtccaaatctgggggagccttgggntcccgggtgtgggaccccgagcccccaaggggggggttttttcaataccgggagtgggtttcccgtaaacgcggggaaagggctcacttggtccccccgcgcgcaggtgttcccacacagggaaacacgcccccccgggggtgggagtaattccccctttctcccccgggggggagggggcccttcctggggggggccacactaggaaaactacgtaccgtataccggagccctcggnaccatttgggggggtggggtaaagggaaatttaacactggggtggccgacccccacacccccggggggagcaaaattcagaggagagacggccccacacagacctgggatttctcaacggtaaccagcctttcccggggagaccggacccgtgtgacccatgtcccccggggggag

SEQ ID NO: 91359 - DNA, 1186 bp, Zea mays
  misc_feature: Ceres CLONE 1579699
  misc_feature: Encodes the peptide sequence at SEQ ID NO. 91360
  misc_feature (1)..(1): n is a, c, t, g, unknown, or other
  misc_feature (2)..(2): n is a, c, t, g, unknown, or other
  misc_feature (47)..(47): n is a, c, t, g, unknown, or other
  misc_feature (56)..(56): n is a, c, t, g, unknown, or other
nnaaaaaaaaacctggggcgaacaacccccccctctcttccaccatngtgtaatcntctttcaccgttactaaaaaaaaatgaactccccgcggtggcggccgcttctgaactagtggatcccccgggctgcttgaattcgtctcacccctagaaaaaaaccaacctcctctgcctgccgcttctcctgctgcgggcggtcacggctgcaagtactagaggaggacatccgcttccattactgcgcctgcggaggatcggaggaaccagtagcggaggcttctattttcggcgggcgcaataaatttcccgcatggctcggagggccgcgtcctcgctcgtctcccgctgcctcctggcgagggcccctgccggcgcgccgcccgctgccccctctgcgctgcgcaggacagtgcctgcagatgggatgcacaggctgttgccaggtgtccttcagaggttcagcactgcagcagcagtagaggagcccatcacgccgtcagtccatgtgaactacacaaaactcctcattaatggacaaccttttgtttgattcccccatccggaaaaaaaccttcccaaacttctgggacccttcgtacaaggggcaagttgaattgcctccaatgtgggctggaggggtggtaccacagaaggtaactttaaaccctgtgggccaagtaaaccttgccaggccaccggcaaaagggattttctttgaatataaaaaagggtcccacatggtgtccacaaaaaaaaatagaaaaccagcgccctataataaggattgagagagggtccccccgcggacaaactcacctaaacctgggcagggagacatttcgccatagaaaattcttggacgtgtgtggaagcaaagacccctcttaaatgttaaccccaaaggccgctcagtgcacaccattttgtggcatgaaaacagtgtggtggacacaaaacgcgggggaaaaattcccttttatgtaacgcgcagacgcccttgcccctcaattagttcgttatctttaaccccaacatcgtagtagcgccgcgatggatcaaatcgcccttattaatccatataccttgggtattaggcgtgccacaaaaaaaaaaccgaagagggatctcttattttttgccacccgcacatgtgaggccacccccacaatagatgtaataaaaaa

SEQ ID NO: 91360 - protein, 79 aa, Zea mays
  misc_feature: Ceres CLONE 1579699
  misc_feature: SWISSPROT Homolog: EC 1.2.1.3 Aldehyde dehydrogenase (NAD(+))
MARRAASSLVSRCLLARAPAGAPPAAPSALRRTVPADGMHRLLPGVLQRFSTAAAVEEPITPSVHVNYTKLLINGQPFV

SEQ ID NO: 91361 - DNA, 958 bp, Zea mays
  misc_feature: Ceres CLONE 1579701
  misc_feature: Encodes the peptide sequence at SEQ ID NO. 91362
  misc_feature (890)..(890): n is a, c, t, g, unknown, or other
  misc_feature (898)..(898): n is a, c, t, g, unknown, or other
  misc_feature (926)..(926): n is a, c, t, g, unknown, or other
ctccccgcggtggcggccgctctagaactagtggatcccccgggctgcaggaattcgtctcacccctagaaaaatctctgtcgcggagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaagacaaaccacttcctccctattcatcgtgaagcccctgcttttgttgagcaggccactgagcagcaaattcttgttactggaaatcaagtcgtggatcttcttgcaccctaccaaagggtgggaaagattggtctcttcggtggtgcaggagtgggtaaaactgtgctcattatggaggttgatcacatgttgctaaggcccatggtggnttctctgntgttgctggtgttggaaacgtaccctgnaaggtatgatcttgtaggggatatgattgaaa

SEQ ID NO: 91362 - protein, 273 aa, Zea mays
  misc_feature: Ceres CLONE 1579701
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
  misc_feature (251)..(251): Xaa is any aa, unknown, or other
  misc_feature (254)..(254): Xaa is any aa, unknown, or other
  misc_feature (263)..(263): Xaa is any aa, unknown, or other
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHFLPIHREAPAFVEQATEQQILVTGNQVVDLLAPYQRVGKIGLFGGAGVGKTVLIMEVDHMLLRPMVXSLXLLVLETYPXRYDLVGDMIE

SEQ ID NO: 91363 - DNA, 907 bp, Zea mays
  misc_feature: Ceres CLONE 1579706
  misc_feature: Encodes the peptide sequence at SEQ ID NO. 91364
  misc_feature (400)..(400): n is a, c, t, g, unknown, or other
ggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcgggcaagaaacaggtcgccatgtaacccatcaacacccnctttgatgccaaacgtctcattggcaggagggtttagtgatgcctctgtccaaagtgatattaagcggtggccccttcaaggtccttcctggggcccgggggaaaaccccatgaaatttgttccccccccaggggggagagaaaaaaaaatttggccccccaaaaaaaacccccccccctggggtcccccatcaaaaaagcggggagaaaccccctaaaaccttttcccttgggggggccgaatccaaaaaaggcggtttgtttcgggggccccgggcctatttttaaaaaaattccaaaaaaacacggcccccccaaaagaaaccttggggggaattgggggggccccaatgggccccccctttcttgccatagaacacaaaaccggggccggccaatgggcccttgagtgtcttaagcagggagggaaacacccagggcccgccgcaaaaaaaaagggcacccacatttttccccctcgggtgagggggggacacctgtggaatt

SEQ ID NO: 91364 - protein, 64 aa, Zea mays
  misc_feature: Ceres CLONE 1579706
MAGKGDGPAIGIDLGTTYSCVGVWQHDRVEIIANDQGNRTTPSYVAFTDSERLIGDAGKKQVAM

SEQ ID NO: 91365 - DNA, 690 bp, Zea mays
  misc_feature: Ceres CLONE 1579709
  misc_feature: Encodes the peptide sequence at SEQ ID NO. 91366
ctccccgcggtggcggccgctctagaactagtggatcccccgggctgcaggaattcgtctcaccccctagaaaaaaaccttcccagcactttcccctccgtctcccgcgcctggtctccgcctcccgcgcgcgcccgatgcagatgccgccgtcgcggccgatctgacgccatcggtcgccggccatgaggcctcgccgccgggccctcttcccgttgcacagcgcaggcgctggggcctgcggtgacccgtgggccgactgccagacaccaccgccggttcccagcactcctgattccggccctggcccttccccatcgctgcctccctatggcgatctaccgtgccctcccgttttgtcgccgtcgccgtcgcctgctcccgcgcataacggtaggaggaacccagggagggacgccaggaatacgggggcccccccccgggtgcagggcgaacaccgacccgaacgggccccttcgttcaaaataccccccctccttcccccccccccgggggggggttccccccctttccgaaaaggccccgggaacccccgggccccggggggggtcctcccgggggggggccccgtggggggggggccccccggggaagggggttccccgggggccgcaaaaaggggggggggaaaagggggggcctcttttccctcttttgggaaaaacaccc

SEQ ID NO: 91366 - protein, 168 aa, Zea mays
  misc_feature: Ceres CLONE 1579709
MRPRRRALFPLHSAGAGACGDPWADCQTPPPVPSTPDSGPGPSPSLPPYGDLPCPPVLSPSPSPAPAHNGRRNPGRDARNTGAPPRVQGEHRPERAPSFKIPPLLPPPPGGGSPPFRKGPGNPRAPGGVLPGGGPVGGGPPGEGGSPGAAKRGGGKGGASFPSFGKNT

SEQ ID NO: 91367 - DNA, 928 bp, Zea mays
  misc_feature: Ceres CLONE 1579711
  misc_feature: Encodes the peptide sequence at SEQ ID NO. 91368
ctggagctccccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggcggcgaagggagaggccgccgcgcagggcgcgccatcgacgccgagggcgcaccagcagcaccgccaccccgccgcccccgccatcgccgtcagcgacagctccctcaagttcactcatgtgctcaacaacctctcgcctgctgagctgtacgagcaggccatcaagtacgaagaggggtcgttcatcacgtccaccggcgcgctggcgacgctgtctggtgccaagtacgggcggtctcccagggactagcgcgtcgtcaaggacgatgtcacgcccatgacctgtgggtgggcatgtctcgccaacatcgagatggacgagaagacgttctgatcaacagggagagggcgtcgactactcactccccggaaaaggtgttctggaacaaacagtccttcactggtaccccaaaaacggatcaagtcccacatctccgccg

SEQ ID NO: 91368 - protein, 189 aa, Zea mays
  misc_feature: Ceres CLONE 1579711
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAIKYEEGSFITSTGALATLSGAKYGRSPRD

SEQ ID NO: 91369 - DNA, 846 bp, Zea mays
  misc_feature: Ceres CLONE 1579713
  misc_feature: Encodes the peptide sequence at SEQ ID NO. 91370
  misc_feature (679)..(679): n is a, c, t, g, unknown, or other
  misc_feature (747)..(747): n is a, c, t, g, unknown, or other
  misc_feature (781)..(781): n is a, c, t, g, unknown, or other
ggagctccccgcggtggcggccgctctagaactagtggatcccccgggctgcaggaattcgtctcacccctagaaaaagcacccctagctactactgcgctcctcctccggcttgctcttcgcgcagcaagcagacggggaaacaagaatcatcccttccatatgaccatatatactactactactactactcaatacccatgcatgcgcactgcctcctggtgcggcgtatgaaccagacatgaacagggagcacagcagcagcagctccaagctcatcaacgagaagctcgaggaacaccggatctccaccgcgaagcactgcccccactgcggcgagaaaatcgacagcaaaccagattgggtggggttgccggcaggcgtcaagttcgatccaactgaccaggagctgatcgagcacctcgaggcgaaagtgaaggactaaggctcgagatctcaccctctcatcgacgagttcatacccacaatacatggggaggacggcatatgctacacccaccccgagaaacttccaggtgtgacgagggatggcctaagcaagcacttcttccaccggtcgtccaaggcctacacgacgggcacgaggaagaggaggaagatacagacggagtgcgacgtccacacgggggagacgaagatgcacaaagacgagcagacncctccggtgatggttagtcgccggcacaaggggtgcaacaagatactggtgcttgaacaccagcttcngcaagcaaccgcaagccggagaaaaccaactggntgatgcaccaataccatctcggttgaccaaaagaaggagaaagaggggaaactggtgggggtgca

SEQ ID NO: 91370 - protein, 67 aa, Zea mays
  misc_feature: Ceres CLONE 1579713
MNREHSSSSSKLINEKLEEHRISTAKHCPHCGEKIDSKPDWVGLPAGVKFDPTDQELIEHLEAKVKD

SEQ ID NO: 91371 - DNA, 833 bp, Zea mays
  misc_feature: Ceres CLONE 1579714
  misc_feature: Encodes the peptide sequence at SEQ ID NO. 91372
tggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtcacggcagcaaccactggggaaggtctgctggaccccatcgacggggtgctcctcaggaactcatccgctaacgggaggtcccccagggcaccttagaaagctttgaataagaaccgtttttcccccctatggggggagtttgaaagttcccggggaaaaactttttttcccaaaatttggcctctggggggatttgggttaaaaagggcccccccgttcccttttatgcccctctggagaaaaacctcaagatgttccccacattttggggaaaaaaaaaaggggcgcccccaccccccaaaaattttgggggagggagaattcccgggccc

SEQ ID NO: 91372 - protein, 114 aa, Zea mays
  misc_feature: Ceres CLONE 1579714
MAATVSSCLSLVPTVHHRAGGFPSSVALTNTLQRRRRSRRYLVVASATRAEQEAAPVTIEDVDLSSHQAAADDGELAARWREVTAATTGEGLLDPIDGVLLRNSSANGRSPRAP

SEQ ID NO: 91373 - DNA, 860 bp, Zea mays
  misc_feature: Ceres CLONE 1579715
  misc_feature: Encodes the peptide sequence at SEQ ID NO. 91374
  misc_feature (513)..(513): n is a, c, t, g, unknown, or other
  misc_feature (860)..(860): n is a, c, t, g, unknown, or other
ctccccgcggtggcggccgctctagaactagtggatcccccgggctgcaggaattcgtctcacccctagaaaaattcgagtgaaagcggcccccaatttctactgtaagcagcaatggcgctctcctgttgcttgctcgccggcgcccgggggggagcctccccttccttctcatcctccgctgccatccgccggcgggaccaccgtctgctgaccttgtccgtggttccgctttcgctctctcagcgatgtcgccacggcctccgcgtgtgctgcgcctcctccacctcttcctcatctccgccgccggcaactcccgaggagcccgacgactacgagttattggacacagctgggaattgtgaccctctatgctcggctgatgaagttagctcacaatactttgaagctaactacaaaccaaaaaatgaccttctaaaagctttaactatcattggcacagccttgactggtgcagccgcaataaatcattcctgggttgctgctaatcangacattgcaatggtgttggtttttgctattggctatgcacgtatcgtttttgaggaatcactagcatttaacgaaagtggagttgcgttattgatggctgtctgcctatgggttatcacaggcattgcggctccctcgactgatgtagctgttcaagacgtgagccagtcaacttctgcagctagtcgaattgtgtttttcttgcttggggcaatgactattgtggaaatgttgatgcacatcaaggttttacctggtgactgatatatatttactcgaaacccaaaactcttcagggggggaatggtatgaaactttccttctgaggtcgatcttcacaacctgan

SEQ ID NO: 91374 - protein, 220 aa, Zea mays
  misc_feature: Ceres CLONE 1579715
  misc_feature (133)..(133): Xaa is any aa, unknown, or other
MALSCCLLAGARGGASPSFSSSAAIRRRDHRLLTLSVVPLSLSQRCRHGLRVCCASSTSSSSPPPATPEEPDDYELLDTAGNCDPLCSADEVSSQYFEANYKPKNDLLKALTIIGTALTGAAAINHSWVAANXDIAMVLVFAIGYARIVFEESLAFNESGVALLMAVCLWVITGIAAPSTDVAVQDVSQSTSAASRIVFFLLGAMTIVEMLMHIKVLPGD

SEQ ID NO: 91375 - DNA, 816 bp, Zea mays
  misc_feature: Ceres CLONE 1579716
  misc_feature: Encodes the peptide sequence at SEQ ID NO. 91376
  misc_feature (528)..(528): n is a, c, t, g, unknown, or other
  misc_feature (666)..(666): n is a, c, t, g, unknown, or other
  misc_feature (667)..(667): n is a, c, t, g, unknown, or other
  misc_feature (674)..(674): n is a, c, t, g, unknown, or other
  misc_feature (678)..(678): n is a, c, t, g, unknown, or other
  misc_feature (679)..(679): n is a, c, t, g, unknown, or other
ggagctccccgcggtggcggccgctctagaactagtggatcccccgggctgcaggaattcgtctcacccctagaaaaaactccgagatctggtcttctcggtgtccaacggtccacagcccaaccctctcgagtctcgtcttctcccccggactccgagatcttgccgatctgcaacgacgccgcggtccgcggccatggcggtgccctctcccgccccgcggtccccgcgccgaccggatgccattgtggccccggatccctcgtccgctgacgtgccaccatccctcgacttcggcgacccggcctccctcgccgcgctccgagtcctcaccgacgcgggtgccgccacccgcctcctccacgagtgcgtggcctaccagcgcgcgctcgacgcccgtctcgacgctctcctcgcccgccgtgctgacctcgaccgcgccgctgcttcgctcctccgctctgccccgcctctgctctcgctcgcggcttccgacgccgccgcgcttaaagggatccctcaccaccnacgcggcgctcgccgacgcgctctcgtcccgcgtgcgccatctcgacgcggcgcactccagggcggacgctgcgctggcacgtgccgaggccgcgctcgatcgttctcgcgcgctcgaagccgcgccgcggccttggnncgccgangaannctcgcggcgcggcaccggtgtgcacgaattcctcgctattgacgctcgggtcccaccgaacaacatctccggcccgatttgcttgacatgaaacgtccctccaggggctcccccgtcggaggctaacggcggtcgtt

SEQ ID NO: 91376 - protein, 174 aa, Zea mays
  misc_feature: Ceres CLONE 1579716
  misc_feature (111)..(111): Xaa is any aa, unknown, or other
  misc_feature (157)..(157): Xaa is any aa, unknown, or other
  misc_feature (160)..(160): Xaa is any aa, unknown, or other
  misc_feature (161)..(161): Xaa is any aa, unknown, or other
MAVPSPAPRSPRRPDAIVAPDPSSADVPPSLDFGDPASLAALRVLTDAGAATRLLHECVAYQRALDARLDALLARRADLDRAAASLLRSAPPLLSLAASDAAALKGIPHHXRGARRRALVPRAPSRRGALQGGRCAGTCRGRARSFSRARSRAAALXRRXXLAARHRCARIPRY

SEQ ID NO: 91377 - DNA, 853 bp, Zea mays
  misc_feature: Ceres CLONE 1579717
  misc_feature: Encodes the peptide sequence at SEQ ID NO. 91378
  misc_feature (853)..(853): n is a, c, t, g, unknown, or other
ctggagctccccgcggtggcggccgctctataatagtggatcccccgggctgcaggaattcgtctcacccctagaaaaaacctggcacgggcttacaacgccgcagctgacctacccacaattgatataccaggggcgcatctgggtgtggatctatcgctgaccggcgtgctacctaatcccctggcttgctttctcaccggatgatggtcgcactatggacgaccactgagtccgagccctaccccgacagggggcggaagggctcgtttggctccgccacgatcaatcccgcagggggcggggctggtgcctcctcgtcggcagctgatggggaatcatcagctggaaattctgctggggtaccgcaacctccccaaggcgtaccggagccgacagatcgacgcttgcgacaacggtgccgacaaggcggtaggcgaagagaatggactgaagagccggctgctgccggatatgagtccgagatctgggcccgatggggcatgcgccagcaaaactgcgggcagcctcgggaaacgcaagacctgcaagcatcaaaatccactccttcaagcaagccgaggccgggcagcgagctctctcttccgggtgctccaaagggccaaacgattggcagggaacaggttccgcggggaacttggaagcatcgatggggttcgaccctggggggtctggccactcgactaggcggacttccaacctcggacgtggaggccccgagaatcaacggcgttgggggaatcagcggggacaaccgcaagggtggtgcaattttgggggggtcaaaagagcggggcaacataggagagttcccttccgcggaggggtccan

SEQ ID NO: 91378 - protein, 125 aa, Zea mays
  misc_feature: Ceres CLONE 1579717
MGNHQLEILLGYRNLPKAYRSRQIDACDNGADKAVGEENGLKSRLLPDMSPRSGPDGACASKTAGSLGKRKTCKHQNPLLQASRGRAASSLFRVLQRAKRLAGNRFRGELGSIDGVRPWGVWPLD

SEQ ID NO: 91379 - DNA, 966 bp, Zea mays
  misc_feature: Ceres CLONE 1579722
  misc_feature: Encodes the peptide sequence at SEQ ID NO. 91380
  misc_feature (504)..(504): n is a, c, t, g, unknown, or other
cgctggagctccccgcggtggcggccgctctagaactagtggatcccccgggctgcaggaattcgtctcacccctagaaaaagtccttatcgccagccgaaccgacattgttttctccccccttctcgccttctccttctcccccctagtctagaggcgtttgctccccaatcccttcagcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacanctgttattgtccgtttctctaccgttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcgagccgtatccaaagaccaatttgcaggagaactggagaatagtagatttcttctctcaccacccagagaagctacacatgttcaccttcctctttgacgatgttggcatcccactcaactacaagcacatggagggctttggtgtcaataccacaacttgattcacagggatggaaagcctcacctgtgaaattcattggaaacccacttgtggtggggaatgcttgacgcaccatgaagctgtgactgttgtaggaactgtcccatccatgcggagaa

SEQ ID NO: 91380 - protein, 211 aa, Zea mays
  misc_feature: Ceres CLONE 1579722
  misc_feature (18)..(211): Pfam Name: Catalase Pfam Description: Catalase
  misc_feature: SWISSPROT Homolog: EC 1.11.1.6 Catalase
  misc_feature (98)..(98): Xaa is any aa, unknown, or other
MDPYKHRPSSGSNSSFWTTNSGAPVWNNNSALTVGQRGPILLEDYHLIEKLAQFDRERIPERVVHARGASAKGFFEVTHDVSHLTCADFLRAPGVQTXVIVRFSTVVHERGSPETLRDPRGFAVKFYTREGNFDLVGNNMPVFFIRDGMKFPDMVHAFEPYPKTNLQENWRIVDFFSHHPEKLHMFTFLFDDVGIPLNYKHMEGFGVNTTT

SEQ ID NO: 91381 - DNA, 823 bp, Zea mays
  misc_feature: Ceres CLONE 1579725
  misc_feature: Encodes the peptide sequence at SEQ ID NO. 91382
  misc_feature (593)..(593): n is a, c, t, g, unknown, or other
  misc_feature (664)..(664): n is a, c, t, g, unknown, or other
  misc_feature (672)..(672): n is a, c, t, g, unknown, or other
  misc_feature (762)..(762): n is a, c, t, g, unknown, or other
tggagctccccgcggtggcggccgctctagaactagtggatcccccgggctgcaggaattcgtctcacccctagaaaaaattcgcaatccaaaaagcttgcgcgctactccactggtccattacttacgcagtcagttcagcgagtgagcactgagcagccatgtagcaatttcaattgcaagttgcaacgcgacgaatacggagccatggacgacggcgccgcaaccacaatcgtccaaggcggcgacgcgcacgtcctgctcctgccgttccctgggatgcagggccacgcgaacccgatgctccagcttggccggcggctggccttccacggcctgcgccccaccttggtggtctcccgccacgtcctctccaccacctccacctccaggtcgtgccccatccccgtggccgccatctcggacggcttcgacgacggcgggatctcctcgtgcccggacaccgcggaatacgtgcgccggatggaggccgcggggtcggagactctggcggagctcctggacgccgaggcccgcgcggggcggtccgtccgcgtgctggtgtacgactcgcacttgccgtgggcgcgccncgtggcgcgggccgccggcgtggccgccgccgcgttcatgacgcagatgtgcgcggtgggcctcctctacngcaaggcntgggcccgggcgggtggccctgccgctggcggaacggggcgcgcctgcccgggaagcttcgcgtggagctggccccccaccacttgccgnccgttcggggcggccccccagggggaccccgggtttcacggaatccgggctgagcccaatc

SEQ ID NO: 91382 - protein, 205 aa, Zea mays
  misc_feature: Ceres CLONE 1579725
  misc_feature: SWISSPROT Homolog: EC 2.4.1.121 Indole-3-acetate beta-glucosyltransferase
  misc_feature (129)..(129): Xaa is any aa, unknown, or other
  misc_feature (153)..(153): Xaa is any aa, unknown, or other
MDDGAATTIVQGGDAHVLLLPFPGMQGHANPMLQLGRRLAFHGLRPTLVVSRHVLSTTSTSRSCPIPVAAISDGFDDGGISSCPDTAEYVRRMEAAGSETLAELLDAEARAGRSVRVLVYDSHLPWARXVARAAGVAAAAFMTQMCAVGLLYXKAWARAGGPAAGGTGRACPGSFAWSWPPTTCRPFGAAPQGDPGFHGIRAEPN

SEQ ID NO: 91383 - DNA, 876 bp, Zea mays
  misc_feature: Ceres CLONE 1579728
  misc_feature: Encodes the peptide sequence at SEQ ID NO. 91384
  misc_feature (876)..(876): n is a, c, t, g, unknown, or other
ctggagctccccgcggtggcggccgctctagaactagtggatcccccgggctgcaggaattcgtctcacccctagaaaaaaacccgcgcgccctcccatccgccgctccattccgtcgtcgtcgtcagcagcttctgcttgctttgtgggggaaggagagagagagagagcgagagagagatctagtagagaggctagtaggtggtcctcgaacgaagatgttggcggtgttcagcgggcaggtggtggaggtgccggcggagctggtggcggcgggcagccggacgccgtcgcccaagacgaaggcgtcgcagctcgtggggcgcttcctggccgcctccgagccggccgtgtccgtgcagctcggcgaccacggccacctcgcttactcccacaccaaccaggcgctcctccgccccaggtcgttcgcggccaaggacgaggtgttctgcctgttcgaaggggtgctggacaacctgggtcggctgagccagcagcacgggctgtcaagcaagggcgccaacgaggtgctcctcgtcatcgaggcctacaagacgctgcgcgaccgcgcgccctacccggccagcttcatgctcgcccagctcaccggctcctacgccttcgtcctcttcgacaagtccaccaactccctgctcgtcgcatccgaccccgagggcagggtgccgctcttctgggggatcaccgcccgacggctgcgtcggcttctccgacgacatcgacatggctcaaaggctcatgcggcaagttcctccgcgccgttcccgcaaggttgcttctacccccacgcccttcgagggcttcaagggctacgaggaaccccaagcccaagggccaccgcttgtccctcgcccaaan

SEQ ID NO: 91384 - protein, 219 aa, Zea mays
  misc_feature: Ceres CLONE 1579728
MLAVFSGQVVEVPAELVAAGSRTPSPKTKASQLVGRFLAASEPAVSVQLGDHGHLAYSHTNQALLRPRSFAAKDEVFCLFEGVLDNLGRLSQQHGLSSKGANEVLLVIEAYKTLRDRAPYPASFMLAQLTGSYAFVLFDKSTNSLLVASDPEGRVPLFWGITARRLRRLLRRHRHGSKAHAASSSAPFPQGCFYPHALRGLQGLRGTPSPRATACPSPK

SEQ ID NO: 91385 - DNA, 878 bp, Zea mays
  misc_feature: Ceres CLONE 1579732
  misc_feature: Encodes the peptide sequence at SEQ ID NO. 91386
ctccccgcggtggcggccgctctagaactagtggatcccccgggctgcaggaattcgtctcacccctagaaaaaacctcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcggctgcgccggcaccttctgctccggccctcccacctccgcctccgcgcgccccactccatcgccgacctctcccgctcctccaattccgccccgagcccggcccgcccagcgctgggctccggcccggagaacggcagcggcggcgtccgcgcggtggagaaggacccgatcaagctgtgggagcgctacgtcgagtggctctaccagcacaaggagctcggcatcttcgtcgacgtcagccggatgggggtcacggaggagttcctgcggcagatggaaccgcggatgcagcatgccttcgtcgacatgcgggagctcgagaaaggcgccatcgccaccccgacaagggccgcatggtgggccacatatggtgtcggggaacgggcccctggtcccaaatccttccccggaaaaaaatcgaaacccccccccaaaaaccccccctctcccccaaaggtccccctggaaaaaatttttcccccccggggggggtcccccaaaatcccccccaaagaaacacgggggggccctttgggccccccattttttggccaaggccttgcctcccaaaacccccccccgggaaaaaaaatttttttgtaaacaaaaaaacctgggagg

SEQ ID NO: 91386 - protein, 219 aa, Zea mays
  misc_feature: Ceres CLONE 1579732
  misc_feature: SWISSPROT Homolog: EC 5.3.1.9 Glucose-6-phosphate isomerase
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGVTEEFLRQMEPRMQHAFVDMRELEKGAIATPTRAAWWATYGVGERAPGPKSFPGKKSKPPPKNPPSPPKVPLEKIFPPRGGSPKIPPKETRGGPLGPPFFGQGLASQNPPPGKKIFL

SEQ ID NO: 91387 - DNA, 846 bp, Zea mays
  misc_feature: Ceres CLONE 1579733
  misc_feature: Encodes the peptide sequence at SEQ ID NO. 91388
  misc_feature (761)..(761): n is a, c, t, g, unknown, or other
ctggagctccccgcggtggcggccgctctagaactagtggatcccccgggctgcaggaattcgtctcacccctagaaaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacctcgagtccaccgacaacgctgagttcaagatcgtgctcaccatcatccgcgacggggtcaaggctgaccccaagaagtacggcaagatgaagggagaagcttgtccngcgtctcttaggagaccaccacgggtgttcaagagggctctacaaaatgcagggagaccggcggccttcttctttccctgccatt

SEQ ID NO: 91388 - protein, 229 aa, Zea mays
  misc_feature: Ceres CLONE 1579733
  misc_feature (12)..(229): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEDYEKTGKIPDLESTDNAEFKIVLTIIRDGVKADPKKYGKMKGEACPASLRRPPRVFKRALQNAGRPAAFFFPCH

SEQ ID NO: 91389 - DNA, 1080 bp, Zea mays
  misc_feature: Ceres CLONE 1579734
  misc_feature: Encodes the peptide sequence at SEQ ID NO. 91390
ccgctctgaactagtggatcccccgggctgcaggaattcgtctcacccctagaaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtccgcggcaggagacacttctccgtgcggatgttcgtcccgacctccgagggcaccaccaccatcgccgtgggcgcctcggaggtacatgtgttggacgccatgaactccaagacgggggtggcgggaatcctcggcggggggcccgtggacctgcctccttccggcttaccgtacgagggtttatggcccccggtggccaaatggctggcgcggacacagccttatctaaccttttgatttaattcaccgcgtctccccggccgcgatacaaccatagtttttttttctctcctaccaagtttatcgtatatgaattccctgaattcggcatgaccaccccaagaagcgcatcagaatttcccctctcattgggttggagtccctttccgtagaacggcgattcctcccttttgcgctccttctcgcaccaacggcccctatatggcccttagataaccggcattggccttaattaggcgggttgctcagagcgcttatcgcgctttcttgattttgctttcctatattaagtaggcgatccctcctgcactcgacagctacattgcttgttatctcgtcaagaatcatcgggtactagggtgtcaccatgacactgctcgcgctacacgacagtcggtgactacgggccagacccttaacagagataagagagaacaattgtaacttgttcgcccggctcttttcgtcatagcaatccgattcacccgcgtttctacccgtctttccgattttgctgtgcgcccccgtttggtgtgtcgccttgtcctttctcgtcattccccg

SEQ ID NO: 91390 - protein, 111 aa, Zea mays
  misc_feature: Ceres CLONE 1579734
MGLRVAATAPAPAGVRVLGRGAARVTPRPWAAVRGRRHFSVRMFVPTSEGTTTIAVGASEVHVLDAMNSKTGVAGILGGGPVDLPPSGLPYEGLWPPVAKWLARTQPYLTF

SEQ ID NO: 91391 - DNA, 843 bp, Zea mays
  misc_feature: Ceres CLONE 1579735
ctggagctccccgcggtggcggccgctctagaactagtggatcccccgggctgcaggaattcgtctcacccctagaaaaaaaccaaccccagtaccccacgagatctgctcccatctcttcttctcccccatcgcacgaggtttgcgcccctccccgctcgccgtcggcctgtctcagcccctgaccctccaccgccaccgactccctctcttgccaccgagggaatttggatctaggagcccatgccactacagctctcccccgcccacgattagccctcggctcgggagatgctgacgcccatcgcgaccacgatttgctccctcgtgtcctcggcctcttcctccactctcatcctccctcctccccccgtcctcggttattctcgtcgcctccgccgcgcgttccgctctccccacagcctttgtccgccacatcatcctcggctgttgtcggcgcctcgctccacgcccgccctcgtccaacgaccctcgccgcacccctccctgtcctcgacaacttcccctctggccccgtccttgccggcatcggcgcctgctctctccgtcatgggggatgcgaaagtgaaggatgtagaagagcaagcggcttatgcagctcggccggtcgcctcccaccaaaatcccccgagacatcatcgacgaggagatggagatggagtctagccccgcagctcctcggcatcacaatcgttgccctcccgtgttgtgcccttggaatcacttctcgtgcgacgcccctgatcgaacagcacgtcgtgcgtccgcaccgcctccctgaccgaaaagcatgtcatggctccaggcacttgcagccctccc

SEQ ID NO: 91392 - DNA, 1106 bp, Zea mays
  misc_feature: Ceres CLONE 1579737
  misc_feature: Encodes the peptide sequence at SEQ ID NO. 91393
  misc_feature (1106)..(1106): n is a, c, t, g, unknown, or other
ggagctccccgcggtggcggccgctctagaactagtggatcccccgggctgcaggaattcgtctcacccctagaaaaagagaagaagaaggaagggccatcttccgacccacttgtaggcgctgtaagcctgtaagcagtcacctctcagccacagacatggtgggcatgagaggcgcctacggtggtgcttgcaatgacgacagcaagagccggctgcacggaggcaaggcggcggagccggagatcgcgtcgatggcagtgcacaaggtggcgccgccaccggcgcggagcacggcgagcaagatgaaggtgagggtgaaggagaccttcttccccgacgacccgttccgggcgttcaaggggcagccgccggggacgcagtggctcatggcggtcaagtacctctttccccatctggactgggtgccgagctactccttgtcgctcttcaagtccaacctcgtcgcgggcctcaccattgccagcctccccattccccaggggattaactttccccaaaactgggtaaactttgcctccccataaaccggggcggttttttcaaagttctttcgccccccctaaatggtgtaaccccggtggctggggagaattccccgggtaacccggtgtgggggggcgcccccgggggttaaaatatttcgctcccccctataattccggggggccactgtgttctctcgcaaaaagccctctgtaaacccccaccccccgtgtgaacaccaaacacagtggtttctccctacaaaatggggcttcttttccttctacaccccgttttttcgcggggggggggggaggggggctctcccgggtggagatctcctgagggttgcgggttcataaaatgagatttttcttttaaacaagaaacacattaggagggggtttatgtgccgcgcgcccctcatttcttgttgtcggcgcacttaccaaggagcggggcggaggcatttcccaatacacaacaaaagaggtcgcccgcacgttgcttgcgccttctcctttacagcgatagggtgggggaaaaacactttgggtggcgccctctctgcatctcccgaagaatacgcaaaataacan

SEQ ID NO: 91393 - protein, 129 aa, Zea mays
  misc_feature: Ceres CLONE 1579737
MVGMRGAYGGACNDDSKSRLHGGKAAEPEIASMAVHKVAPPPARSTASKMKVRVKETFFPDDPFRAFKGQPPGTQWLMAVKYLFPHLDWVPSYSLSLFKSNLVAGLTIASLPIPQGINFPQNWVNFASP

SEQ ID NO: 91394 - DNA, 1067 bp, Zea mays
  misc_feature: Ceres CLONE 1579742
  misc_feature: Encodes the peptide sequence at SEQ ID NO. 91395
  misc_feature (682)..(682): n is a, c, t, g, unknown, or other
  misc_feature (858)..(858): n is a, c, t, g, unknown, or other
  misc_feature (888)..(888): n is a, c, t, g, unknown, or other
  misc_feature (908)..(908): n is a, c, t, g, unknown, or other
  misc_feature (1018)..(1018): n is a, c, t, g, unknown, or other
  misc_feature (1047)..(1047): n is a, c, t, g, unknown, or other
ctccccgcggtggcggccgctctagaactagtggatcccccgggctgcaggaattcgtctcacccctagaaaaaatcggccgatgctgcggcgactgaccacagctttcgaccctctccagtggagggaacggggttagcgagcggcctccgctgcgacggcaacggcgtgggagggccatggcggcccccgcgctcgccttccccatgttgctggctgcctcactgatctccgtcgccgctcctgcgctggctcgaagcccatcttgccctgatggttggcaagtcggccctgttcagaacagatgcttcatgtacatatcagcctccctttcttgggatagatccgaggctgtctgccataactacagcgggcatctcgctgcagtatcatcaatccaggagctaaacttcgtgaagtctctctgtggatcatcatccacaggatgctgggttggagggcatcactacagcactagtaccggtaacggttgggaaatggtctgaccattcctcctgtttggaatgagaactggcttccttggtgaacccattgccctggcaactggcagtggatcctggcttggtaaagtagcccaccaagccaacgattttgtgttacttttgggtcaccaaagcgggtcaacccttctcaacttattttcctggaaaaaaaaggtgcncgcgtgagatccccattgggttcctcattcctggccgggattgaaaccccccgtgggaccagaatgccttcccatcggattcattggtctaccaagggagttattgttcattatcccatttattggcttgcggagcgcgggtttccatcccgtgcggaaaccaacttctagccctntttgtgggcttcggcccgccgtggttttcncggcgtagaccagggaaacncaaagaagaatcccgagggaaggtgttaattggccgctcaccccgcgcgacctctggtgcgaccgtcatgggataggtgtccacccagggaagaaacttcgtcgtgatcnataagaccctcttagagagggaaccggcntctccggaaaccaaatacag

SEQ ID NO: 91395 - protein, 108 aa, Zea mays
  misc_feature: Ceres CLONE 1579742
  misc_feature: SWISSPROT Homolog: EC 3.4.21.84 Limulus clotting factor C
MAAPALAFPMLLAASLISVAAPALARSPSCPDGWQVGPVQNRCFMYISASLSWDRSEAVCHNYSGHLAAVSSIQELNFVKSLCGSSSTGCWVGGHHYSTSTGNGWEMV

SEQ ID NO: 91396 - DNA, 963 bp, Zea mays
  misc_feature: Ceres CLONE 1579746
  misc_feature: Encodes the peptide sequence at SEQ ID NO. 91397
ctccccgcggtggcggccgctctagaactagtggatcccccgggctgcaggaattcgtctcacccctagaaaaaatatgagtctgcgggtgtgggtgtttgcgagcttttgttgttttgcttttttacttgttttgagtgcaactgtttgtttggatttccctgttctctttgttcttttgttaatctcggaagagtcctaagcggccgatgccttagcttggagtttttctcggctccttgtggatttgtttcttgtttcagatcagttccaagcacatacatatgagaagcgaagaaggggaaggacgaagaacactgccgaccctattcctagcaacgggccaaagcgaccagctgcaggaaggagaagcagtgttggcgcgttcgagctggcggtgccaggataaatcgggaggaagtgatggcatcgaattcatcggcggcgttctttggtgttagggatggggaccagcaagaccagattaagccgctgatatcaccgcagcaacagctggcagcggcgctgcccggtgtggcaggcggtgttcctgcggcgtccggccaaggcgcgccgccggcgcagccaccgcccaagaagaagaggactatgcctgaccccgacgctgaggtgatcgcgctgtcgcccaagacgcttatggcgaccaacaggttcgtgtgcgaggtgtgccacaaggggttccagcgcgagcagaacctgcagctgcaccggcgcgggcacaacctgccgtggaagctgaagcagaagaacccgctacaggcgcagcggcggggcgtgtacctgtgccctgtacccaactgcgtgcaccaggaaccgggccgcgccttcggcgacctgagggggatcaagaagccttctgccgcaagcccgccaagaaaatgggaagggcaacagtgctccaggccttacccttgcaatcggactggaaagggcattcctaat

SEQ ID NO: 91397 - protein, 180 aa, Zea mays
  misc_feature: Ceres CLONE 1579746
  misc_feature (84)..(106): Pfam Name: zf-C2H2 Pfam Description: Zinc finger, C2H2 type
MASNSSAAFFGVRDGDQQDQIKPLISPQQQLAAALPGVAGGVPAASGQGAPPAQPPPKKKRTMPDPDAEVIALSPKTLMATNRFVCEVCHKGFQREQNLQLHRRGHNLPWKLKQKNPLQAQRRGVYLCPVPNCVHQEPGRAFGDLRGIKKPSAASPPRKWEGQQCSRPYPCNRTGKGIPN

SEQ ID NO: 91398 - DNA, 623 bp, Zea mays
  misc_feature: Ceres CLONE 1579747
  misc_feature (256)..(256): n is a, c, t, g, unknown, or other
  misc_feature (269)..(269): n is a, c, t, g, unknown, or other
tggagctccccgcggtggcggccgctctagaactagtggatcccccgggctgcaggaattcgtctcacccctagaaaaagctcggccattggactgtacaaggacgagagcgagaacagcggattcatcaccgccaggcgtcaggtcagagtgtgttaagacaagatggtggcgaatggtgatgcacctgctagagggagtgcggcggcagctgcaagcctgcgctaggcgtaggaaccacaagcggtgcctgctnggtggtggaggcnggtgcccagctcgatgctccagttctacactgatgaggctgcgggccgcaaatgtcacaaacaccgttctgatcatgagcattgggttcatcgccgtttgtccctatgctccatgtttttgggaagctgtacccaccccccactagggttggattttccctaaccccaaaaaaccctgggccccccaagaaacggggaccctttaaaaagggggtttttttcaggggggaaagcccaggggggcctttttcaaaaaaagggaaccccttctgtttaaagagccgttttttcccggggggaaaaaaccctttgaaaaacacctttttttttttttaaaaaaaaaaattttttttt

SEQ ID NO: 91399 - DNA, 1229 bp, Zea mays
  misc_feature: Ceres CLONE 1579749
  misc_feature: Encodes the peptide sequence at SEQ ID NO. 91400
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (84)..(84): n is a, c, t, g, unknown, or other
  misc_feature (750)..(750): n is a, c, t, g, unknown, or other
  misc_feature (752)..(752): n is a, c, t, g, unknown, or other
  misc_feature (775)..(775): n is a, c, t, g, unknown, or other
  misc_feature (936)..(936): n is a, c, t, g, unknown, or other
ttttgtttttttgggtggcctctctcccggttctattaaccacgggtccgggggggacggggggccncnnnnntgcatgctggnactcaccgcggtggcggccgctctagaactagtggatcccccgggctgcaggaattcgtctcacccctagaaaaaacggaaaaacgccatctcattcgtcttcctccatcttgtctctacttgccccgcgccggggagccgcgagcgtcgcgccactcccatcgcctgcccacaactccggcatggagccgtcggcgtgggccgtcgccttcgccgcactctgcatcgtcacgctcgcgccgccggcctcagggttctacctccccggcgtcgcgcccaatgacttcgagaagaaagatccacttcctgtgaaagtcaacaagctgacctcaatcaggacacaacttccctagtccggaggagtccctcccactctcccatcccggatatggtgtggggataatgcataaaaaatttctgtagaaatttctacggggaagatccccaatgaaaaatgcttgcctgatatggtttggaaaaggtgggggatgccctgccgaggttggtcagaacttattccggccaaaaactttctctgttttcggggacactaagagaaagacataaagctcttcttcaaagggatataaaaaatttgaaaaggaatgtgaatattgtccggtggcgtaaaaccagggaagttatcaagtggaaaagaattctccnancctgtgaatgggagaaccgcgcngtacccctgcgattctttatatagggaacggaggagtgaaactcgctaaggtaaaggaggggggcgcggtcaaattttttgcactggagtgaacaaagaaccgggcgcggtattggttgacaagcgacgaacagacggggtcacatataaaatgggaagancacgttttttccatgggggggtaggggcctgagttggacgggcagggaggcaacacggttgtgtgatggcacaaacgagaattcttagttttgtggtattatttttgtggtgttgcgaataaaatgtggtgtgtgcaacgggtgtctatggtgcacgatgaatatggaaatattatatggcacaggagctttgatgtttgtccccttttctgaactattggataaaaaaagagtaccaagcgtatattatatatgaactgtatataagtctgtagtgagttctatacgttgtg

SEQ ID NO: 91400 - protein, 56 aa, Zea mays
  misc_feature: Ceres CLONE 1579749
MEPSAWAVAFAALCIVTLAPPASGFYLPGVAPNDFEKKDPLPVKVNKLTSIRTQLP

SEQ ID NO: 91401 - DNA, 953 bp, Zea mays
  misc_feature: Ceres CLONE 1579751
  misc_feature: Encodes the peptide sequence at SEQ ID NO. 91402
ctccccgcggtggcggccgctctagaactagtggatcccccgggctgcaggaattcgtctcacccctagaaaaaatcccccgtcgagcacacaacacatcctcctccaagactcgcttcgcttctcccccagctcggacggagctcctcgcagtcgcagcagccgccgatcaacctgcgctcgggctcagcgctggaaggtgttggaagagaatagcctgaaggttcacagtaaccttcatctgttggaagatgtatcgggctaagagggctgcattgtcaccgaaggtgaagcgccgcgtcggcaagtacgagctcgggcgcaccattggggaagggacctttgccaaggtccggtttgctaagaacaccgaaaacggggaacctgttgctatcaaaatccttgacaaggagaaggttaagaggcacagattggttgagcagattaagcgtgaaatttgcatcatgaaattagtaaggcaccctaatgttgttcgactgtttgaggtgatgggaagtaaagcaagaattttcatcgttctggaatatgttaccggcggagagctttttgaaatcattgctactaatggaagattgaaggaagacgaagcacgtaaatacttccagcaactgattaatgctgttgattactgccacagtaggggagtgtatcacagagacttgaagctcgagaatttgctgcttgatgctggcagaaatctcaaagtttctgactttggtttaagtgctttaacgaagcaagggaaagctgatgggctgcctcatacaaatgggggaacccccaattatgttgcccctgaggtgatcgaggaaggagcctatgaaggtgcaactggcgaattcttgggctgccggaagaaacccccttggttcctcttggcgggaattttccttttcgaggaataaaactcctccgcccctatacaaaagatt

SEQ ID NO: 91402 - protein, 224 aa, Zea mays
  misc_feature: Ceres CLONE 1579751
  misc_feature (20)..(214): Pfam Name: Pkinase Pfam Description: Protein kinase domain
  misc_feature: SWISSPROT Homolog: EC 2.7.11.1 Non-specific serine/threonine protein kinase
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAGRNLKVSDFGLSALTKQGKADGLPHTNGGTPNYVAPEVIEEGAYEGATGEFLGCRKKPPWFLLAGIFLFEE

SEQ ID NO: 91403 - DNA, 1056 bp, Zea mays
  misc_feature: Ceres CLONE 1579752
  misc_feature: Encodes the peptide sequence at SEQ ID NO. 91404
  misc_feature (974)..(974): n is a, c, t, g, unknown, or other
catcatccccttccattagcaacaatttttttattaccctcttcccccttgctcccccatccccaaataaatattcaaactggaactcaccgcggtggcggccgctctagaactagtggatcccccgggctgcaggaattcgtctcacccctagaaaaaaaccaaccctccttggctggactggacccccaacccaacaacagcagcaggaacaggaaaaagaaaaaactctctcccattcccatctcgcctcccacctcctccgcctcgccgccgcggcaggcaccgccaccaatcttctcttccgccccctcgttcgttcgctcgctcgctcgccaggagatcgactcgaggcgaggccatgaagtacgtgctggtgaccggcggcgtggtgagcgggctcgggaagggcgtgacggccagcagcatcggcgtcgtgctcaaggcctgcggcctccgcgtcacgtctatcaagatcgatccatacctcaacaccgatgccggaaccatgtccccattcgagcacggcgaagtgtttgttttggaccatggcggtgaggtggacttgagaccttgccaaactaagagagatttcctgggacactcaagcttgactcggtgacaacaatcataaccaccgggggaagaatatacccccccttgttcattgtactaaggaaattttcgaaagcagacattactcttatgaaaaaaacctgttttcaaggtcccgtagacacactaccgttcacaaaaatggaaaaataccaaaacaattggggaattttcaacacccacttgcgcacaatgtaaattccccggctttgaatggacccacccgcataaaaatccccgccccccaaatagattcccgcacgtaccaataagaataactttagggaaggcggaacccaatttaggcggggcaaccaattgctaaaatccaaatttgcccccttttcctaattaataancagaccacccataagggggctcatatatttttttgcccataatacctgggtagtattataggtcccccccgtgcgcctaata

SEQ ID NO: 91404 - protein, 86 aa, Zea mays
  misc_feature: Ceres CLONE 1579752
  misc_feature (1)..(87): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTSIKIDPYLNTDAGTMSPFEHGEVFVLDHGGEVDLRPCQTKRDFLGHSSLTR

SEQ ID NO: 91405 - DNA, 871 bp, Zea mays
  misc_feature: Ceres CLONE 1579755
  misc_feature: Encodes the peptide sequence at SEQ ID NO. 91406
  misc_feature (753)..(753): n is a, c, t, g, unknown, or other
  misc_feature (801)..(801): n is a, c, t, g, unknown, or other
  misc_feature (822)..(822): n is a, c, t, g, unknown, or other
  misc_feature (871)..(871): n is a, c, t, g, unknown, or other
ctccccgcggtggcggccgctctagaactagtggatcccccgggctgcaggaattcgtctcacccctagaaaaactcccttcccttctcctctcttccccgaaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggcggcggcggcccgcgcgccggccgcctcttctcccccgccttcgccacctccgtctctggagacttcctccgcccgcacggcgggggcgcctccggcatctccaagatcggagattcacattttgagccacgtgagcgtgttcgatacacaagagatcaacttctcgagctgcgtgagattgttgatgtgtctgaggaaattttaagaatcaagcaagagattgatgtagagcttcatggtgaagaccagagctgggttcgcaatgattcaactgttcaaggacaagcacaagctcaaacacaagcacagaatcgctatgctgagactgatagccgtgattggcgtgcacggtctgcacagctgactccgactaatgaagaaaaatcttggggacacataagggagggctaagaagcctatgcctctagcggtagggcagcagagcaagctaacaggcaagatcagntaagctcccagtttgcttcgaaagctcaggttggccctacccctgctnctattaagggctgagtgcccntggtcagcccgaagagggcatctctcggaaaaagaagaagtcttgaaan

SEQ ID NO: 91406 - protein, 150 aa, Zea mays
  misc_feature: Ceres CLONE 1579755
MQPDQPVISLRPGGGGGPRAGRLFSPAFATSVSGDFLRPHGGGASGISKIGDSHFEPRERVRYTRDQLLELREIVDVSEEILRIKQEIDVELHGEDQSWVRNDSTVQGQAQAQTQAQNRYAETDSRDWRARSAQLTPTNEEKSWGHIREG

SEQ ID NO: 91407 - DNA, 1048 bp, Zea mays
  misc_feature: Ceres CLONE 1579758
  misc_feature (1048)..(1048): n is a, c, t, g, unknown, or other
cctagctggtagctcacgcggtggcggccgctctagaactagtggatcccccgggctgcaggaattcgtctcacccctagaaaaaatcgccccgaccaaagcttccccagacggcaggagacagcagcaggccggacgccggactcctcctccctcccccgtacgcatccactgagatccttcctgtgcgaaggaaatctccagttcttcggccccggccaggttttcaagtgttgcttgccccgccggagttttcctctaacccgcaagtccaattggctaagaagttgatgggatcggggggacactggaaggctgtgtgagatcgcgaaggggaccgtgaattccttgcaaggctacagagatacggctgcccccctccaccaaccggggtggggtgggggtggggtcgactccaactctgaacacttaggtggtgcttgcctcctcatcttccctgcacgcaattctcaccccctgtttgggtaagtgccaaccaatgtttgatctcaagataaggtaattggggaaggaatttgcaaaaataagcctgcgccaggaggggcggtaaacaaaccagggtgcaatactgagttgaaaaaatgccgtaaggggaaaaagaggcgcagcaagaaccgaccagttcctgtgggtcattattgggttcatttggtggttggcgttgggtgggatttgtggcctgggggagactggggacctgtgatgtgccgtagaattggactctctacggaaaagtattgtattgtgctgttttcccgaggtttattctttctgtagctggggtagatcccgcggttgtgatatagtaaagttgagacggggccggaagaaatccactttattagttttgtacgtctgtgggggggattttttcatggttcgtatttggggtggagacagtttgtcggagtgccgctcggaggcacaatgtttattaaatgaatcccccatgtgggccatgatctttgcgggaggcgttgtgaatgttccaattttgacatgattgggttgggggggaggatgcctn

SEQ ID NO: 91408 - DNA, 849 bp, Zea mays
  misc_feature: Ceres CLONE 1579761
  misc_feature: Encodes the peptide sequence at SEQ ID NO. 91409
tccccgcggtggcggccgctctagaactagtggatcccccgggctgcaggaattcgtctcacccctagaaaaacttgcaagcacaactgcacaagggaacaggaggaaaaaagagcgagaactcgcagctgacgcgcacacggcaagccccaatcggagccgcggaccggatcagaactaggtctcgaggcgatggcaagcggaggcgagggcgcagggagcggcgaatcccctcccgccgcctcagtggaggcggcagcggtcgaggcgacgctgcacatccggtgcgcgaacggctccaagttcacggtgcagacggacctgggcgccacggtgggcgcgttcaaggaggtcttatccggtagctgcggcgtgccagcaccgcagcagcgcctgatctacaagggccgcatcctcaaggacgagcaaaccctagacagctatggcgttgagacggatcacacaattcacttggtgcgaggtgtcgccacaccagctgcatccagtgcacctgctgctgccaacccccttgcttcatttactcctagtagtggccctgcaggtggcctgggaggcctatttccaggtgttgatgctccaggaaatgacaggccatcaggtatatttagggccaggattttcagaattagagcaagttgagcaacatttaagccagaatccccacttgatgagggagataaatgattatgccgggcatgcaaaatctcatgaaataaccctgattttataccgtaatatgatcatgaacaacccacaaatgcggcgagaacatggaatcgggaatcccggaatcttggcccatgtggcctcaaggaacccaaggcgtca

SEQ ID NO: 91409 - protein, 155 aa, Zea mays
  misc_feature: Ceres CLONE 1579761
  misc_feature (31)..(99): Pfam Name: ubiquitin Pfam Description: Ubiquitin family
MASGGEGAGSGESPPAASVEAAAVEATLHIRCANGSKFTVQTDLGATVGAFKEVLSGSCGVPAPQQRLIYKGRILKDEQTLDSYGVETDHTIHLVRGVATPAASSAPAAANPLASFTPSSGPAGGLGGLFPGVDAPGNDRPSGIFRARIFRIRAS

SEQ ID NO: 91410 - DNA, 813 bp, Zea mays
  misc_feature: Ceres CLONE 1579762
  misc_feature (697)..(697): n is a, c, t, g, unknown, or other
ctggagctccccgcggtggcggccgctctagaactagtggatcccccgggctgcaggaattcgtctcacccctagaaaaaagaagttgcaggactaaaggcgagcttgagtacacttacatctgaggtacaacgtttgtataagttatgcgctgagtggaaggaagcagaagattcactgaagaagaagtggaagaaaatcgaagaatttgacgcccgtcgatcagagctggagttcatttacagtgctcttcagcgggccaatatggattcatcagcattttgggagcaacagccattatcagctagaggatatgcatcaactacaattatccctgcgtgccatgctgtggtagacatgtctacgaactcaagggacctcatagagcgagagttagctgcatttagccagagcttggataatagcttgtgcaggttgccagcaacccctcaggttagtagtgttatatgcttaaatcgattacttccaaataatatctgtctgctatgttcccataccagtactcgtctatatctgctttacctgaatgaactggatgagcatgagccactaaaaatatgctaggcagttttctccatatattgcctttgtcatgttgacattgatgaaacatgtccaatattatcattttcaagattccagttcttagtctcccctttagctgagcttttgaaantggttatttcttttgcaaaaaccaaccaagggggtgaaaagtaatagctgctttggagtttggaccaaaatttggttctcctctagtaccaaactgaaagtaactccgcgccctcc

SEQ ID NO: 91411 - DNA, 833 bp, Zea mays
  misc_feature: Ceres CLONE 1579763
  misc_feature: Encodes the peptide sequence at SEQ ID NO. 91412
ctccccgcggtggcggccgctctagaactagtggatcccccgggctgcaggaattcgtctcacccctagaaaaagtccaattcatccaccttgtccgtccctccctgagaaccagaaggccacccaccttccaaggcaggggaggggccatggacgaccccgtcgagcgcttgaaggacgggttccacaagttcaagaccgaggtctatgacaagaagccggagctgttcgagcctctcaaggccggccaggcccccaagtacgtggtgttcgcctgctccgactcccgcgtgtgcccgtcggtgaccctgggcctgcagcccggcgaggccttcaccgtccgcaacatcgccgccatggtcccagcctacgacaagaccaagtacaccggcatcgggtccgccatcgagtacgccgtgtgcgcgctcaaggtggaggtcctcgtggtcattggccacagctgctgcggtggcatcagtgcgctcctctccctccaggacggcgcacctgacaacttccacttcgttgagaactgggttaagatcggcttccctgccaagattaaggtgaagaaagaccacgcatcggtgccgttcgatgaccagtgctctattctagagaacgaggccgtgaacctgtccctggagaacctcaagacctaccccttcgtcaaaggagggctggccaacgggacgctcaagctggtcggcggccactacaacttcgtgtcaggggagttcctcacatgggacaataagcagccatcgtggatctatatatatacactacatgatgcatgttcggtatcagcatgcagctacatactttatttt

SEQ ID NO: 91412 - protein, 228 aa, Zea mays
  misc_feature: Ceres CLONE 1579763
  misc_feature (31)..(201): Pfam Name: Pro_CA Pfam Description: Carbonic anhydrase
  misc_feature: SWISSPROT Homolog: EC 4.2.1.1 Carbonate dehydratase
MDDPVERLKDGFHKFKTEVYDKKPELFEPLKAGQAPKYVVFACSDSRVCPSVTLGLQPGEAFTVRNIAAMVPAYDKTKYTGIGSAIEYAVCALKVEVLVVIGHSCCGGISALLSLQDGAPDNFHFVENWVKIGFPAKIKVKKDHASVPFDDQCSILENEAVNLSLENLKTYPFVKGGLANGTLKLVGGHYNFVSGEFLTWDNKQPSWIYIYTLHDACSVSACSYILYF

SEQ ID NO: 91413 - DNA, 992 bp, Zea mays
  misc_feature: Ceres CLONE 1579764
cgctcttaactagtggatcccccgggctgcaggaattcgtctcacccctagaaaaagagctgacagcaaagcaaagcttgagaggcttttctcaaaaacgcgccgtcgccgtttcttccccctttttctttgagaaaattcgcccgcgagatctttagtttcagaccccgtgtggattagtcgctgtcacgatcgaggcggggcgccaattgcggtggccaccacctccaatccactccccgcggtggcctcgccgagctgttcttgctccgtcctccctccaactccaagatttgtttcgcacccgattcctgagcttccgcggcgcttcttgctgaaaagaaagctccgagttcttcagttctggatcgatacagaggcggttcctttgcgggctctgaggttcagctctcgctcttgatttgtctcatcgacgcatcagttgggctgctggcttagagctggaaggaataatttgtctttgagaaatggggcagtggttgtagcttagctcccgccccggactctggacgggggaggcaccaatgggtttgggcttttcctaaccggggaaatgccagcggcaaaccccttttgtggtttcaacccttccccagtatcccggccggaggtggtgggtaccaccgccttcgggcgaacgaacccgtccgggggtgtcccacccggttgtcctggtggcctggtgcccccgctacccccacggcggataactaattctttgtgataattgttcttaggaatttcgcctctgtcttctccctccgaaaaaggagtttggccccgtggccagttttgggggtgttattctcctgctccgagcgtttcccgcgggggatgtagttaaccacgcgatctccccttccagtgtgtgttgttctcttctgggcgcacatgcggggaattccgcattagagttccgatcttggactattgcgcctgtacttccaaattagttagatctctgggagact

SEQ ID NO: 91414 - DNA, 1107 bp, Zea mays
  misc_feature: Ceres CLONE 1579765
  misc_feature: Encodes the peptide sequence at SEQ ID NO. 91415
  misc_feature (12)..(12): n is a, c, t, g, unknown, or other
  misc_feature (18)..(18): n is a, c, t, g, unknown, or other
  misc_feature (19)..(19): n is a, c, t, g, unknown, or other
ttttttttcctncctttnntctcctccatttccactctcttctcttggtcttcgacccgccccgacacataacaacaaactggagctccccgcggtggcggccgctctagaatagtggatcccccgggctgcaggaattcgtctcacccctagaaaaaactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggtgtcttccctctcaaggacctcttcctcatctggctcgtcaccatcacctgcacccctgccgaatccagtctctgttcccccttcttggtatttcaggaataaagggaatctggcatatttgcttaaaccaaaccccaaggacatttggaaatttttaatgctcggggttatggttgggccgccttcctttaaaaagttgttggggaaaggggccaatatcttcccttccaaaaccggtaatgggggggaaaatctcgggggggccttgaaataaaaggttcatgtgggaaagggaaaaaacccccagtgtttatttcggttaacccggaacacccctttttattgtggcacacaagagattataacccttttccaaaaaaaccctagaggtgtttcggggaaattaaaatccttccaaaaacctatattggaaaatgtgcgcactttaaaacccccactgccaatccccccccccttgtgagaaaaaccttggtggtgggggttaatcctccgcggcccccaatttaaagggggcttatatgctctaaaacaaaaagtggtggccccaaaaaagaaaataacaactccctcttggggctattggggccaagtttctttttcctccccg

SEQ ID NO: 91415 - protein, 74 aa, Zea mays
  misc_feature: Ceres CLONE 1579765
MGGGNGETTQLGEPLLAKKAKAYRPRCPGCRVDRLNAEREGVFPLKDLFLIWLVTITCTPAESSLCSPFLVFQE

SEQ ID NO: 91416 - DNA, 859 bp, Zea mays
  misc_feature: Ceres CLONE 1579766
  misc_feature: Encodes the peptide sequence at SEQ ID NO. 91417
ctccccgcggtggcggccgctctagaactagtggatcccccgggctgcaggaattcgtctcacccctagaaaaaacatctctccaggtctcctgggagcctcccgcgactgctctctgcccgccgacgctctcctgcgctgcgccgccatggaccgggacccttccgtctccgacgaggacgacgacctcgagaccctagtaccacagaaccacgccaagcccccgtccccctccgcccgctcccgctcgccgccctcctccttcatcgtcgccgcgctccgtccgacgcttccgtcctccgccgcctccctccggcgcgtcctctgggcccgccacgtcgtggtgctcttgttttccctcccgcttctcttcctagtcctctacttctcctactggggtgcgtcctcgcaccgcctgccctcctccttgctcctcccctccgccgtacccgccgcctaccccgtggcctcccgcatgcgcgaggtctatctgcgcgctctctacctactccgctcccagtactccggttggcctctgactctttccaccgcacccgcggacccccaccaaagagctgccggggccgggacccccagctcgaattcgccgattctccaagtccgacacttcatagagaccaggtcccaaaatctaaccatgttataatccatgtcggggtatccttgctcccacggctatagattcagggggtccgggaactggttgtacctaaaggaagtgggctggattaaacgaatcggccctttatctacccgccttggctgggtaaggagggatattttggcgggacaaaaccggggtgggaacctattggatggtgaaaaaaccacaataaaa

SEQ ID NO: 91417 - protein, 63 aa, Zea mays
  misc_feature: Ceres CLONE 1579766
MSGYPCSHGYRFRGSGNWLYLKEVGWIKRIGPLSTRLGWVRRDILAGQNRGGNLLDGEKTTIK

SEQ ID NO: 91418 - DNA, 881 bp, Zea mays
  misc_feature: Ceres CLONE 1579767
ctccccgcggtggcggccgctctagaactagtggatcccccgggctgcaggaattcgtctcacccctagaaaaaagaagctgcaaccacaccgcaggcccccacaccagggagtatcgtcttctcgctcttgtccggttcgggtggtcctcggtctgggtgagtgagtgagcatctttgcttctccatctccccattcccttccctccccagcccccccggcccggcggcggtacctgaccctgacgccgcagagctagctatctcgccggaacggcatgtggctgctcgcgacctgagagcacatcatcatcggaccggctcacgcaggcgatcggcagaaaatatagacggagcactacctgtggagacagttgctgctgccgcggaccgccacacagcggccaaccgaaaagcgtgctgccacgccctcaaggggcccgggtacgccacgcctactggaggccatgtagaaggcctccagcgtaaagctcgtctacgtcacctgcttctacaactgcactggaattaacaagcctgattaccatgcgaccgtggatttggatactcagctctcctacatactaccagggtgatccacaggcatctcggtcacctacatcggcgacgagctgcatcactctggactgaactcctgcaactcctgccacgttgacccatactccaagcgccgcttactgatcctgccttccttgctgttagggcctgtggagtcttctacacatgacatacccagggcgtcatcctagaaaagtggctatttgagacttgctgaaatacgggcttgggtcctcaaccaccaatacgtgcgtggggaatataattctgcttgggaaagaggaatgcctggaattcttccaa

SEQ ID NO: 91419 - DNA, 955 bp, Zea mays
  misc_feature: Ceres CLONE 1579769
  misc_feature: Encodes the peptide sequence at SEQ ID NO. 91420
agctcaccgcggtggcggccgctctagaactagtggatcccccgggctgcaggaattcgtctcacccctagaaaaagaggtcgagggctcctctctctctaccatctccgttcgatcccatcgccccgccgccgccatggcgtttctcgcgcgggcgctgcggcagtccaactggcgcctgtcgtcgcgctgccccgccgtggccgcctcctgccgttggatctccccgaccgccgccgcgggatcgccggaggccggcgcggcggtggcgtctgccgacccggagctgcctccgccgcgggagcccgttggcggcgcccgcgtggagcttcctcctaacccggaggacgcgctcgaggtattcgtggatggccatgcggtgcggatccccaaggggttcaccgtgctccaggcctgcgaggtcgccggcgtcgacatcccgcgcttctgctaccatagccgactctccatcgctggaaactgccgcatgtgtctcgtcgaggtcgagaagtcgcccaagcccgtcgcttcctgtgccatgcccgcgctcccagggatgaagattaagacaaacaccccagtggcaaagaaggcaagggagggtgtcatggagttcttgctgatgaacatccactcgactgcccaatctgtgatcagggcggcgagtgcgacctccaggatcagtctatggcatttggtgctgaccgcggccggttcactgagatgaagcgttcagttgtggacaagaattgggtccctttggttagacagtgatgactcgttgcatccaatgtacaaggtgtgtcaagtttgctactgagagtgctggaatcaaaaaccttggtatgtaaggtcgtgccagtggtgaaaaaaattggaaatttgttgagaaactattgacagtgaccttcttgaaaagcctggaaatctgcccgtggggggccttaactcaaga

SEQ ID NO: 91420 - protein, 196 aa, Zea mays
  misc_feature: Ceres CLONE 1579769
  misc_feature (75)..(139): Pfam Name: Fer2 Pfam Description: 2Fe-2S iron-sulfur cluster binding domain
  misc_feature: SWISSPROT Homolog: EC 1.6.99.5 NADH dehydrogenase (quinone)
MAFLARALRQSNWRLSSRCPAVAASCRWISPTAAAGSPEAGAAVASADPELPPPREPVGGARVELPPNPEDALEVFVDGHAVRIPKGFTVLQACEVAGVDIPRFCYHSRLSIAGNCRMCLVEVEKSPKPVASCAMPALPGMKIKTNTPVAKKAREGVMEFLLMNIHSTAQSVIRAASATSRISLWHLVLTAAGSLR

SEQ ID NO: 91421 - DNA, 822 bp, Zea mays
  misc_feature: Ceres CLONE 1579771
ctggagctccccgcggtggcggccgctctagaactagtggatcccccgggctgcaggaattcgtctcacccctagaaaaacgcttcgtcaacaccggaaccgcccccaccccgccccgagcgccaattgcaccgccgctcccggccaaaccggccaagtcaacggcgcatccacttctccttaccatcccggaggtaatcttgcgccgattcggtgccgatttgcgccatccgcgaccggaggctccgccgggtcttgtgttcttgcggggcgggggctcaggacaacctggcctctgcttgattggattcggggcgttcggcgcctccagctcgcgatctttcctgccggtttcgtcgaccgctggtcaacctggccggtcggtcccgggggctcttcacctccgtgctgcctgccaccgtcgctttagtcaagtctcggccaagagtttagctatctccgggcaaaaggctttaccgattcttggattggtggcttcttgggggcgagaagccggttcctgtttcgtctcttgtgctccagcatgttctgtagcacaccggttccccatctccagtgaaggtgttcgtgtgctcttggttttgtgcctcccggaatcgttcccggaaagctacttttggccgctgcggcgatggcgtcgagcaccagcgagatggccgaagggaaagagaagctgaaagagtccggcaagcttggggagcaaacgatacgtaatgtgcgtgcagaacaagattgatcttaccgagccctcggacatccagcttggagaaacagccttcaccaagaacctgggggcaaaaa

SEQ ID NO: 91422 - DNA, 1103 bp, Zea mays
  misc_feature: Ceres CLONE 1579775
  misc_feature: Encodes the peptide sequence at SEQ ID NO. 91423
  misc_feature (79)..(79): n is a, c, t, g, unknown, or other
  misc_feature (673)..(673): n is a, c, t, g, unknown, or other
tttttttgttggcggggggcccggccgtgctcgtggcgctgggcttctttccctcacgtgtcggaggagaaaaatatanaaaaactggaactccccgcggtggcggccgctctagaactagtggatcccccgggctgcaggaattcgtctcacccctagaaaaaagcctcaaactcttgccctccccccggcaccacactagcctagtgagaagtgcagcagcagcaccagcggcagaagtgttacttagttgctcctcctacctgtgctgctgcgcaggagcagagcctgaaaggacgacggccgtcggcgtaaggggagcgagcgagcgagcggccatgaagtacgtgctggtgaccggaggggtggtgagcgggctcggcaagggcgtgacggccagcagcatcggcgtcgtgctcaaggcctgcggcctccgcgtcaccaccatcaagatcgatccatacctcaacaccgatgctggaaccatgtcgccgttcgagcacggggaggttttcgttttggacgatggcggagaggtggacttggaccttggaaactacgaacgttttctggacatcaaattgaccccgcgacaacatatataacgcgcggggaaagattcttccaaggcttgtcatttaacaagggtagagggagaagggcgtacttaccntaaggggaaaagaacccggtcccaaggttaggtggcccgccatcaattcaacggggaattggaagaaataccagggggaaccttggggaattaccgaaaacgagccgtttccccccggagttgtggttcctcccaaggttggggaaacccgcctaaaggggaaaaagggggccccttccccttgaaaccgatccttgacaggtttcaattcgataagtccttctcggtggggggcccaccttatttagggggggaaaattaattccaaagggtccaaaatggccctctttttccaattttgaaaaagccggatttaagggtttccaaaatttccctccgcataaacccggtgtgttttggggaaccccctgggtaaaaaaacctttccttgtgtccgccgatattcaatgggttcaaagaaccacttgga

SEQ ID NO: 91423 - protein, 88 aa, Zea mays
  misc_feature: Ceres CLONE 1579775
  misc_feature (1)..(89): Pfam Name: CTP_synth_N Pfam Description: CTP synthase N-terminus
  misc_feature: SWISSPROT Homolog: EC 6.3.4.2 CTP synthase
MKYVLVTGGVVSGLGKGVTASSIGVVLKACGLRVTTIKIDPYLNTDAGTMSPFEHGEVFVLDDGGEVDLDLGNYERFLDIKLTPRQHI

SEQ ID NO: 91424 - DNA, 1221 bp, Zea mays
  misc_feature: Ceres CLONE 1579776
tgtgtgggagttcttttttttttttaggtatgatcatactataagtattagaggagaaattgagattttttttttccatgctggagctccccgcggtggcggccgctctagactagtggatcccccgggctgcaggaattcgtctcacccctagaaaaagctggcgtgatttcctccgctacgctccgctccccattgcaggattgcgcctagcacgaacacgctcatcccataaacctcttcttggctctgctttcggtggtatggtgggaggatgaggaaggataaaatgctgttctgtctcctctgctgcctcgccggcgccggagaggcggcgtctcaggtgggcgagggggaggcggaagatctggccgtgtaggtagaccatttgaggtagtggcccagccggggggagcatgacgtgatcgaggatctgtggtatcttgaaaacataggacacctcctcctatgggagggggtgcacgccccacactacgtggagtcacggagttatgtcagaggatgctgtgagtcttctggtcataccacttgccatgttggggatagaagggatttatctgggaagcctcgaccgtagaactgggaccttgaagccttttaccgtgcggtaggaacattcagtatggggctgtacattatctgagcaggataggccaaggacacttcgtgcgggccggaaccccttggcagacctgggatccaacgcgttaagagaggtacgcggataccgggctcttgccatatctagatagacttccggtacattcgtgaggacagaaatattttggatgtctaagctgggcgatttggccagaaattttgtggtaatgcttatcgagaattccgctgcggaatcgctcgctaaaggctaaacaaattgagcgacatgccaggacgagcgggggggtaacaacaattatctccggagagccagggtaaagtgtgtgattattacagaagatgcgcctcacgaaatctagatgataaagaagatattcgcattgcagggtgcttgggaaggccaagatagggaaaggagtgttatgatatgagtgtgtgatccatgttaactacagtgagctgggtaaagtaattctattttataatccgatcgcggcagttttggggattctccaattgctgtgacacactggttgcggacgaaaaaggccgaaagagccgcggttgcagtcgtagaaa

SEQ ID NO: 91425 - DNA, 1256 bp, Zea mays
  misc_feature: Ceres CLONE 1579778
  misc_feature: Translation starting site: 303
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (451)..(451): n is a, c, t, g, unknown, or other
nggggggggggtttnnnttttagggttggtggcagcacaacacacgggcgccgcggccaggcccaagagaaaannanttcaaaactggagctccccgcggtggcggccgctctagaactagtggatcccccgggctgcaggaattcgtctcacccctagaaaaacatcaccaccaccccgcggctgcagctcagcagctccagacctcaccagaggcacctaccacaccgcccgccgccgatcccgtcacccgtctcctccccgctgcggagcgtctccagccctgcccggtgcccgcccagatggcaaacgcggcgtcagggatggccgtggacgacgactgcaagcgccggttcctggagctcaaggccaagaggacgcaccgcttcatcatctacaggatcgacgagaagaagaagatggtggtggtggagcaggtggggcaagcccntgctccactacgacgacttcgccgccagcctcggcggcaacgagtgcaagtacgccatcttcgactacgacttcctcacccgaggagaactgccagaaagagcaaagaatctttctttcatcgccctgggtctcctggaacactggccccgcgctgtagggaagccaaggatggaatcttaccggccaagtcctcccaaagggaagaaaaggtttccaaagcccggggtaaaccttggggaaacagggcaaatttctcaagggtgggggaattctcctccacagaggggcccaaacccggtaaaacttccccctcccccgaagagggggttggggggggcccctctttgtgggaaacggggtttatagttttccccaaagaggggggccccccccctggtcgcaaaaaagactctcttataaaggagaaaatgcgccccccaaagagggggaaaagggaaaaaaacgtgggcccccccatgggacccccacaaaaagggagatagtgttttatggaagaagccacatctccctttctgcggtgttttccccgataatggggaggagaaactctttgggaaaccggggggtgcgcgagggggcctctctgtgtttataaaaaaaacaagtgggccttgtcccacaccgccccatgtgtggggatggataaaaatcgcaaattcctctataatacaaaaagcgtaaacgcacacccccccctccttttaagagggagggagcggagtgtttcctatttgccttaacaatatagtgcgaccgcaaccggcgactttttattttatgtg

SEQ ID NO: 91426 - DNA, 790 bp, Zea mays
  misc_feature: Ceres CLONE 1579781
  misc_feature: Encodes the peptide sequence at SEQ ID NO. 91427
ctggagctccaccgcggtggcggccgctctagaactagtggatcccccgggctgcaggaattcgtctcacccctagaaaaaatgtttgagcacacattgcacgcaggcaggacgcaggcgcacaccatctcctcccttgcccttggaaccgccacccttccacctcgctctcttctcttctcttcccttggctccgcccacctctgcggctctgcctcccttcggcaatggaggcggcgcctccaacttctccatcctccctggtgctactcttgctgctgctgctcatcatctcttccccttccagcgctttcctctcccccaagggcgtcaaccctgaagtgcaagctctgatgaacaacaaaaagcatgctcaaggacccccgtggcgtccctcaaaaactgggaacaagaacttcccgggatcccctgcaactgggacacccgtcagctgcttcgccagaaaaattcgttcacccggaacaggaaaccgttccatacacttccctctccctcctctatctctatgtgcgctgctcccagtcccagatcatattttcgctggccgaaaaattctttcccccccctatggtcatccctgtggttccttccccaaaattgttctgggggacggtgggaaattggattggttttggccggggagggcccccgggccaaaaaaccaacctgggctgtgttttgttctcccccccccccccccaaggggggggaggaccccccaccccccccccgccaggaaaatgttgttttccggacaaaaaaaaacaaa

SEQ ID NO: 91427 - protein, 187 aa, Zea mays
  misc_feature: Ceres CLONE 1579781
MEAAPPTSPSSLVLLLLLLLIISSPSSAFLSPKGVNPEVQALMNNKKHAQGPPWRPSKTGNKNFPGSPATGTPVSCFARKIRSPGTGNRSIHFPLPPLSLCALLPVPDHIFAGRKILSPPYGHPCGSFPKIVLGDGGKLDWFWPGRAPGPKNQPGLCFVLPPPPPRGGRTPHPPPARKMLFSGQKKT

SEQ ID NO: 91428 - DNA, 1192 bp, Zea mays
  misc_feature: Ceres CLONE 1579783
  misc_feature: Encodes the peptide sequence at SEQ ID NO. 91429
cttcttcttttatttttacccacaatatataaatttttcctcttttcttgccgcccacttctccttaccgataaaagaactggagctccccgcggtggcggccgctctagaatagtggatcccccgggctgcaggaattcgtctcacccctagaaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggagccgtccagcgtcccggccatcaacggcaacaagcctcacgggggctcttcttctccagcatcggccagggagctggccacacttccccacgccacccgcccgtgcacctcctcagttcttggctggtggcctattgactgtggacacctgggaaccgaactcaacggggcttcaccctttcggcccagattcggaattctaggggctatgactccaaagaactaacttttaaggaaagttgcagggggctaaaaaaatcccgaatcccattagatcccctgaggtgacggtcgactagacaataaacccgtatagcctttgtgcgtaatatttttcgccttgcaaagttcgaaaaaccgccaggtagctatggtatatatagagcgggtctcgccgcagattatgtatcccccgcatattgttaaaatttttgatgagatgcgcagcagcggtatgagcagaacatgaaccgagagcggcaaggcaattgctaggtgagaggtgtcacgcgggcctctcgaataatatataaaaatatcccgcacgacctcttggcacatatgtagtctcaaagataacggagataaaacactggaaagtcctcaccgcgggtgtattcttagtgagtgggccgagcgacctactccccgtggtggtaaagcgacaccccccctgaaaataatctatagattaaaaatttgtgaatgtgcgccgcccgctcttcctcgagtaattccccgcacaagatcgcccgatgg

SEQ ID NO: 91429 - protein, 149 aa, Zea mays
  misc_feature: Ceres CLONE 1579783
MAASASTVSGLAGASLASRPAFSTSFTRGSRVSARNPLMSRNLERNGRITCMTFPRDWLRRDLSVIGFGLIGWMEPSSVPAINGNKPHGGSSSPASARELATLPHATRPCTSSVLGWWPIDCGHLGTELNGASPFRPRFGILGAMTPKN

SEQ ID NO: 91430 - DNA, 912 bp, Zea mays
  misc_feature: Ceres CLONE 1579784
  misc_feature: Encodes the peptide sequence at SEQ ID NO. 91431
  misc_feature (26)..(26): n is a, c, t, g, unknown, or other
  misc_feature (34)..(34): n is a, c, t, g, unknown, or other
  misc_feature (64)..(64): n is a, c, t, g, unknown, or other
  misc_feature (73)..(73): n is a, c, t, g, unknown, or other
  misc_feature (93)..(93): n is a, c, t, g, unknown, or other
ggggggggggggggtgtggggagggncccttccnctgcgtcttcgcggcacgcgggttgggganttgtttgtnttgcaaactggagctccccncggtggcggccgctctagaactagtggatcccccgggctgctggaattcgtctcacccctagaaaaaacccgccccgccctagctcacacgccaagccccagtacaaacaaagcctacggaatttcccccagctccaattcgcgctgttcgttccctttcagccagtcagtcgccgcctccgctgaactggaagtccaaactagctagctcactgggcaccgatttcccccaatttttcgctgccaggaggccgcggcgaccatgggcaactgctgcgccgcgccgtcgacggagggaagcggcaagacccgccccaagaagcagaaggagaacccctacaacgtcgcgtacaaccgcggcgcggcgccgccggcgccggtgcgcccgggcctggtggtgctgcgggacccgacggggcgggacctcggcgcggagtacgagctgggcggcgagctggggcgcggcgagttcggcgtcacgtacctgtgcacggagcccgccacgggggcgcgctacgcgtgcaagtccatatccaagcgcaagctgcgcacgcccgtggacgtggaggacgtgcgccgggaggtggacatcatgcgccacatgccgccgcaccccaacatcgtcagcctccgcgccgcctacgaggaccgagacgccgtgcacctcgtcatggagctctgcaaggggaggggagctccttcaacaggatcgtccccccgcgggccactacacccgaactgcgccggccggccgccggtaaggcgccaacattcgtttgaagggtccgttccaaaaaatgaccaacagggcaatgggcg

SEQ ID NO: 91431 - protein, 185 aa, Zea mays
  misc_feature: Ceres CLONE 1579784
  misc_feature: SWISSPROT Homolog: EC 2.7.11.1 Non-specific serine/threonine protein kinase
MGNCCAAPSTEGSGKTRPKKQKENPYNVAYNRGAAPPAPVRPGLVVLRDPTGRDLGAEYELGGELGRGEFGVTYLCTEPATGARYACKSISKRKLRTPVDVEDVRREVDIMRHMPPHPNIVSLRAAYEDRDAVHLVMELCKGRGAPSTGSSPRGPLHPNCAGRPPVRRQHSFEGSVPKNDQQGNG

SEQ ID NO: 91432 - DNA, 1320 bp, Zea mays
  misc_feature: Ceres CLONE 1579786
  misc_feature: Encodes the peptide sequence at SEQ ID NO. 91433
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (45)..(45): n is a, c, t, g, unknown, or other
  misc_feature (977)..(977): n is a, c, t, g, unknown, or other
  misc_feature (1061)..(1061): n is a, c, t, g, unknown, or other
  misc_feature (1196)..(1196): n is a, c, t, g, unknown, or other
  misc_feature (1286)..(1286): n is a, c, t, g, unknown, or other
  misc_feature (1320)..(1320): n is a, c, t, g, unknown, or other
tttttttttttnnntnnccacatttaaaaaaatattataaattancgcgtgtcgtgtgttgaaccaaagacaaaatggagctcaccgcggtggcggccgctctagaatagtggatcccccgggctgcaggaattcgtctcacccctagaaaaaaacgcctcctccagtccttcttcgtaagcctgcaaaccgacgaatttgagccactgcacccagagcgcgatccattgccggggaagaagcaacttgttgcgagcctcctctatggcgagctccgaccatggttccaccaccgcccccaaggacgtgccgggaagctaccgcctgccactggtgggcgccgtgcgcgaacgcctcgacttctacttcttcgaggggaaggagcagtacttgtagttcctagtggagggctacagttccaccgtggagaacatgaaagaacccgccggggccccttatgggtgcgcgaactcggccgtggaggtaagtcctaggacgaataagaagcttaccccgtggcatcttccgactatggagcaatggctgggaaaatagaaggactcttgtttctacgagggaaaacctaagaatggcgattcaaaaacgtcccgttaacccgagtggggctttactctatatatcttggtgcttcctattatcgtggggaggcccctcttccgggaatcgcgcaatactctagataatataagggggggataatgccaaacacctggtctactatctcaccctcctcatttttatagggtagaacccgctccgcggtctaaatagaggggtagacacaacactaggtgtgcagggtatactaccaaccaaccacgtttttacacattaagttccccccttaaattcgctcatctcctactctctggagatgtgtgtgtcagttatagggtgtggtaaacaacaccgtcggtgggtagagaggggcatggaacaaacccactcacgatgancactaaatggataagtagaggtgagatagtgagggatgtggggtaggtgtgttgtaagaaaaagatctggtagatgaactaggncaaggtgccgagttaccggttctttgtgctcgaactctaccgaagtatatttattttatatggccgccacctaactctcgctgtcgagaggggaggtgctcacagtatgttgtgttgataaagacacttattgtntatgtcacaaaggggctgtgcttgtactacaaatataaaataagagggatgtacataagcaaagtctaagaaatatatgggcgcgtagcncagacactcggaggagcgagagagaatagaagan

SEQ ID NO: 91433 - protein, 43 aa, Zea mays
  misc_feature: Ceres CLONE 1579786
  misc_feature: SWISSPROT Homolog: EC 4.2.1.92 Hydroperoxide dehydratase
MASSDHGSTTAPKDVPGSYRLPLVGAVRERLDFYFFEGKEQYL

SEQ ID NO: 91434 - DNA, 804 bp, Zea mays
  misc_feature: Ceres CLONE 1579788
  misc_feature: Encodes the peptide sequence at SEQ ID NO. 91435
  misc_feature (740)..(740): n is a, c, t, g, unknown, or other
tccccgcggtggcggccgctctagaactagtggatcccccgggctgcaggaattcgtctcacccctagaaaaagattcggtttggtgcgcctcgtggtccacgtgcgcgggctttgtgctctctcttccctctgtgtgtgtgtcagttcgtcgggtaggttggtggcggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaagcacgtgcgggcgccgctctgcgcagggtgcgccgcgcgcccggccgccgcgcgcgtctccctcccctccgacccggcgttcctctgcgcggactgctgcgagggctgcgccgccgcttccgcggcgcgcgtgtcggttgagggcttctcggggtgcccctcggcggccgagctcgccgcgtcttgggggctcgacctccgccgcgcggccgtggccgtgggcgacgacggcgacggcggcgacgacgacgaccccttcctctcggtgctcgactactccgtgctgggggtgggggtggccgacacggacctgcgcgacctctacgtgccgtgcgacccagcgggggtgcccggtccccgacaccggctgcgcgcccgctcagggggcgaggcccttgttggaaccancttcccggaaaattggccgcggcgccgaccaaggcgggaacaccgtccccaccgccgccacccc

SEQ ID NO: 91435 - protein, 209 aa, Zea mays
  misc_feature: Ceres CLONE 1579788
  misc_feature (11)..(58): Pfam Name: zf-B_box Pfam Description: B-box zinc finger
  misc_feature (188)..(188): Xaa is any aa, unknown, or other
MKSCGGGGADGQQCPCDYCGEAAAALHCRADAARLCVACDRHVHAANALSRKHVRAPLCAGCAARPAAARVSLPSDPAFLCADCCEGCAAASAARVSVEGFSGCPSAAELAASWGLDLRRAAVAVGDDGDGGDDDDPFLSVLDYSVLGVGVADTDLRDLYVPCDPAGVPGPRHRLRARSGGEALVGTXFPENWPRRRPRREHRPHRRHP

SEQ ID NO: 91436 - DNA, 1136 bp, Zea mays
  misc_feature: Ceres CLONE 1579791
  misc_feature: Encodes the peptide sequence at SEQ ID NO. 91437
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (921)..(921): n is a, c, t, g, unknown, or other
tttggcgttgtttttntttnncttttctaattcgtatacatgcttaagtagacaaacagccacaaaaaaaccaagaaagaaaaaaatggaactccccgcggtggcggccgctctagaatagtggatcccccgggctgcaggaattcgtctcacccctagaaaaagtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatccctgcgagataccaagggacgtggctcgtccgtcccccgcccaagggcagcaagcgccgaagattcatccccgtttccttcaaagaccctggggtcaaaccctgccccaatgggcaaatcgggcttttcaatgccttccctcctaaaaccaaaggcttccgcccgaaatgttcccttccttccaaagggaaagggcggctcttcttttcctaaagcgcccggggtacaatttctttttcccgccgggtttcaatatcgggaccctttttcttttccgggcgggcccttaatcgcgccccttaagcgtgtggactctcttaaacccccaaatgaggggacggaaagcgcccaattcccaacccccccaaaattggtggggccttcggcctgngaaattgggacctttcccttcggccctttaggaattgggggggcacccaggcttttcctctcggggaaacccggtttggccccaatttccttcccgccggttcttggggaaaacctttcttggccctcctttcttaaacggtacatgggggcccgaaacctctctttggggggcacaagtggtcacctccataatatccgcgccccttattttcg

SEQ ID NO: 91437 - protein, 187 aa, Zea mays
  misc_feature: Ceres CLONE 1579791
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTIPARYQGTWLVRPPPKGSKRRRFIPVSFKDPGVKPCPNGQIGLFNAFPPKTKGFRPKCSLPSKGKGRLFFS

SEQ ID NO: 91438 - DNA, 891 bp, Zea mays
  misc_feature: Ceres CLONE 1579792
  misc_feature: Encodes the peptide sequence at SEQ ID NO. 91439
ggagctccccgcggtggcggccgctctagaactagtggatcccccgggctgcaggaattcgtctcacccctagaaaaacagcgctgctgctaaaacctcccgactaaaccctagcagcggttcctctccagtctccagcagtccagctcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggacgcacaccgtgcttgcggttgctgaggtgctccggccttctcctgccctccgcgtatcggaggatggaaagaagattggtagagctagtgaactcttgaagccagatgagatcatagaacaagtagactctaggactattgctgtatctccgctgccttgcaatgtaaagcaggaaagacgtccaatcttttttcacaaattatgcaaaggtaaacagcggtgagacttccacgcaatattgcgcaacaaaaaaaacttgctgtggggaatgctttggttgaagttttcctgaagaagagggaagcaaaaagaatttatggaggactggcttttagtattttgcaggggggacaaatctgggaaaataagggcccaaagaaaaggaggtttgaatgccctgaaccaaaaagtccaaaaaaaagaaaggcatatttgaaacaggacaccccccttataaaaaagggacaaacccgggctatggaaaggcgt

SEQ ID NO: 91439 - protein, 83 aa, Zea mays
  misc_feature: Ceres CLONE 1579792
  misc_feature (17)..(81): Pfam Name: La Pfam Description: La domain
MAAPAAAPLDEGKAKKVLRQVEFYFSDSNLPRDKFLRETVEQSDDGLVSLPLICSFSRMKSHLGLDADVKPETVPDAHRACGC

SEQ ID NO: 91440 - DNA, 842 bp, Zea mays
  misc_feature: Ceres CLONE 1579793
  misc_feature: Encodes the peptide sequence at SEQ ID NO. 91441
  misc_feature (753)..(753): n is a, c, t, g, unknown, or other
  misc_feature (816)..(816): n is a, c, t, g, unknown, or other
ctccccgcggtggcggccgctctagaactagtggatcccccgggctgcaggaattcgtctcacccctagaaaaaaacccacaccaccgcaccacgcacctccaccaccagaagaaaaaaccaaggcggagggcggagaggagagcaaggagggtgaagggggaaaagggtaataaaaataaaagaggagaggcgaagcaagacgaggaggaagagggagcacccagaggcaggggagggggaataattccgcaggggctgagggatctcggcgagtccggccggggagcagcgcagcgaggcggcgatcggaggcgggcaggcgtagacgccggcgagatttgtgttggtgacaagccatgaacagcgcaaccaccagttgttaagtaaccctcctgtaaacttgaagcaaccgaagcggagagcagaaatggtgttccaaaagaggtcgtcgtcagagttggaggcgtccggtggaggccaagtcgcggagatgccgcgcgttcccaagtctgcgaggggcaagagatcggtcaggaagaaggaggcccagaacccgccccagatgtcagcattcgaccttctcgcgacggtggcagggaagctgcttgatgagggggtgggctcgctggggaacatgagcgctggtgccccagctttgactgcatgcgcgaaggatgtccgtgtgaagaaggagcagtgtgacgaggaaatgaagcagttcaagcatgaggtgacagatcaggatagctgncatgagagtgcaattctcccgcacattgtgttccagcggggcggtgaatatgctcgggatgangatccctaggcgaagtctgtagccag

SEQ ID NO: 91441 - protein, 131 aa, Zea mays
  misc_feature: Ceres CLONE 1579793
  misc_feature (108)..(108): Xaa is any aa, unknown, or other
  misc_feature (129)..(129): Xaa is any aa, unknown, or other
MVFQKRSSSELEASGGGQVAEMPRVPKSARGKRSVRKKEAQNPPQMSAFDLLATVAGKLLDEGVGSLGNMSAGAPALTACAKDVRVKKEQCDEEMKQFKHEVTDQDSXHESAILPHIVFQRGGEYARDXDP

SEQ ID NO: 91442 - DNA, 1217 bp, Zea mays
  misc_feature: Ceres CLONE 1579795
  misc_feature (39)..(39): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (781)..(781): n is a, c, t, g, unknown, or other
agaactaaaaaatataaaaagtttaggaaataagaatcnttgtcttttgtgataannnnaaannnnggggtggggtgcaaactggagctcccctcggtggcggccgctctagactagtggatcccccgggctgcaggaattcgtctcacccctagaaaaaaacccagccgcccattgccggcattgctcgcagcgctagcttcttgcgctcatcactcgtctccgaccaagatcagcaaggacggcatgagctctcaaagcagcgtacgactacctgcacgttcaccgacgaccagtgcacgcccacacaagcagcagcagtcctcggcatcctcctcctcctcgccattccggctagcctcggcagcgaagagctccgtccgcgacatcccccgaatggaagcaactcaagctgaccgccgaaccctcgccggggaagacgcccatcaatcgggcacctgcagcctcaacgggataacaacgcggcacgtactccgttccagcgaaacacaccacgccaaggttgcgggcccacaaacaggggcggaaagctaggtagccacggtcagagaagacctggtgtaccaacccgttcgatgacgagtaccaaacgccctgcagcgtaccgcaccagaggggcccaatcgccacacagaaaaaggcgaaccaaacaaaaacacatcgaccaggaacggttctcgccccccccgggccggggaaaccgcccccgtgtacagcgaccgcagaaaagatcgcttgaccgagcctttggacatagcgnttcccccgcgcgggtgataacagttgcgggaccgcctcttctcttccgatgccacgtttaacgcgggtcacgaatgttcgacaatgagagcgcgacagaatcgtcggcgcggtacggaagaagagggggcggtgcaaaccaatagctaatgcgtgccaaataggaccgtccatatcaggctcgtccagaagacttcggcggcgacggtaccccccacgaaaatgctggcctcgtcgcaacgttcccgcgggaagcgactgttgaaaggatccgccgcaccccgaggtgaaggcgaggagagccgaccgtaattcccacaaacgaacggaccttgtcgcgcttggttgtcgcccccccccccgtcggaagacagtatgattctccgaatatacacgcaagcgaaacgcctacactcaacacgacctatgctacaccg

SEQ ID NO: 91443 - DNA, 945 bp, Zea mays
  misc_feature: Ceres CLONE 1579804
  misc_feature: Encodes the peptide sequence at SEQ ID NO. 91444
  misc_feature (945)..(945): n is a, c, t, g, unknown, or other
ctggagctccccgcggtggcggccgctctagaactagtggatcccccgggctgcaggaattcgtctcacccctagaaaaaagcggtccctcaaatccgcctcctccttctcctcctaccgcagcccgtagggaggtggagttgtcaacgtgcctaggactggagcggctcgcgtcctctatcaacgagacgcgcgggcatttcctctgctcctctctgttcccccctgcctgcctgcttccagctgcgtctcactcctaggagctcgatcgctcggattccctctctacgccgagaccgagaggaggcatccctgacttacggacagcggccatggggacgcaggcgccggacaactaccccgccgagaaggacgcgatgagctcgcgggagcaacccaacaacgactggctgccgatcacctcgtctcggaacgccaagtggtggtactccgccttccacaatgtcaccgccatggtcggcgccggcgtgctcagtctgccctacgccatgtccgagctcggctggggccctggcatcgcggtgttggtggtgtcgtgggtgatcacactctacatactgtggcagatggcggagaagcacgagatggtccccggaaacggttccaccgttaccacaagctggggcagcacgcgtggggggaccgggctggcccttggatcttggagccgcatcaccttgttcatcgaggtgggccttaacctcgggaacttggacaccggagcaagttccctgaaaaattcccctatccgatggttgttgccaaaacccagggggtgcttttagggggaaggagaattattcagaccgccattctttaataattagaatttccgggccgagtccaaattcgatcttcttgcgagaattcccctgaatggaaatcccttattcccgggttaatccccttcgcgggtgtgcgagn

SEQ ID NO: 91444 - protein, 157 aa, Zea mays
  misc_feature: Ceres CLONE 1579804
MGTQAPDNYPAEKDAMSSREQPNNDWLPITSSRNAKWWYSAFHNVTAMVGAGVLSLPYAMSELGWGPGIAVLVVSWVITLYILWQMAEKHEMVPGNGSTVTTSWGSTRGGTGLALGSWSRITLFIEVGLNLGNLDTGASSLKNSPIRWLLPKPRGCF

SEQ ID NO: 91445 - DNA, 887 bp, Zea mays
  misc_feature: Ceres CLONE 1579805
  misc_feature: Translation starting site: 567
  misc_feature: SWISSPROT Homolog: EC 1.4.1.2 Glutamate dehydrogenase
  misc_feature (825)..(825): n is a, c, t, g, unknown, or other
ctggagctccccgcggtggcggccgctctataactagtggatcccccgggctgcacgagttcgtctcacccctagaaaaggaagccctaggtcctctgttacttgtgccgccgccgcccatcccctcccgttctccgccaccgccaatcccctcccgtcctccgccacctctgctgagagcgagaagagatggtcggcaaaggtgatgggccggccatcggcatcgatctcggcccgacctactcttgcgtcagtgatgtggcagcactaccgtatcgagatcctcgccgacgaccagtagtaaccgcaccacaccctcgtacgtcgccttcaccgactcccagcgcctcatccgagatgctgccaataaccatgtccccatgaaccccatcaacaccgtctatgatgccaagcgtctcattggcaggaggtttagtgatgcctctgtccagagtgatattaagctgtggcccttcaaggtcattcctgggcccggtgagaagccgatgatacttgttcatcacacgggggaggagaaacagtttgcatcccaatagatctcctccatggttctcatcaagatgcgtgagatcgctgaagcttaccttggcagcacgatcaagaatgctgttgtcactgtccctgcctacttcaacgactcacataggcatgccactaaggatgctggggtgattgctggcctcaatgtgctgcgtatcatcaatgagccaaccgctgctgctattgcctatggtcttgacgagagtgcaatcagcgtcggagagaagaacgtcctcatctatgaccttgcgcgtggtaccttcnatgtctacctccttactagtcgaagaacgcatctctggagatcatgcccacagctggcgact

SEQ ID NO: 91446 - DNA, 1176 bp, Zea mays
  misc_feature: Ceres CLONE 1579807
  misc_feature: SWISSPROT Homolog: EC 3.5.1.49 Formamidase
  misc_feature (56)..(56): n is a, c, t, g, unknown, or other
  misc_feature (62)..(62): n is a, c, t, g, unknown, or other
ttttttttgtgggggggggtaggaaggaggaggaaggatgtaaaaagatattaatngggagnttgaaggttttccaaactggagctccccgcggtggcggccgctctagaactagtggatcccccgggctgcaggaattcgtctcacccctagaaaaacttgatattttaccgactcctgagaactggttacttgagaagattcctgacgggactgctggatggcacaaaatgtctctatgatacaatcacgactagtccaggaagggagaatggcggtaattgtgacaataaaaacctaagccgacgacccccagtttatctaccagaatttgtcgaacgagcgaatcttactacctgagatttgcacttatcccatagcgatggtgaagttgcgtctccagcagcgagtcacatgagagcaatccttcagcgtcagcgccatacactcagaggtgggatcaacgactacttgaccccagccgaaccggaaccggtccctgtgaaccaccatcttatgtgaaccggccttgtccagcccaggccttcctcagaaaaaacttggagttttaagggcactaacggctggggaagaaatctggggaaaagcaaccaactttcctaagggatccttgtctgggaatccctctttccaagcgcgtgggtaagagtacccttctacaaagaaagccttttagaaacctcacgcctatttggggggcaaaaaatttttttggccgcccaaagcgtgtccctaaacacgataaagacaaaagaggtgcgctttttatctctaacccctgagtaaatatccgcgcgactttgatatttgactccccccctttaaatttggaacggggctttaaaaactattccatcaagtggggcacacgcgagggtgataaaaaaaaccccttctctaatctctccacataataggtggaaagggttcctcttgcgcacgttgcaacatatagacaatttataaagttttggaacccccggtgtagactttataaaggccaaaatactattcatgttgaacaggataaaatattttgcccaacaatatgtgttgaattacaaaggatttcgccggatacataccggtaaaaatttgtttgaaaaacttggttggcatttatcgtttgtttacacacaagaggcaaaaggggtg

SEQ ID NO: 91447 - DNA, 903 bp, Zea mays
  misc_feature: Ceres CLONE 1579808
  misc_feature: Encodes the peptide sequence at SEQ ID NO. 91448
ggagctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagagcaacgagcgctgctgctcgcgatccccttctccctgctgctcctgccgctcctgctccgctacctcgcggcgtcggcgtcggcgtctgcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtgggtctcgtcaccgcgcgtcgccaagggcgtgctccgcacctacgaccacgtttttttcctcccggccgggactccctggggggtccgacatcattcatggtacgggggcccccgaactcagggtttggggccctaaaggggaaaaacttttcccaaaagggccgggaaaactgggcaaccccgggggccctcgggtacaacaccccaaaaaaaggggggggggttcctcaaaagggcccccctccggaaaaaggaaaaaaaaaaaaggttccccgattcccgacaaaatacaaaat

SEQ ID NO: 91448 - protein, 217 aa, Zea mays
  misc_feature: Ceres CLONE 1579808
  misc_feature: SWISSPROT Homolog: EC 1.14.13.68 4-hydroxyphenylacetaldehyde oxime monooxygenase
MAAQLHHALYELLHEAAAEQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVGLVTARRQGRAPHLRPRFFPPGRDSLGGPTSFMVRGPPNSGFGALKGKNFSQKGRENWATPGALGYNTPKKGGGVPQKGPPPEKGKKKKVPRFPTKYK

SEQ ID NO: 91449 - DNA, 958 bp, Zea mays
  misc_feature: Ceres CLONE 1579809
ctccccgcggtggcggccgtttctagaactagtggatcccccgggctgcaggaattcgtctcacccctagaaaaaggcgagcgagagtccgagacccattcccatccacgcgacaacgatgccgttatctcgacttgctccgcgtcgcttccattcccgtccctcagaatctcacccccgccagccgagtgccagccctaacgaaatttacacctgcttcgttggcgtgagcggtcttaggcgtcgggcgtggctgctgtccagcggtgtcggatcctggtcccgcgccgttagggcgaaggttgttccgggaaggcgcacccgctggatgttaaacagggagatcggggacataacaggcaaggttgggttgtaacatttgtatcgccagaagtaactcagaacatgtcaatgttaaaaacgtgaacgggcataactggtgccagaggctcctaaacgagcgcgtagctatggaaagagaaatccgaagcaagccttcaccctgcaaatgcacagatgcagatttgaacccgcgacatggcgactgagtgagacaacggtcaccattgcaacaagcctgtccttcctcatgggtaaaacagagcattaactcgtcgtcatgaacaacatgggaatccaattgctgcattgcgggcgaggagatggaccagcagggcgatcactcctacaagaagtttcggcataaaggaatgtgaggcgctcgcccatcatgggaccatgccatgggacatccaaccccttttacaggaataagggagtgtcatcttctggtccccaacataggggggggaagattgatcccccaaaaaaagaggatcggttagacacaatgaaggtcccatatgagaaaaccttggaacggcccctccatgtgctccctgtagccaagggcccaatccgaccaaaaagggaaaccccgggtgaaaagcttatctcg

SEQ ID NO: 91450 - DNA, 822 bp, Zea mays
  misc_feature: Ceres CLONE 1579810
  misc_feature: Encodes the peptide sequence at SEQ ID NO. 91451
  misc_feature (546)..(546): n is a, c, t, g, unknown, or other
  misc_feature (547)..(547): n is a, c, t, g, unknown, or other
  misc_feature (553)..(553): n is a, c, t, g, unknown, or other
  misc_feature (555)..(555): n is a, c, t, g, unknown, or other
  misc_feature (564)..(564): n is a, c, t, g, unknown, or other
aaagctggagctccccgcggtggcggccgctctagaactagtggatcccccgggctgcaggaattcgtctcacccctagaaaaagtccccaacccacgcactcccaccggtctctctcacacaacacagggatataagcccagtccacgagatctcccgtagaccagtggcgagtgaagggaaggaacgaaacagagcccgatcctagcgacaggccagggaagatcgccatgatgatgatgggcgaaggcgtgagcgtgccgccgtggtcccaccacgtccccgtgagcggcgtcgacgtcggcgtcggcggcggcggcgacgagatgacgccgtacctgctggcggcgctgcggcagtacctgccgtgcaacgacgccggcgccgccgaggcggacgacgaggaggcggcggccatggccgcgggcgtggacggctacggctgcgacgagttccgcatgtacgagtttcaggtccggcggtgcgcccgcgcgcgcagccacgactggaccgagtgccccttcgcgcacccgggggagaaggcgnncgcgcncnacccgcgcnagtaccactactcgggcggccggctgcccgggactttcgcaaaggccgggtgcaaggccccggcaacccctgcaacattcccgcacgggggtctttcgagtggctgggttcccccggggggggttaacggaccccaaccccttgaaaggaagggaagggccttgccccccccccccgttttggttttttttccggcaaccccccggaaaccattgtgggggggggtccccccccccccagccccacaagaattttaag

SEQ ID NO: 91451 - protein, 196 aa, Zea mays
  misc_feature: Ceres CLONE 1579810
  misc_feature (106)..(106): Xaa is any aa, unknown, or other
  misc_feature (108)..(108): Xaa is any aa, unknown, or other
  misc_feature (109)..(109): Xaa is any aa, unknown, or other
  misc_feature (112)..(112): Xaa is any aa, unknown, or other
MMMMGEGVSVPPWSHHVPVSGVDVGVGGGGDEMTPYLLAALRQYLPCNDAGAAEADDEEAAAMAAGVDGYGCDEFRMYEFQVRRCARARSHDWTECPFAHPGEKAXAXXPRXYHYSGGRLPGTFAKAGCKAPATPATFPHGGLSSGWVPPGGVNGPQPLERKGRALPPPPVLVFFPATPRKPLWGGVPPPPAPQEF

SEQ ID NO: 91452 - DNA, 1113 bp, Zea mays
  misc_feature: Ceres CLONE 1579815
  misc_feature: Encodes the peptide sequence at SEQ ID NO. 91453
  misc_feature (54)..(54): n is a, c, t, g, unknown, or other
  misc_feature (58)..(58): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
cgagattggtatggaaaggtttgttgatatgtaaatataacccactctcccccncccnccccnnnnnntttcaaaactaggactcaccgcggtggcggccgctctagaactagtggatcccccgggctgtttgaattcgtctcacccctagaaaaattaaggagccacggacggtgggtctgtgttgcgacttgtctgtgtgtgctatacgacctgccaagtggcaagagcgccaacgccgtctccttgccatggccatcctgaacagagctgacactagtcacactaccaccgcatccaacggcagcgccaccccggctgcccccgttgccattgccatgccttcgcttcctcacccgccactggacgccgacgagttccgcaggcagggacgcctagtcgtggacttcatcgcggactactacgcgcgcatctacaggtacccggtgcgcccggccgtcgcacctgcccccccgattcggcagcttcccgaggcagcgccggcgcggccggagcccgacgcgctcgcctcggcgctgcgcgacgtgcgcgacctcatcctgcccggcgtcacgcactggcagagcctgcgccacttcgcgcacttcgcggccactgccagcaacttgggcgccctcgggcaggccctccccgcggggtcttaacgtgaaacccgtttcacgtgggtccgcatcgccgggcgggccaccgtagcctaggaggtccgctcgtctacataacttgggctccgtgccaggcggctggcaaccctccccgggaaaaggccttggctggttcttccccggaaagccggcccgggaggccaccccctgctttgggcaaccgtcccttatcaaagggccattgctctctggctacatactctgctctcttcctctataataacctggtatacctcccccccatagtaaggccgcacgtagcgggaaataggcaggaccctccctgggctggtcccgtgtttcccaattcaataactccaccttccccttttttccacaagagggcttaggtctctttcccccctgggtaatttcgcccccgtgggaacactggcccgtgtataaataaaccggacgccttctgcggggg

SEQ ID NO: 91453 - protein, 137 aa, Zea mays
  misc_feature: Ceres CLONE 1579815
  misc_feature (96)..(136): SWISSPROT Homolog: EC 4.1.1.25 Tyrosine decarboxylase
  misc_feature (28)..(61): SWISSPROT Homolog: EC 4.1.1.28 Aromatic-L-amino-acid decarboxylase
MAILNRADTSHTTTASNGSATPAAPVAIAMPSLPHPPLDADEFRRQGRLVVDFIADYYARIYRYPVRPAVAPAPPIRQLPEAAPARPEPDALASALRDVRDLILPGVTHWQSLRHFAHFAATASNLGALGQALPAGS

SEQ ID NO: 91454 - DNA, 917 bp, Zea mays
  misc_feature: Ceres CLONE 1579819
  misc_feature: Encodes the peptide sequence at SEQ ID NO. 91455
  misc_feature (709)..(709): n is a, c, t, g, unknown, or other
  misc_feature (815)..(815): n is a, c, t, g, unknown, or other
ctccccgcggtggcggccgctctagaactagtggatcccccgggctgcaggaattcgtctcacccctagaaaaatggggagcaacgcaagcactccgatccacgctgctgtgcagaacgagagagatatcatcagtagttagagcgaccaatagatgagttcctccccgtcctttggtctcctggccgtagcagcagtactcctagcactgaacttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatccataagacgaacttcgccggcatcaacgtcgagttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtgtacgatgaagattacgtccagaagagaattgaactggcggacagcgtggaagagatgggggagaagctctctgccactttgcacgccagtggcagagacgacatgtctatccttgccatgcagcgcctcaacgaacaccagccgaacgggccggcgacgccnggtggacatggtggtggactactacaagttcgactacgagttcgcggagccgccgcgcgtgaccagcctgcagaacacgtgcctctcgcgaccttcagcgacttcngcgacgacgtctacttcgtcgctgaccagcggggctacgaggccgtcgtctactacctcgccgggcagtacctcagaccgacgacaggtctggaaagatcgc

SEQ ID NO: 91455 - protein, 254 aa, Zea mays
  misc_feature: Ceres CLONE 1579819
  misc_feature: SWISSPROT Homolog: EC 1.5.3.11 Polyamine oxidase
  misc_feature (221)..(221): Xaa is any aa, unknown, or other
MSSSPSFGLLAVAAVLLALNLAQHGSLAATVGPRVIVVGAGMSGISAAKRLSEAGITDLLILEATDHIGGRIHKTNFAGINVELGANWVEGVNGGKMNPIWPIVNSTLKLRNFRSDFDYLAQNVYKEDGGVYDEDYVQKRIELADSVEEMGEKLSATLHASGRDDMSILAMQRLNEHQPNGPATPGGHGGGLLQVRLRVRGAAARDQPAEHVPLATFSDFXDDVYFVADQRGYEAVVYYLAGQYLRPTTGLERS

SEQ ID NO: 91456 - DNA, 914 bp, Zea mays
  misc_feature: Ceres CLONE 1579822
  misc_feature: Encodes the peptide sequence at SEQ ID NO. 91457
ctggagctccccgcggtggcggccgctctagaactagtggatcccccgggctgcaggaattcgtctcacccctagaaaaagcgttcgctttccccgaaacgttacccaagctacagagagagaaaggacaagggaggagaagccgccatgaagcagcagcggcagcagcagcatcctcctagtcgtccccgttaaatccctgctcgcccccggttcgcgacctcgacccaacccgtttgtgtcgtaggcggtttgcactagcgtttccgtgaggcgggcgaaggcgtccgtgaccgaccgaccgaccgaccggagcttcatgcgccaggggcggcggcttcaccccgtcgtttgatgggcaacgcatgcagcggcgcccttagatccaagtacctgcacagcttcaagcacgccgcgtcgcagcgccacgactccgagtacagcgccagcgccagcgccgacgactcgcccaggaagcccacaccgcccgccaccacggacgcccacgcgccggcgccgcccgccgccgccatgaagcgcggcgcggctggcgcgacgccagacctcgggtccgtgctcggccacccaacccccaacctccgcgacctctacgcgctcggcatgaagctcgggcaggagcagttcggcaccacctacctctgcaccgagctcgccacggggatcgactacgcctgcaagtccatctccaagcgcaagctcatcatcaaagatgacgtcgactacgtgcgccgcgagatccagatcatgcaacacctctccggccacaagaacgtcgtcgctatcaaggggcgtaccaagaacaagtctacgtccacatcgtcatggaactttgttcccaggtgcgagttcttcgaccggatcatcaaggcggaccctacagcggacacgagggc

SEQ ID NO: 91457 - protein, 186 aa, Zea mays
  misc_feature: Ceres CLONE 1579822
  misc_feature: SWISSPROT Homolog: EC 2.7.11.1 Non-specific serine/threonine protein kinase
MGNACSGALRSKYLHSFKHAASQRHDSEYSASASADDSPRKPTPPATTDAHAPAPPAAAMKRGAAGATPDLGSVLGHPTPNLRDLYALGMKLGQEQFGTTYLCTELATGIDYACKSISKRKLIIKDDVDYVRREIQIMQHLSGHKNVVAIKGRTKNKSTSTSSWNFVPRCEFFDRIIKADPTADTR

SEQ ID NO: 91458 - DNA, 826 bp, Zea mays
  misc_feature: Ceres CLONE 1579826
  misc_feature: Translation starting site: 171
ctccccgcggtggcggccgctctagaactagtggatcccccgggctgcaggaattcgtctcacccctagaaaaattcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcgcgcaacgatggcgagcgcctccgcctgtcctcgcgctcaccgcgcgtctggcccgacctcgcgttcaactggcgggtggtggtcgccaccgtcgtcgggttcctcggtttcgcgtttggcaccgtcggcggcgtctgctgaaggcgggatcttcgtgcccatgctcaaactcgtcgtcggcttcgaacacaaatccgccgccgcgctctccaaatgcatgatcatgggggcctcggcgtcatcaagttggtacaaccccccaggggtcgcacccgaccaaaggaggcgccccgtcctcgaacaacaaagctcgcgttgcttcttcaagcccaatgcttatggctcgggaattaacctttggggggtagaaacctaagcggtccatcctttcccaatacggggctaaaacaccggtcccccatttaaaaaatccctccttccggaaggccaccctccggcccgaaaatccccttccataaaaaaggggaattttccgggaggagggggag

SEQ ID NO: 91459 - DNA, 877 bp, Zea mays
  misc_feature: Ceres CLONE 1579831
  misc_feature: Encodes the peptide sequence at SEQ ID NO. 91460
  misc_feature (877)..(877): n is a, c, t, g, unknown, or other
tggagctccccgcggtggcggccgctctagaactagtggatcccccgggctgcaggaattcgtctcacccccccctagaaaaagatgagaacttcaaattggttcacactggacctggagtgctcagcatggctaatgctgggccgaacaccaatggcagccagttctttatttgcactgtcaagacaccttggttggacggaaggcatgtcgtgtttggccaggtcctggaagggatggatgtcgtaagtctgatcgagtcgcaggagaccgacagaggtgaccgcccgaagaagaaagtagtcatcagcgagtgtggggagcttccagtggtctaagtgttactcatctgttgtcggtcttacctaacctcggatggatggcgatatttcccccacctgacttttgtcgtgctaccttccctcccttccacccctccccccccaccctggctagttatagaagaatatttccgaattgaaagtaaggtcccaaatctggagggcatactgtttgcttctcctgctggaaataaatgtgcttccttgttcatggaaacaaaaatatttctgttgcatttgcatatgcaaagagctggttgatcgttccaaaattcgcccgtttccagcgaacccactaactggcggcgaaaatcccgctccccgcgtttcccaatcctacgggcccgccatcgctttcgggcctcccctccggaaagggggtctttaaaatcaggggcgaactgggccaaacttttttctcaaaaaactaacccaaagcattatttctaccaatttcaaagcaaaccgccccattcccaacgggaatgccttggattttttaactttcccccggggggaaagaaaaaacacccttn

SEQ ID NO: 91460 - protein, 111 aa, Zea mays
  misc_feature: Ceres CLONE 1579831
  misc_feature (2)..(108): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
ELPAVAAALELVDPPGCRNSSHPPLEKDENFKLVHTGPGVLSMANAGPNTNGSQFFICTVKTPWLDGRHVVFGQVLEGMDVVSLIESQETDRGDRPKKKVVISECGELPVV

SEQ ID NO: 91461 - DNA, 802 bp, Zea mays
  misc_feature: Ceres CLONE 1579832
  misc_feature: SWISSPROT Homolog: EC 3.4.21.92 Endopeptidase Clp
ctcaccgcggtggcggccgctctagaactagtggatcccccgggctgcaggaattcgtctcacccctagaaaaatgtatcgagaaaggacactttttttaggtcaagagattcgttgcgagatcacaaatcatattacaggtctgatggtatatctcagtatagaagatggaaatagcgatatttttttgtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacacccagattttttctagaagtggaagagttacacaaagttcgcgaaatgatcacaagggtttatgcactaagaacaggcaagccttttttgggttgtatccgaagacatggaaaagggatgtttttttgtcagcagacgaagccaaagcttatgcttgtcgatattgtaaggggatgaaatgattgacgagcactgcgatactgatccaggtgggttttcagaaatgtttaggattgtaagggggggggatttcctggaaatttatctcaaacctaaattcgggtttatgctatagaaaaaaaaaatactccatgaggatgaacctccgggttaaaatcatctaaccaatcccttttttatataccttcgaaatgccaacggtttaaacactttatt

SEQ ID NO: 91462 - DNA, 871 bp, Zea mays
  misc_feature: Ceres CLONE 1579833
  misc_feature: Encodes the peptide sequence at SEQ ID NO. 91463
  misc_feature (844)..(844): n is a, c, t, g, unknown, or other
ctggagctccccgcggtggcggccgctctagaactagtggatcccccgggctgcaggaattcgtctcacccctagaaaaacgctcgctcgcccgccaccgagagactacactctacgtgtgtgcctgcgagagcgagagcgcaccagcagccagcttcctctgcgcgcggcctgctggtcgcttcgcttcgctccagtccagggcggcacatggcggggggcgggggcggccgggacctcccgtcgacgccgacgtgggcggtggccctggtgtgcgccgtcatcgtgctcgtctccgtcgccatggagcacggcctccacaagctcggccactggttccatacgcggcagaagaaggccatgcgggaggccctggagaagatcaaagcagagttgatgctgatgggcttcatctcgctgctcctcgccgtggggcagacgcccatctccaagatatgcatcccggccaaggctggcagcatcatgctgccgtgcaagccgccgaaagccgccgccgccgacgacgacgacaagagcgacggccgccggagactcctctggtacccgccgtaccctggatacgatgagcccggccaccaccgccgtttcctcgccggcgcggctccggacgacaactactgcagtgaccaaggcaaggtgtccctcatctcctcggccggcgtccaccagctgcacatcttcatcttcgtgctcgcggtgtttcatatcgtctacagcgtcgccaccatggcgctggggcgtctcaaaatgaggaaaatggagaaaggggaatcggagaccactccctggaatacagtacgcaacgaccccttcacgttctggntccgcaacaaacgtcgttcgggaacgt

SEQ ID NO: 91463 - protein, 220 aa, Zea mays
  misc_feature: Ceres CLONE 1579833
  misc_feature (5)..(220): Pfam Name: Mlo Pfam Description: Mlo family
  misc_feature (212)..(212): Xaa is any aa, unknown, or other
MAGGGGGRDLPSTPTWAVALVCAVIVLVSVAMEHGLHKLGHWFHTRQKKAMREALEKIKAELMLMGFISLLLAVGQTPISKICIPAKAGSIMLPCKPPKAAAADDDDKSDGRRRLLWYPPYPGYDEPGHHRRFLAGAAPDDNYCSDQGKVSLISSAGVHQLHIFIFVLAVFHIVYSVATMALGRLKMRKMEKGESETTPWNTVRNDPFTFWXRNKRRSGT

SEQ ID NO: 91464 - DNA, 851 bp, Zea mays
  misc_feature: Ceres CLONE 1579837
  misc_feature: Encodes the peptide sequence at SEQ ID NO. 91465
  misc_feature (580)..(580): n is a, c, t, g, unknown, or other
  misc_feature (625)..(625): n is a, c, t, g, unknown, or other
  misc_feature (647)..(647): n is a, c, t, g, unknown, or other
  misc_feature (648)..(648): n is a, c, t, g, unknown, or other
  misc_feature (652)..(652): n is a, c, t, g, unknown, or other
  misc_feature (667)..(667): n is a, c, t, g, unknown, or other
ctggagctccccgcggtggcggccgctctagaactagtggatcccccgggctgcaggaattcgtctcacccctagaaaaaaacctttgccgagcggcaggacgacgaagcggaggagttgctgtgcggggtgaaggaagaggagtcggctcaggtacaagaaccggccaagaatccgtcaggccgtcccaccccactaccccaggaaggggtcgaaacagcggccggccccggcctcacttcacctcggcagcactgggttaattccatggagccacgttttctacaagtttcgtgattggtggtgtggggttgatgaacttgaagcatcactcatccggtcagacgtgtttcgtagaccttgacgctgagctatcggagttgggtttccaaaaaaaggtggagctctgagaagttccgcattcttctaaaggaagtaggagatacccaggaagcagcatggcattttcttacagcaatgggaggacattgccctcgaaatgggaggatgcagagaggtggatcttcagtcccaattccagcgacatgcgtggaagaaactacggtgctcatggtcggangccaaagtctaaaagtgggcccctggggcctccaggaagacttgntgggacagtatcatctgtttcnntcgngtcattgcttgatantgggagagttggacttattactcaaattctattttttcgccggagtactatggcgggaaatggtttgtgaagaaaaaaaccatgggggcctattccggaaaaccatttggggaaaaatccacatttgagaagggactccaaattttcccctgaaaggggggggcctatcctttttaaaccccaa

SEQ ID NO: 91465 - protein, 92 aa, Zea mays
  misc_feature: Ceres CLONE 1579837
  misc_feature (41)..(41): Xaa is any aa, unknown, or other
  misc_feature (56)..(56): Xaa is any aa, unknown, or other
  misc_feature (64)..(64): Xaa is any aa, unknown, or other
  misc_feature (65)..(65): Xaa is any aa, unknown, or other
  misc_feature (70)..(70): Xaa is any aa, unknown, or other
MAFSYSNGRTLPSKWEDAERWIFSPNSSDMRGRNYGAHGRXPKSKSGPLGPPGRLXGTVSSVSXXSLLDXGRVGLITQILFFRRSTMAGNGL

SEQ ID NO: 91466 - DNA, 865 bp, Zea mays
  misc_feature: Ceres CLONE 1579841
  misc_feature: Translation starting site: 191
  misc_feature: SWISSPROT Homolog: EC 1.4.1.2 Glutamate dehydrogenase
  misc_feature (652)..(652): n is a, c, t, g, unknown, or other
  misc_feature (865)..(865): n is a, c, t, g, unknown, or other
gagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttncacgactcacagaggcaggccacgaaggatgctggggtgaatgctggcctcaatgtgctgcgtatcatcaatgagccaaccgctgctgctattgcctatggtcttgacaggaggcaccagcgtcggtgagaagaatgtctcattcttgacttgggaggtggaccttcaaggctccctccttacattgaggaagtatctttaagtcagggcccn

SEQ ID NO: 91467 - DNA, 841 bp, Zea mays
  misc_feature: Ceres CLONE 1579842
  misc_feature: Encodes the peptide sequence at SEQ ID NO. 91468
  misc_feature (373)..(373): n is a, c, t, g, unknown, or other
  misc_feature (380)..(380): n is a, c, t, g, unknown, or other
tggagctccccgcggtggcggccgctctagaactagtggatcccccgggctgcaggaattcgtctcacccctagaaaaaagaaaccaatagtggcaattattgttcggaggccatcgccgctggtgggcggtggcttccccttcccctgtattagcagcgaggaggcagcagctgaagctctcgtctctgcctctccggacctccggtgaactccaacagagaccacctcctccatccgtcggtcatccatctgtgattccttttgcgtgtgcaagttgttaaatcggcacacggcctccgcttttggagtggagaggggcatatacggtttactggtgcgcccggggccgccgcttttcccgctggcctctncccgggncgtcccatttggagcgcgcaaagctggggcggcacccatttaaaagaagcaaactggccctccccccttttagcagcccccaaggcgccccccccccccaaggggcacggccccccgccccaccaaattttataacccgcccgggcgggggaagggatttaaacccgggccgggaaattggcccttttcccccgtggggggtctccccgtttttcccccgggggccgaaaaaaaaaaaaaaattttttgggaaccccaatttttttttgcccccggggggtttttttggtgggaaaaaatttgggccccccccaaaaaattgtggctcccccatgtgtgtggggggaaaaaaaaaaaaaaaggtgttttttttttcccccccccccctttttaaataaagaaagaagagcccccccccccccccccccccgttttttagggggggggggggggggtgtttt

SEQ ID NO: 91468 - protein, 29 aa, Zea mays
  misc_feature: Ceres CLONE 1579842
GAPRGGGRSRTSGSPGLQEFVSPLEKRNQ

SEQ ID NO: 91469 - DNA, 1204 bp, Zea mays
  misc_feature: Ceres CLONE 1579845
  misc_feature: Encodes the peptide sequence at SEQ ID NO. 91470
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (68)..(68): n is a, c, t, g, unknown, or other
  misc_feature (71)..(71): n is a, c, t, g, unknown, or other
  misc_feature (78)..(78): n is a, c, t, g, unknown, or other
  misc_feature (79)..(79): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (1111)..(1111): n is a, c, t, g, unknown, or other
ttttgtttgntgctnntnttcgcttgtttcggcgcacccccccgtcgctcgtaagggtatcctacagnacngcggaannaaaaaagnnnccaaaactggagtccccgcggtggcggccgctctagaactagtggatcccccgggctgcaggaattcgtctcacccctagaaaaacaatggaacaagcaactattcagtgcctcggttgtctcaagtcaaaaatacctgttgctaagagctaccactgttcaaccaaatgcttctctgatgcatggcagcaccacaaagttttgcatgaacgagctagtagtgctctaaatgaaaatggggctgaagaagaggagttatttggcatatttggcagtggaggttctgggattctaagtactgctggatctggttctttgtcaaattttggacaaagccctggtgttaataatggacctgtgcctttctatccctcatgcactgataaaaatttctggaaaaactcgccccccaacttgggaggctcaccaacatttacaaccaacttgctgaatgatattgggacatgcagcaaatagttttgaagttgcgttcccctgggggaattctaaacaaaaaaaggcccccccaatttgagaacccctccaagcccttcaatttcgattgaaccattccccggttgggaaaaattttccccgggaggaacccaaaactttgccctaataccccccctgttgggacccagagaccctttttaattctcctaaaaggttggtcatacacttgggtggggggaaaagtgggtttttttttttagagaggtgtccacacactttgggggggagaaactttttaaagacaccacaggggcccccaataaaatttttttctccgggatccacccttttaagaaggggaaaagatattctccaacccccggggtgatttttatcctccccacacaacaacataattttctcctccccgcccgcgggagtgggaacaatacttggcccttagagacaacacgtgatattgtcgaatatatatataacgtatccctgggcgcccacaatacatgtggggacacacaattttctcccttggggaaagtttcttctcnaaaaaagacagaaaaattggtggcccggcaacttgaaaaattaatattggggcgagtctccagggcccggaatatacccacccggaccggacg

SEQ ID NO: 91470 - protein, 129 aa, Zea mays
  misc_feature: Ceres CLONE 1579845
  misc_feature: SWISSPROT Homolog: EC 3.4.11.18 Methionyl aminopeptidase
MEQATIQCLGCLKSKIPVAKSYHCSTKCFSDAWQHHKVLHERASSALNENGAEEEELFGIFGSGGSGILSTAGSGSLSNFGQSPGVNNGPVPFYPSCTDKNFWKNSPPNLGGSPTFTTNLLNDIGTCSK

SEQ ID NO: 91471 - DNA, 960 bp, Zea mays
  misc_feature: Ceres CLONE 1579846
  misc_feature: Encodes the peptide sequence at SEQ ID NO. 91472
ggagctccccgcggtggcggccgctctagaactagtggatcccccgggctgcaggaattcgtctcacccctagaaaaaaccgacgcctgtcgccactggcacgcattcctgctctcctctcctcttctccctcgtcggtgcggcgtggcgcggctcggcgttcggtgagaaaccactcggggatgaggatctgctgctagagtgagaggagctacggtcagtatcctctgccttcgtcggcggcggaagtggaggggaggaagcgatggaggcgagcgccgggctggtggccggctcccacaaccgcaacgagctcgtcgtcatccgccgcgacggcgatcccgggccgaagccgccgcgggagcagaacgggcaggtgtgccagatttgcggcgacgacgtcggccttgcccccggcggggaccccttcgtggcgtgcaacgagtgcgccttccccgtctgccgggactgctacgaatacgagcgccgggagggcacgcagaactgcccccagtgcaagactcgatacaagcgcctcaagggctgccagcgtgtgaccggtgacgaggaggaggacggcgtcgatgacctggacaacgagttcaactgggacggccatgactcgcagtctgtggccgagtccatgctctacggccacatgagctacggccgtggaggtgaccctaatggcgcgccacaagctttccagctcaaccccaatgttccactcctcaccaacgggcagatggtggatgacatcccaccggagcagcacgcgctggtgcctttcttcatgggtggtggggggaaagagatacatcccctttcttatgcggatcccagcttacctgtgcaaaccaggtctattggaccatccaaggatcttgctgcctatgggttttggtattgttgcttggaaggaacggaatgtagattgtaagcggagacagagaggatgcc

SEQ ID NO: 91472 - protein, 224 aa, Zea mays
  misc_feature: Ceres CLONE 1579846
  misc_feature: SWISSPROT Homolog: EC 2.4.1.12 Cellulose synthase (UDP-forming)
MEASAGLVAGSHNRNELVVIRRDGDPGPKPPREQNGQVCQICGDDVGLAPGGDPFVACNECAFPVCRDCYEYERREGTQNCPQCKTRYKRLKGCQRVTGDEEEDGVDDLDNEFNWDGHDSQSVAESMLYGHMSYGRGGDPNGAPQAFQLNPNVPLLTNGQMVDDIPPEQHALVPFFMGGGGKEIHPLSYADPSLPVQTRSIGPSKDLAAYGFWYCCLEGTECRL

SEQ ID NO: 91473 - DNA, 906 bp, Zea mays
  misc_feature: Ceres CLONE 1579849
  misc_feature: Encodes the peptide sequence at SEQ ID NO. 91474
  misc_feature (823)..(823): n is a, c, t, g, unknown, or other
ctggagctcaccgcggtggcggccgctctagaactagtggatcccccgggctgcaggaattcgtctcacccctagaaaaaccctagaaaaaaacgacaacctccacctcgccttcaactcctccacgctcccgtcctctccacctctcgctcccacctcccccgccgtcaccaccaccaccacagcctctcccccgcaacgcgttccttcccggtgcatgaaaccctaaacctataccccactcccctccccgagccatcctctccccccgcggcgatggccaaggcgctgctctactcctccctcctccccgggctgccccgcgctgtcgggagcagccggagcgctgccgcgaggctgctgctgctcccgcctctccggctgcggcgcggccggcgcgccgcctccgcgtgcgcggtgagggcgggcctgcacgggctcgactccgtcggcgggccccacctccaggccgcgctggagcgcgccgaggcggcgctctacacgctcgccgacgcagcggtagccgcggcggacgccgccgcgggcgcgggggacgacgccggccaagctgcggcggcggtccagaagaacggcggctggttcggcttcatctccgaggccctcgaggtcgttctcaaggtgctcaaggatggtctctcagcagttcatgtgccgtactcctacggatttgccatcattcttcttactatcattgttaaggctgcgacattgcctttaaccaaaagcagggtggaatcactatggcaatgcagaattttacagcgcagcttaaagcattccagcagagattgcgggccaacangaaaggaaacggctagaaactgcttcgttatacagcaagctggttgcaaccctttaaccaggatgtttttcaacatttgcaaa

SEQ ID NO: 91474 - protein, 210 aa, Zea mays
  misc_feature: Ceres CLONE 1579849
  misc_feature (183)..(183): Xaa is any aa, unknown, or other
MAKALLYSSLLPGLPRAVGSSRSAAARLLLLPPLRLRRGRRAASACAVRAGLHGLDSVGGPHLQAALERAEAALYTLADAAVAAADAAAGAGDDAGQAAAAVQKNGGWFGFISEALEVVLKVLKDGLSAVHVPYSYGFAIILLTIIVKAATLPLTKSRVESLWQCRILQRSLKHSSRDCGPTXKETARNCFVIQQAGCNPLTRMFFNICK

SEQ ID NO: 91475 - DNA, 1208 bp, Zea mays
  misc_feature: Ceres CLONE 1579857
cccccctctcctttctcttacatacccatcaatcataatatcatatatacaaaattaaccacccacttttaattcaaaactggagctccccgcggtggcggccgctctagaactagtggatcccccgggctgcatgaattcgtctcacccctagaaaaagaccccctgcggaaatctctagagcctgggccagctctgtgcgccagctcttgctccatctctccgcggcggcagcgcaacaaccgcacccatgaaagtcgccatcctcaccccccgcgagcctgccccatcctgcttagtgtcgtcccccgccaccgcgcagccgcaacccatctggataaggatgcatccgcttctcccatagccgccactacccctgcctgccctcggctacgaacacgaagatcccctggatggaggtggagctctcagaggcttatgatctagaactctatctcatactacggattccacagggtgaggagagatacgagcagggtcccacccggcgatgcgggtcccatcttccggcattggagagcaatcccgcctactcggatcacgaaggtttctcttgagggcggtgttagctatatgatcaatgcggggccaacggggggaagggacgcattagctaacgcaaggcccaacattccaccgaagggccactaattaagttggggaagttttcccccccaaaaaggggaaaagggtttttggcaaaccttggggtttgggtggccttggaaaacccccaagggggtaaccctatcctccttgggggtgttacccaaatttgttatttaccacgggggatcccaaatttccggttttcaagaagaaaccccccagagcctcttggaaaaaatacaattttttggaagggctcaaaaccacccctctataagaaaagggttttgttaaaaaattttaaaatcccaagcggcccccaaatgctgggccttttgggagtgtcgcgcgaaacgcccctggtttcacaaacacacaagggggggggggagttcccaatatggtctaaaaaataaaacttggggtcaaacaaaactttctcgaaccaccgtgaaacgcctaatggaaatagaccccccactcctcacacccccggggtttttgaagccatttggaacggtttaacatgggagaaaggtgtatttgttttagaacacttaacaccgatataaaaaaat

SEQ ID NO: 91476 - DNA, 987 bp, Zea mays
  misc_feature: Ceres CLONE 1579858
  misc_feature: Encodes the peptide sequence at SEQ ID NO. 91477
  misc_feature (746)..(746): n is a, c, t, g, unknown, or other
  misc_feature (891)..(891): n is a, c, t, g, unknown, or other
  misc_feature (940)..(940): n is a, c, t, g, unknown, or other
  misc_feature (943)..(943): n is a, c, t, g, unknown, or other
ctccccgcggtggcggccgctctagaactagtggatcccccgggctgcaggaattcgtctcacccctagaaaaaaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggacaaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgacaatgtcaaggcctagatccaggacaaggatggcatccctccggtacagcagcggctcatttttgccnggcagcagctcgaggacgggcgcacgctgggcgactacacattcagaaggagagcaccctccacttggtgctgcgtctcaggggtggcatgcagatcttcgtgaagacactactggcaagacgatcaccccttgagtggagtccntcggacaccatcgacatgttcaggctagatccaggacaggaaagcattncancagacagcagcggctcatctttgctggcagcagctggaggaagg

SEQ ID NO: 91477 - protein, 180 aa, Zea mays
  misc_feature: Ceres CLONE 1579858
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKA

SEQ ID NO: 91478 - DNA, 886 bp, Zea mays
  misc_feature: Ceres CLONE 1579859
  misc_feature: Encodes the peptide sequence at SEQ ID NO. 91479
  misc_feature (428)..(428): n is a, c, t, g, unknown, or other
  misc_feature (472)..(472): n is a, c, t, g, unknown, or other
  misc_feature (603)..(603): n is a, c, t, g, unknown, or other
  misc_feature (604)..(604): n is a, c, t, g, unknown, or other
tggagctccccgcggtggcggccgctctagaactagtggatcccccgggctgcaggaattcgtctcacccctagaaaaagagcgcggcggtggtagggtagggaggggcagtcagtcaggcggatccgcgatgcgcaagctgagcgcgccccggggcggcggggagaggctgggcgtgctggccttggaggtggcggcgctcatgtcgcgcgccgcggggctgtggcgcgcgctgggcgaccaccacctggcgcgcctccgcggggaggctatccgcctggagggcgtgcggcggctcgtggccgacgacgacgccgcgctcctggcgctcgcgctcgccgagatggtcgccgcctgccgcgacctgtcgcgcgccgtcgcccgcctgtccgcgcgctgcgccgacccgctgctccgccgcttcgacngccctctttcgcgcgcttcctaaagcgcgcgccgccgaaccggnacgggctgcgctacgccgcgcgcgcccaggatggaacgcaaaggcgcgcaaaatgcaagcgcctcgtgggccgccacggggccacctggtgccacgagcttcaacatggctccccaaactgggaacacccnnccccacccaccgggccggggcccgggaaccggaattgggaaccaaaaaaaaccggggccaaaaccgcccgcccccttttccccgggaaaaagccggaggggggacgggatccccgccccgctttctttttgggcccgcccacttttaaaaacaccgggggccctgtttccccaaacccccctttccacaattttctccgagaatattcaggggggtgttaaccatggaaacacaccccgggagaacacaaagaaaaaagggttttttcacaggggccctccg

SEQ ID NO: 91479 - protein, 106 aa, Zea mays
  misc_feature: Ceres CLONE 1579859
  misc_feature (100)..(100): Xaa is any aa, unknown, or other
MRKLSAPRGGGERLGVLALEVAALMSRAAGLWRALGDHHLARLRGEAIRLEGVRRLVADDDAALLALALAEMVAACRDLSRAVARLSARCADPLLRRFDXPLSRAS

SEQ ID NO: 91480 - DNA, 1097 bp, Zea mays
  misc_feature: Ceres CLONE 1579861
ggagctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagactgcggcggcggcggccgctgcggcggcagcggccaacggataagcgtgcttgcacgccgccaaggggccccgggtaccccacgccgctggaggccatgggataagggccccaggaagaagttcgtctaccttcaccgggtgtctaaaacggtccctgggaatttacaaagcccggattacccttgcgaccgtgggaattttggaatccaaggtttcccccatatatttctccccgggggaatcccaaaagggggtcccggggtgtaccccacatattgggggaaaaaaaagcgggtaaatacaactctggggcgtgggagaaaccaccggtgagatttttcctcggccccagggtgtgaaaaccccatctgtgtgaaaatacgccccccttctcctaggagactcggcccctctccctttggatatataagggccgtgtgttttttttttttttcacaaactcgggcaaaaacccccatagggggcccccccctcttcatataagggggtgagaattcctcagaaacattttgtaaaatataacgggggtgtgtggctcttcccaaacactacatttgtcgggggtgggggaaatatttatttttctttctttagcaaaaaagagaaaaatccctgatacctctctcctccggtttttattatttcctccgtgacggtgtagaactgacctccctctctttgtattaccctcctcacccc

SEQ ID NO: 91481 - DNA, 1324 bp, Zea mays
  misc_feature: Ceres CLONE 1579862
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (711)..(711): n is a, c, t, g, unknown, or other
  misc_feature (1127)..(1127): n is a, c, t, g, unknown, or other
gacggtgggatacaaactcaggttattaatatactacacacgggggggaggctttactcaccnnannnnnacaaactggagctcaccgcggtggcggccgctcttcaatagtggatcccccgggctgctggaattcgtctcacccctagaaaaactccgtctccacctcgcctgctagcctcctccgtctgctcaggacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctacgtctctccatggcgggcccgggtccgaccaacagcagcactgaatgggatggcccccccccacagcggcttcatgggtccagccaacaatggaggccaccacgcttaaacgattcatcgtcggcgctacctatcgccggccgcccttattctgtccccaatctccacccgctgggcaaccggtacacggcccgcccagggtgcttttccctcccggaagttgacttggccccggccctcatttattccggggggttggggcagccaaattcttgtccttcccttggttcccnggttgggggagacattttcctctggtcttgcagaacccaaagggggggaaacctaagtctccttcccccccttcccaaccagttcgtaggggggagactaattttttttagagattatctgttcccccccgtagtggcgggtatttccccaattttttcccaaaaggggggttttttcccgcggcgggaaaaaagaaggtggcccccccccctctttttttttttcctcaggggcccaaaagggggatattggccgggggggggggggaaaactctttttccttccccgggggaaagagcagcttcccaggtataagagttgcctctttttgtagaaaaaaaaaaccaattttctcgggtgtggggccatttcccccttaccatccctgtcgtaaaaagagggcccttattctccntttttggggcccgctttctcttttgatagaagatccctctggtccgaaaagcacctgtggctgcttataatcccctgtgaaaagggggggaggagttggttactctcctgggttcttctttacgggactcccgggtgagaataatgggaatcaagaggaccttctctagccttggagcctattctgaggggtactat

SEQ ID NO: 91482 - DNA, 1117 bp, Zea mays
  misc_feature: Ceres CLONE 1579865
  misc_feature: Encodes the peptide sequence at SEQ ID NO. 91483
  misc_feature (58)..(58): n is a, c, t, g, unknown, or other
  misc_feature (59)..(59): n is a, c, t, g, unknown, or other
  misc_feature (68)..(68): n is a, c, t, g, unknown, or other
  misc_feature (1026)..(1026): n is a, c, t, g, unknown, or other
cctcggggcccacccactacaaacatataattaatacaaccctaacaccctcccccannaaaaaaaanttacaaactggaactccccacggtggcggccgctctagaactagtggatcccccgggctgcaggaattcgtctcacccctagaaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgttagccgcgccctttttgttgaccttgagcccactgtcatcgatgaggtgaggactggcacctatcgccagcttcttccatcctgagcagctcatcattgggcaaggaggattgcagccaacaacttcccctcgtgggtcacctaccccattgggcaaaggaaaatttgttggaacctgtggcccttggaaccgccaattcagggaaagccttgccagaataaaattgggaactgggttcctcccagggggccttttcctttcgctccttttacaaacgcttgtatttggggtgggggaaggggaaaacccgggggctctctggggggcctttggggtttcccatcaaggcctcccctgtgggaaggccgacccggggtcctgggtttggaacttaaaggggccaaaggaaagatcccctaaagcctccgggggtttttctacaccgcggtgttatccccaatttccctcccccccgggttggttcccccccatcccccgtggtgtttgtatgccccatttaacaaccagcggtgttacgtgggttgacaacccaaactgcnatttatcctccagaagccccaaccctgcaatgttttggtctgttcccttggctccccaaacaagtgaaagggtcccctcctctttgtaagt

SEQ ID NO: 91483 - protein, 89 aa, Zea mays
  misc_feature: Ceres CLONE 1579865
MRECISIHIGQAGIQVGNACWELYCLEHGIQADGQMPGDKTIGGGDDAFNTFFSETGAGKHVSRALFVDLEPTVIDEVRTGTYRQLLPS

SEQ ID NO: 91484 - DNA, 1333 bp, Zea mays
  misc_feature: Ceres CLONE 1579867
  misc_feature: Encodes the peptide sequence at SEQ ID NO. 91485
  misc_feature (1)..(1): n is a, c, t, g, unknown, or other
  misc_feature (925)..(925): n is a, c, t, g, unknown, or other
  misc_feature (933)..(933): n is a, c, t, g, unknown, or other
  misc_feature (969)..(969): n is a, c, t, g, unknown, or other
  misc_feature (1179)..(1179): n is a, c, t, g, unknown, or other
ncttccgttttttgttttttatcttctccttatcctcgcgcgcggatatatgtttcatatctctttaaaaactggagctccccgcggtggcggccgtctctagaactagtggatcccccgggctgtcaggaatgtcgtctcacccctagaaaaagtcgcctcacgctcacgctcacgctgcttgctcctcctcccccatccctccgcccctcccatggcgtccctcttcggggctcgccgccggcgatcgccggagtacgacggcgaggacgatagatccggcggagggagggccaagcaccgacgcctgtcgccggaggaggctgctgcgtcgccggcggacccgggcgcggcgacggggactagccacggctggctctccagcttcgtctccggagcgaagaagggccattttcttccgttttgctgtcctcttcgcccgaggagaccggctcgggggaggaccgtcacccccaggagggaagaggaggaccaccacaccgtataagggctcgcacttatttgaatactaactatttccttgatgttagcgggtaaaatatcaccttagttgaacattgtaaacattgccttgtgatcaaaatcgtttcttacggattacccccttcaaccaggaactaaatgtatgaattgttgtggtttcttccgtatgcttacggccctgattttcaaaaatcccccccttgttggtaaacacccttagatttccgcaattagttaccccgattacacccccctgagtaagaagtactactcttttgcctcgcgctacaattattcctccttacacaccaattatattgcctactatcttctcctgcttggtccgactcgaattcaccgcgttatatgcgcgcgcctctaagagtcttcacttacctgactacctcgctcatacgttgcnctattatncacattacacgagaatatgacctactaagatatcantcttctattacgtgtataaggagtccttgatctggactgttatgcagatgtcaatccctcgttacgatacatattccccttctctaaataaacagtctgtcacgagtttttaattacatcgctgaataacgtgtctcatcgtctataccgcccttcactctgtgcacgtctcgcaagcgtagattagtcggtgtgcgattatttttagancgttctctctcgcacgtccgacctcgtccgactatatttctcttgatgcgttattaacacattcgatattctcctcgtctccttaattcctcgcgctattcgcgctttctggcgctccagttttggtttggatggctatccacgatcataatct

SEQ ID NO: 91485 - protein, 97 aa, Zea mays
  misc_feature: Ceres CLONE 1579867
MASLFGARRRRSPEYDGEDDRSGGGRAKHRRLSPEEAAASPADPGAATGTSHGWLSSFVSGAKKGHFLPFCCPLRPRRPARGRTVTPRREEEDHHTV

SEQ ID NO: 91486 - DNA, 843 bp, Zea mays
  misc_feature: Ceres CLONE 1579868
  misc_feature: Encodes the peptide sequence at SEQ ID NO. 91487
ctccccgcggtggcggccgctctagaactagtggatcccccgggctgcaggaattcgtctcacccctagaaaaaccccaacctcatcttctctccttttgctcggaacgcacacacagcccggtccccgatctccgatcccctcgtcgatccaagatgcagatcttcgtcaagaccctcactggaaagactatcaccctcgaggtggagtcttctgacaccattgacaacgtcaaggccaagatccaggactaggagggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaggggcggcatgcagatatttgtgaagactctgactggcaagactatcacccttgaggtcgagtcttctgataccatcgacaatgtcaaggccaagatccaggacaaggagggcatccctccggaccagcagcggctcatttttgccggctagcagctcgaggacgggcgcacgctggccgactacacattcagaaggagagcaccctcacttggtgctgcgtctcagggtggcatgcaga

SEQ ID NO: 91487 - protein, 123 aa, Zea mays
  misc_feature: Ceres CLONE 1579868
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAG

SEQ ID NO: 91488 - DNA, 910 bp, Zea mays
  misc_feature: Ceres CLONE 1579874
  misc_feature: Encodes the peptide sequence at SEQ ID NO. 91489
  misc_feature (417)..(417): n is a, c, t, g, unknown, or other
  misc_feature (418)..(418): n is a, c, t, g, unknown, or other
  misc_feature (509)..(509): n is a, c, t, g, unknown, or other
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggatccccagcagtgtggcactgacgaacacgcttcagcgccgtcgtcgttctcgccgctatcttgtcgtcgcctcggcgacgacagccgaacaggaggccgnnccctgtgacgatcgaggacgtgaacctcagctctcatcaggccgcgagcgacgacggggagctcgccgcgcgggggcgggagttcacggcnaccaacactgggagggtctgcttggacccatcgacggggtgctcttcagggagctcatcccgtaaggggaagtttcccccaggccaactaagaaaagttttgaaataaaaccgttttttccccctaatgggggaaatttgaaaataccggggaaaaaactttttttccaaaaatttgggccttgggggggtttgggaaaaaaagaaaccccgatacctttaagcccccttggaagaaacctaaaattcccccaaatttggagaaaaaaagagcccccccacacccaaaatatggggagaggttcccggcactttaattgggggaaaggggcccgttcccccccacaagaaaaaaggggggggttttccccccgggaaaaaatcccggtgggggggggcggc

SEQ ID NO: 91489 - protein, 106 aa, Zea mays
  misc_feature: Ceres CLONE 1579874
  misc_feature (55)..(55): Xaa is any aa, unknown, or other
  misc_feature (86)..(86): Xaa is any aa, unknown, or other
MAATVSSCLSLVPTVHHRAGGIPSSVALTNTLQRRRRSRRYLVVASATTAEQEAXPCDDRGREPQLSSGRERRRGARRAGAGVHGXQHWEGLLGPIDGVLFRELIP

SEQ ID NO: 91490 - DNA, 1131 bp, Zea mays
  misc_feature: Ceres CLONE 1579876
  misc_feature (1131)..(1131): n is a, c, t, g, unknown, or other
acccgcggtggcggccgctctagaactagtggatcccccgggctgcaggaattcgtctcacccctagaaaaaaacacactaacctaaccagctgcatctcctctctctcctaactcctaagctctcagccgtcgccgtcgccgtcgccgtcgctctcctctctgtccctctccacgccgctctcctctctcctccgagccgcagctccctctccccagcgcgccgccactgtgagcatctacaccgctgccgctctcctctctcctctgtgccgcagctcttctctctccctctcccctgcgcgccgccactacgggcaccctaaacgccgccgctgcgtggccctacacgccaccgctacgggtgccctacgcgccgccgtcactgctccagctcttctctcctctgtttcccagccaatggcgccgctctaactcccccaggcattcgccccgacgaaaggctaaaggaagcctccgggtaaaccctgggcccataggggggggcctttagcctcccaggggaaccggcaccttgggggccattttcccccccccttggagggggaaaaaaaacggggtgaaaaaagatttcccggggggaatgggggtttccccttggggcccaacacaccccccaggtggggctggggggaccctcccggggtgtgccaatcctctttcccccccctataaaaaaaatgggggtgtctccttgcggcggggggagcgagtgttttttttgagtaaccccccgcgggagtcttgctatggaattcccttctccctaaaaaaacctctccctttgtgttcgtgtgggcggccgcgccccgacataattcttcccgcaaaggatgacaaaataactcctcaagatgggtatgtacacaagggatggagcgtcccttgtgggaaattttttgtcgacatccagtgtggccctttttcttcccattattttgtacgcggggaggagagtatgctacataatagcgtgtgttttggcccccgtgctcgcaaataaatcaaaatatttcttattgtgcaccccgcaaagggagtttttccttgatctgtcttctctggcacagatgtgtccgggctctgtgtttaggagggtgtgaggaattcn

SEQ ID NO: 91491 - DNA, 958 bp, Zea mays
  misc_feature: Ceres CLONE 1579877
ctccccgcggtggcggccgctctagaactagtggatcccccgggctgcaggaattcgtctcacccctagaaaaagtggactcctactcctactcctactcctactctctccccttcctcccgttgattgattgaggggattgctactaggcgggcgctagcactgcgaagcatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgactgccgcgccggcgccgaccacgccatcggctccgccggccaacgcgacaaatccgccgcccgcgaccccgtccgcgccgccaccggtggcgcccacgcctcccacgcccaccccgcccacgccgttcccgtcgttcccagccgctgcgccgccgtcacccccctccgtcccggcccccgcgccgtccttcaccccggtagactccctctgggccctcgccctcctcccctttctccccgggaacgcccggcaccccttcgcctccttggaaaaccccttcccccccttctcccggggaagggggcagttccccccctcccccgggggggggggaaataaagccgttcccccctttcccctcaatgagatttggggggggggggggggggggggactcccggcgcgtataaataccctttggggtgtggccacttggggcctcagttttacgtttctacaaattattgcgcttttgtcccccctaaaaaccttcggccctcctctgcctttaaaattataaccacccctcccctcttcccggaagacaactcgcggtgtatcatctttgttcgaacggtctcccccccccaacacattttgggttatacccctccgcccccccatgatttttgttcctccgtcgccgcg

SEQ ID NO: 91492 - DNA, 829 bp, Zea mays
  misc_feature: Ceres CLONE 1579879
  misc_feature: Encodes the peptide sequence at SEQ ID NO. 91493
ggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgcgcgcgcagggcgggcccggcgccggacctggtgggctcgggcgggccagggacttcggccgctccaagagcgaggttcaggaagtgca

SEQ ID NO: 91493 - protein, 226 aa, Zea mays
  misc_feature: Ceres CLONE 1579879
  misc_feature (103)..(225): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVSEGESAGPGGFVAFVGNLLFPFIAFAGLFFLFRARRAGPAPDLVGSGGPGTSAAPRARFRKC

SEQ ID NO: 91494 - DNA, 1010 bp, Zea mays
  misc_feature: Ceres CLONE 1579880
ctccccgcggtggcggccgctctagaactagtggatcccccgggctgcaggaattcgtctcacccctagaaaaactgcagtccagagtccagactccaggactaccagtctaccaccacttcgtctcgtcctcacacctcactccaccacctctgccttgcaaagccttccacaccgatccgccgcctcgtccgcgcgctcgcaggcagcagtgtggactacccgccccatactccatcccctactcgaaggacctcgagttaagttgggcgaggagaggtggttcattccagcagggatccttctcgtgagcccagtcgatctgaccgtccttggtatctgggggggttgttctgtactctctctttaatttgtgagtcgtgacaggttcttgaagtgcaattgttaagagttttagttgtagaggaagagaaggatttgcctatatggcgttgggcaggaacctccaaagtaaggctgggaatgtatccgcctttgggaattttccgggggaatgggccgtttttcccccaccgtcccggttaattccttgtttgggcgagaagggtgggggcccccccctggggggcaatgccaaaggggccgggttccccggcctatccccccggaaggaacacgtacccccccgattggaaccccccaaaaaaatgggcctggccttttggggaaaaaaagggggctaaaaactttttccttgagaaggggggacaaatgttttaaaacaccccgggaaaacacccccctccgggaaaaaaaaaaagagccccaagggcctcttcctctctaaaaatcccctatgtgcgcccttttttcccaaccctcttttaaacaaaaaaacaagggggggttgtcccccaaggagatctcccccggggtgtggggggaaaaaaagcgggccaccaaaactttttttggggggcaaaaaaaaaaaaaaaaaaagcggtcgccccccccgctgtgcccccccaaaatttgtggtggtggggggg

SEQ ID NO: 91495 - DNA, 846 bp, Zea mays
  misc_feature: Ceres CLONE 1579883
  misc_feature: Encodes the peptide sequence at SEQ ID NO. 91496
ctcacaggggtggcggccgctctagaactagtggatcccccgggctgcaggaattcgtctcacccctagaaaaaactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcgtgtcgtccgaacatcctttcggaggaattatgctgatcctaatgaagtcgctgccgtcattttgggtggtggtaccgggactcagcttttccctctcactggcacaagggccacccctgctgttcctattggaggatgttacaggcttattgatatccccatgagcaactgtttcaacagtggcataaaaaagatatttgttatgaatcagttcaaactcagcttctcttaaccgtaacattcatcgtacccaatcttggggggggggaatcaccttcacgggggagaatctgttgaaggggactgggctgccaacacaaaaagccttgagggaaagcctgcttgggatggggttccaaggggcaacagtcagaaacccccgcttagtaaaaaaatta

SEQ ID NO: 91496 - protein, 146 aa, Zea mays
  misc_feature: Ceres CLONE 1579883
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFSARGAVSSTQCVLTSDAGPDTRVVRTSFRRNYADPNEVAAVILGGGTGTQLFPLTGTRATPAVPIGGCYRLIDIPMSNCFNSGIKKIFVMNQFKLSFS

SEQ ID NO: 91497 - DNA, 847 bp, Zea mays
  misc_feature: Ceres CLONE 1579885
  misc_feature: Encodes the peptide sequence at SEQ ID NO. 91498
aagctggagctccccgcggtggcggccgctctagaactagtggatcccccgggctgcaggaattcgtctcacccctagaaaaaactttcgcaagcccccttccgaccttgcccctgcggtctcccgagtcccgaagcatccccttccaaaaccctcgccgcgccgcagccacccttgcttccgcacgctatcgcccgggaccagccatctatggcggcgtccctgctcctccgcgccgtgcgccgaagggagcttgcgtcccctctcggatccctgggtgccagcatacagtcaacatgtgttgccaacatatgctcaaaatggggaaggtttgcaagacctttcagtgcaaaagctgctggaaatgaggttattgggattgatttggggacaacgaactcacccgcctctgttatggagggaaagaacccaaaagttattgagaatgctgaaggtgcgagaacaacaccatctgttgtcgcatttactcagaagggtgaaagacttgttggaactccagccaagcgccaggcagtaaccaacccccagaatactttgtttggaacaaagaggttaattgggcgacgctttgatgatccacagacacagaaagagatgaagatggtgccatacacaatcgtgaaggctccaaatggtgatgcttgggttccaaacaacagatggcaagcagtactcacccaatcaggggcgggtgcattttgtgctggaacaagatgaagggagacagcctgaaatcttaccttgggcaagtcctatcttcaaaggcaggtgaattactggttcccagctttaatttcaatgaacgctccaggggtcaggccccaat

SEQ ID NO: 91498 - protein, 175 aa, Zea mays
  misc_feature: Ceres CLONE 1579885
MAASLLLRAVRRRELASPLGSLGASIQSTCVANICSKWGRFARPFSAKAAGNEVIGIDLGTTNSPASVMEGKNPKVIENAEGARTTPSVVAFTQKGERLVGTPAKRQAVTNPQNTLFGTKRLIGRRFDDPQTQKEMKMVPYTIVKAPNGDAWVPNNRWQAVLTQSGAGAFCAGTR

SEQ ID NO: 91499 - DNA, 1004 bp, Zea mays
  misc_feature: Ceres CLONE 1579887
  misc_feature: Encodes the peptide sequence at SEQ ID NO. 91500
tccccgcggtggcggccgctctagaactagtggatcccccgggctgcaggaattcgtctcacccctagaaaaaacctctcactaccaccatccgctgtcgcgggatccatacgagctgctgctgcagcgcgcgcgagctagcttctgtcggtcgacagatcgatggatggctggggcatcatggctcgggagggagcaggcgctgctgtcaacagagatcgtgaacggcggcgtggtagccgtcgggcccggacggcggcttcgccggacttctcggtgcgcgtgcgccgccgcctgccggacttcctgcagtcagcgaaacgcgagtacgtgcgcctcgggtaccactacatcatctgccacggcgtggtagctggccaccatcgccgtcatcgtgatggtgtgctgcgcccagctgggcagcctcggacaccacgagcagtggcccaaggtgtggggggaggccagctgtcgacctagccttcgtgactcggctgtatcgccgttctagacctttacaggttccgtcttctgatgtgcaggcccaagaccgggtacgccagagatgtggcttgttatcggcgggcccagaagcgctggggtccaagggggagatcatcgacctgacacgcagtccggctaggtcgacgaggacagactggcattacggtcggagccttgttggggaggtagggacctgggaacaattcgtagttcccgcatgaggtgttgtagccaacaaccgatgcgcaagcatgaaaagaagtgcccccccaggcccccacgttcagtgggcccaacgcatggaaaaaccttttaaagattgaacgactccggcgccaggaaattgtgtggcacggttggtacagggacccctccctgaaaaggagcgcattcctgtgggcgagaacgcgcactaatgtacataagggggggtgattgcccggattttacagcaggtgggtatttgggttcccaaggcggtcttttctcgaaattattgg

SEQ ID NO: 91500 - protein, 99 aa, Zea mays
  misc_feature: Ceres CLONE 1579887
MAREGAGAAVNRDRERRRGSRRARTAASPDFSVRVRRRLPDFLQSAKREYVRLGYHYIICHGVVAGHHRRHRDGVLRPAGQPRTPRAVAQGVGGGQLST

SEQ ID NO: 91501 - DNA, 950 bp, Zea mays
  misc_feature: Ceres CLONE 1579890
  misc_feature: Encodes the peptide sequence at SEQ ID NO. 91502
  misc_feature (792)..(792): n is a, c, t, g, unknown, or other
  misc_feature (805)..(805): n is a, c, t, g, unknown, or other
  misc_feature (806)..(806): n is a, c, t, g, unknown, or other
  misc_feature (889)..(889): n is a, c, t, g, unknown, or other
ccccgcggtggcggccgctctagaactagtggatcccccgggctgcaggaattcgtctcacccctagaaaaaatcgcgcgattcctccgcccgcgattccccaccccgcgcccgcagccccccgtcctcccggccgcagccgagcacagccgccgcgcccacaaatcacgcgactcccgcttccatgtcctcgcgtcctccattgcagccgcatacatagcgtcgccccttccatcgatggcagccagccgcgcccgcaaatcacgcgactcccccttccatggcgtcgcccccttccatccatggcaggtccgcgcccctacgccccaaatcacgcggatggaaggtatgcgcctcctctccctattgctcagtgtaggcagtccccaaatccgcgcgtccgcgccacctcctactctgcgctccccgttccatgtcacgcgcacctgctcccgcaccggagaacccaccgcaagccgacctcgtcctgagatggcggtggcgctgtgcttcccaggggtcgcgagggagtctctctctggacgcgcccgtcgccgcctccaagctcaggagggagcggcgcccggcccccgcgagcgtgaacccggggccacaatgcttgaggcggaggaggggcctggcggttcgctgccagacggggtccaccgcagcgcccttcctcaggacggaggagccccccgcggctgcggcgggggcaaggaatgcccaggcggggttcaccttcgtcatgaagttcggcggctcgtcgctcgcgtcagccgagcggatgcnggaagtgggcggnnctcatcttagcttcctcgacgagatgcctgtcgccgtcctctccgccatgggggagacaccaattaactcctcctaggacctncatttctagcttcagcgcctgagtcagggtgctcgattctttccgctaaaagctaaaaggc

SEQ ID NO: 91502 - protein, 149 aa, Zea mays
  misc_feature: Ceres CLONE 1579890
  misc_feature: SWISSPROT Homolog: EC 2.7.2.4 Aspartate kinase
  misc_feature (120)..(120): Xaa is any aa, unknown, or other
  misc_feature (125)..(125): Xaa is any aa, unknown, or other
MSRAPAPAPENPPQADLVLRWRWRCASQGSRGSLSLDAPVAASKLRRERRPAPASVNPGPQCLRRRRGLAVRCQTGSTAAPFLRTEEPPAAAAGARNAQAGFTFVMKFGGSSLASAERMXEVGGXHLSFLDEMPVAVLSAMGETPINSS

SEQ ID NO: 91503 - DNA, 1274 bp, Zea mays
  misc_feature: Ceres CLONE 1579892
  misc_feature: Encodes the peptide sequence at SEQ ID NO. 91504
  misc_feature (64)..(64): n is a, c, t, g, unknown, or other
  misc_feature (65)..(65): n is a, c, t, g, unknown, or other
  misc_feature (430)..(430): n is a, c, t, g, unknown, or other
  misc_feature (1166)..(1166): n is a, c, t, g, unknown, or other
gaatatgtctatgttttgtttgtgtttagtgtctgtccgaacttgcgcctgccctccttcgttnncaaaactggagctcaccgcggtggcggccgctctagaactagtggatcccccgggctgctggaattcgtctcacccctagaaaaaatcgcgcgattcctccgcccgcgattccccaccccgcgcccgcagccccccgtcctcccggccgcagccgagcacagccgccgcgcccacaaatcacgcgactcccgcttccatgtcctcgcgtcctccattgcagccgcatacatagcgtcgcgccttcgatcgatggcagccagccgcgcccgcaaatcacgcgactcccccttccatggcgtcgcccccttccatccatggcaggtccccgccccttagccccaaaatacgcggatgggaggatggnccccctctccctattgctcagtgttagtagccccccaatccgcgcggccgcgccaccccctattctgcgctcccctttccaggtcttgtgccattggctcccggcagcgtgagaacccctccgcaaaggcgaacctccgtcctcgagaagggcggtgggactctgttgctttccaagggggtcgccatggcgagtaccctcctcctgggtcgagcccccttttatcttttctcccaaacttctccgaagtggaatccgggtcccctggcctcccccgggtaagagtgggaaacccagcggcgccctatcaattgtctttaacccctccgtacgtaagggtgtcctctgggcggtggttttccgtataccaccgacaggggggtgtcctaccaccaaatccgagccccgcttgctgtcttatggacgtggagaggggagctccctcccttccttcgtcattctctactacaaggctgtcacaaagtctatattgtccctatgtccgtgggtgttctccctcctattctcccacagtgtaaaattctgcgtgttggggtcggtagcttctcccagtgcgttccggtcgaggatcgctgatcattacccttactatcgtagcgccgcgacccatagttatctgtactgcatttgtgcgctcctcagtacactccgttgatggaacgacgttcgctcctcgtcttctacggtgtgtgatatacactccccccacttattngttctcgccccccggagagcactctttctcgagcccttttgtttttcatcctgctgcgccgcggatatagactgggggattcgcataatatactcgtccttacgcacc

SEQ ID NO: 91504 - protein, 31 aa, Zea mays
  misc_feature: Ceres CLONE 1579892
MASTLLLGRAPFYLFSQTSPKWNPGPLASPG

SEQ ID NO: 91505 - DNA, 807 bp, Zea mays
  misc_feature: Ceres CLONE 1579893
  misc_feature: Encodes the peptide sequence at SEQ ID NO. 91506
  misc_feature (492)..(492): n is a, c, t, g, unknown, or other
  misc_feature (580)..(580): n is a, c, t, g, unknown, or other
ggagctccccgcggtggcggccgctctagaactagtggatcccccgggctgcaggaattcgtctcacccctagaaaaagcaccacacggcacctggcactgccagcctcgtcgcgcacggcctatatatccccagtctcttcatctgcagcgacaaaaataggaaccgagcaaaggtctggcgagctaccaataaactaccatctccacaaacaggccagcacgtagctatatgccagaactgacctagctagtagaggatcgatcgcagatggtgtttcctgccatcctccccaaggtggccgcacgatggctcttcacgttctaccgcgccgccagaaagctcaggcgccacgccttccagctctactaccgcaacactaccgccgccaagccgtcgtccgccgccgccgccgccgtctcgcagcaacagaccggggccgccgccactgcccgcttgaagaccggggccgcccatcctgacgcccgcggnccgaaaccgtgtgtgcgagatgcacggcgccctgctgcgctccaccgggctcttcccctactcatgctcgtggccgtggaaaggcggnagcctcctcggcgcatgctgctgctttgggctttccccctctttggggccctcgggaacgccccggggcccggggtcccgggtaaatgggtttctccccctttccggggggctaaggcccagggaacgggaaccttggggcccgggccttcttggcaaaaaattataggggaaagacctcccccgcgggggttaaggaaaacctttgggccccgggcaaagaaaaag

SEQ ID NO: 91506 - protein, 179 aa, Zea mays
  misc_feature: Ceres CLONE 1579893
  misc_feature (104)..(104): Xaa is any aa, unknown, or other
MVFPAILPKVAARWLFTFYRAARKLRRHAFQLYYRNTTAAKPSSAAAAAVSQQQTGAAATARLKTGAAHPDARGPKPCVRDARRPAALHRALPLLMLVAVERRXPPRRMLLLWAFPLFGALGNAPGPGVPGKWVSPPFRGAKAQGTGTLGPGPSWQKIIGERPPPRGLRKTFGPRAKKK

SEQ ID NO: 91507 - DNA, 866 bp, Zea mays
  misc_feature: Ceres CLONE 1579894
  misc_feature: Encodes the peptide sequence at SEQ ID NO. 91508
  misc_feature (595)..(595): n is a, c, t, g, unknown, or other
  misc_feature (606)..(606): n is a, c, t, g, unknown, or other
ggagctccccgcggtggcggccgctctagaactagtggatcccccgggctgcaggaattcgtctcacccctagaaaaagcacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtcntcaagtctgancagattgttgttgagaagtccactgtccctgtcaagacggctgaggctatggagaagatcttgacccacaaacagcagggcatcaactaccagattcttttccacccagaagttcttggcggagggcactgtcatttgaggaccggttcaaggcctgaacgaagggcttatccggtggccggggagaacccctgaagggcaaggaagggccctccccggcttctccaagggagggggtacccccccacggggggtctccc

SEQ ID NO: 91508 - protein, 184 aa, Zea mays
  misc_feature: Ceres CLONE 1579894
  misc_feature (2)..(178): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (117)..(117): Xaa is any aa, unknown, or other
  misc_feature (120)..(120): Xaa is any aa, unknown, or other
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVXKSXQIVVEKSTVPVKTAEAMEKILTHKQQGINYQILFHPEVLGGGHCHLRTGSRPERRAYPVAGENP

SEQ ID NO: 91509 - DNA, 937 bp, Zea mays
  misc_feature: Ceres CLONE 1579897
  misc_feature: Encodes the peptide sequence at SEQ ID NO. 91510
  misc_feature (937)..(937): n is a, c, t, g, unknown, or other
tccccgcggtggcggccgctctagaactagtggatcccccgggctgcaggaattcgtctcacccctagaaaaagcaaaacaaaacaccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggccgtggacgggcacccggtcctgctggacgtgccggccaacatccgtctcaccccggcgtcgacgctcgtgcccgccgcggacgtccccgcagcgggcggcggcagcttcctcggcttcgacgcggcggcggccgagagccggcacgtggtgcccgtcggaaagctccgtgacattcggttcatgagcatcttccgtttcaaggtgtggtggacgacgcactgggtgggggacagcggcagggacgtggagaacgagacgcagatgatggtgctcgaccgctccgccggcgagcccgtcggcggcggccgaccctacgtgctgctgctccccatcatcgagggcttcgtccgggcctgcctcgaagcccggaaggtggaagactacgtggacctgtgcttggaaagcgggtcttcggcggtgcgcggcgccccgtttccggacttccctgtacctgcaaccgggcgaacaaccctttcaagctcgccccggacccccttatggatgggccccacgcacctggggaccttcccggaccagggaggagaagacacccccccccttacgtggtacaaattcccggtgggggcacttgggaaacccttctacccctaagggtan

SEQ ID NO: 91510 - protein, 240 aa, Zea mays
  misc_feature: Ceres CLONE 1579897
  misc_feature: SWISSPROT Homolog: EC 2.4.1.67 Galactinol--raffinose galactosyltransferase
MAPNLSKKTPAGLLGDEVAPVEGLKPSRFTLKGKDLAVDGHPVLLDVPANIRLTPASTLVPAADVPAAGGGSFLGFDAAAAESRHVVPVGKLRDIRFMSIFRFKVWWTTHWVGDSGRDVENETQMMVLDRSAGEPVGGGRPYVLLLPIIEGFVRACLEARKVEDYVDLCLESGSSAVRGAPFPDFPVPATGRTTLSSSPRTPLWMGPTHLGTFPDQGGEDTPPLTWYKFPVGALGKPFYP

SEQ ID NO: 91511 - DNA, 940 bp, Zea mays
  misc_feature: Ceres CLONE 1579900
  misc_feature: Translation starting site: 511
  misc_feature: SWISSPROT Homolog: EC 4.2.1.1 Carbonate dehydratase
tggaactagtggatcccccgggctgcaggaattcgtctcacccctagaaaaactaaaaaaaaagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaaatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtgcccgtcggtgacacctgggcctgcagcccggcgaggcattcaccgtccgcaaaattgcctccaggttcccaccctaaaacaagatcaagtacgccggcaccgggttcgccatctagtacgcgcggtgcgcgctcaaagtgcagtcatccgtggccatgggccacagctgctgcggtggaatcaggagcgctcccttccttaagtacgggcggccgataaacttccactttctgaagaaatggggccagattgagcaccccggccaagaacagagggataaaaag

SEQ ID NO: 91512 - DNA, 959 bp, Zea mays
  misc_feature: Ceres CLONE 1579904
  misc_feature: Encodes the peptide sequence at SEQ ID NO. 91513
ctccccgcggtggcggccgctctagaactagtggatcccccgggctgcaggaattcgtctcacccctagaaaaactcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacagccttccccggctggcggaacacgcccgtcacgacgcggcagcgcgtcatgttcaagttccaggagctcatccgggctaacatggacaagcttgcagagaacatccctacgggagcaggggaagacgcctaaaagatgcttggggcgacgtgttccgcggcctagaggtgggtggaacatgcttgtggaatgggaacactgcaaatgggcgaatatgtatcaaatgtttctaaaggggattgaccccttcagcattcgggagcccccttggtggtttgccctgggaaaatgccccttttattttcctcggcaataatcccccttgggaagttttcccattaccgctttccggtgggaaaaccttttgtctcttaaccctcggaaaagagcacccgggggctccttttatagatttgcgggagccttacaatgtgaacctgggctgtccaaaagggttttttaaaactctctcctcgggcccacaatgttctgtttccaaaaaatatttgggcaagagaggggaaattaaagcgtggttt

SEQ ID NO: 91513 - protein, 135 aa, Zea mays
  misc_feature: Ceres CLONE 1579904
  misc_feature: SWISSPROT Homolog: EC 1.2.1.27 Methylmalonate-semialdehyde dehydrogenase (acylating)
MLRSALFRSAPGLRRSPATAHLSTAAAAAAAWLSNGPASAPSRVRLLIGGEFVESRADEHVDVTNPATQEVVSRIPLTTADEFKAAVDAARTAFPGWRNTPVTTRQRVMFKFQELIRANMDKLAENIPTGAGEDA

SEQ ID NO: 91514 - DNA, 977 bp, Zea mays
  misc_feature: Ceres CLONE 1579906
  misc_feature: Encodes the peptide sequence at SEQ ID NO. 91515
ctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccagagacgttcgccaagaaccgggagctggaggtcatccactcccgctgggccatgctgggcgcgttgggctgcgtgttcccggagctgctcgcccgcaacggcgtcaagttcggcgaggccgtgtggttcaaggccgggtagcagatcttcagcgagggtgggctggactacctcggcaacccgagcctgatccacgcgcagagcatcctcgccatctgggcctgccaggtcgtgctcatgggcgccatcgaggggtaccgcgtcgccggcggcccgctcagagaggtcgtcaaaccgctctaccccggcggcagcttcaaccccttcgggctcgccgacgaccctgaggccttcgcggagcttcagggtgaaggagctcaagaacggcccgcctcgccatgttctccatgtttcgggttcttcctccaggccaacgtccccggcaagggggccgtttcgaaaatctcgccaaacaacttcggccaacccggttaataaaaacgcaggggatttatgccctcaaccttgttgcccggccaatgtaagggggtggaaggcgccccgcgcccaccggtctacc

SEQ ID NO: 91515 - protein, 134 aa, Zea mays
  misc_feature: Ceres CLONE 1579906
  misc_feature (64)..(134): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCVFPELLARNGVKFGEAVWFKAG

SEQ ID NO: 91516 - DNA, 1200 bp, Zea mays
  misc_feature: Ceres CLONE 1579909
  misc_feature: Encodes the peptide sequence at SEQ ID NO. 91517
  misc_feature (5)..(5): n is a, c, t, g, unknown, or other
  misc_feature (6)..(6): n is a, c, t, g, unknown, or other
  misc_feature (35)..(35): n is a, c, t, g, unknown, or other
  misc_feature (54)..(54): n is a, c, t, g, unknown, or other
  misc_feature (990)..(990): n is a, c, t, g, unknown, or other
ttttnngccctgggcgtgtgggatggcgccacccnaacaatccctcccctctcnaaaaaaggttgaaaccaaaaaaaaagatggagctccccgcggtggcggccgctctgctggtagacccggccaacggctacttggcgctgctgtcgcaccactgcatgccgctccactccttcccgcgcctctacgccgcgctcttcccgacaccggcggcggcggcggcggccacgcgtgcacgcagctacatcgaggtgctgaagggcgagccgcagatggcgtcgcgctacgcggagcgcggcggcgaggagggcatgctcccggaggtgccctacgagcggttccgcatcgggtcgcagttcttcgcgctggcccggcgccacgccgtgctggtggtccgggagcgccggctgtggcgcaagttccgcgcgccctgcgtccccgagatggcgcaagactcgtgctaccccgaggagcactaccccccgacgctgctggacatggcggacccccgcggcgtggcgcggtacacgctgactccgcgtcaactgggacgggcagcgttcgcggggccaccccgaaaacgtaacaccgggaacgggagggtctcgcccgaagggctcaatccggaaaaacttccggcggccttcccaaaccaacaaaccccaccccccccaaaatgattttccgccgcccgcaaaaagtttgcggccggcccccgcgaaacttgggcccattcggggggcccccgtgcctttcccctgcggacgccaaatatcgtgtgcgcgaaaaatcacacccaggaatcccagttttctttttcccaaaggggggaaatcttcgaaatttggttcgtggggggctggcgagggcttcccccatttctccccgaggggcaataccacaccattttttagcataagatattatacagctacatttcccggtccctgttccgccaaaaagcggtcttggggcggagccctttgaggncacaaaagggccctcgcgccgtgaatacaatacgcgagaacggggctctttgggaccaagactggataaaataaaaaatgatccttcctacacacgtgtgttgtgaaaacacccctgtgcccccccatatgtaagagcggttcgatgtgattctatctcgagcggaccacgaagtgcctatcttagtgctcaaaaaaatattatagaggg

SEQ ID NO: 91517 - protein, 199 aa, Zea mays
  misc_feature: Ceres CLONE 1579909
  misc_feature (1)..(182): Pfam Name: DUF266 Pfam Description: Arabidopsis protein of unknown function, DUF266
MELPAVAAALLVDPANGYLALLSHHCMPLHSFPRLYAALFPTPAAAAAATRARSYIEVLKGEPQMASRYAERGGEEGMLPEVPYERFRIGSQFFALARRHAVLVVRERRLWRKFRAPCVPEMAQDSCYPEEHYPPTLLDMADPRGVARYTLTPRQLGRAAFAGPPRKRNTGNGRVSPEGLNPEKLPAAFPNQQTPPPPK

SEQ ID NO: 91518 - DNA, 892 bp, Zea mays
  misc_feature: Ceres CLONE 1579913
  misc_feature: Encodes the peptide sequence at SEQ ID NO. 91519
ctccccgcggtggcggccgctctagaactagtggatcccccgggctgctggaattcgtctcacccctagaaaaaatcacagtgcgggcggcgggcgccactctcacacctaccaggaaaccaatcaaaacttaaaaccaatcgaaattagaccggcgacgaggattagcgctcgccggcgatggattctgactacggcgtgcctcgcgagctctcggaggtgcagaagaagcgcacgctctaccagcccgagctgcccccctgcctccaggacaccactgtcagggtggagtatggtgatgctgcaattgcagctgacccggcaggtgctcatgtgatcagccatgcattccctcatacctatgggcagcctattgctcattttctcaggaacacaactgttgtccctgatgctaaggtcatatctgaacaccaggcggtcagggttggcattgtcttctgtggcagacaatccccaggaggccacaatgttgtttgggggctctatgaggctatcaaggcccacaaccaaaacagcaaactcattggtttccttggtggatcagatggtctgctagcacagagaaccttggagatcactgataaagttattgcttcatataaaaatccaaggtgggatatgacatgctttgggtcgaaacaaaaggatcagtattagggaacgacggagcaagggcaaatggtggcttatgggctagtttgccaaagcttttgaaagttgggaaggcctctgggttatcaattggggagggtgtgcactttcccaaacacctggaatgctggccttcaacccttggcccggaagaccattttgtgcctggtagaggcaaaaagtggtgggcgcaaccaataaagaggtttggtgtgggggt

SEQ ID NO: 91519 - protein, 165 aa, Zea mays
  misc_feature: Ceres CLONE 1579913
  misc_feature: SWISSPROT Homolog: EC 2.7.1.90 Diphosphate--fructose-6-phosphate 1-phosphotransferase
MDSDYGVPRELSEVQKKRTLYQPELPPCLQDTTVRVEYGDAAIAADPAGAHVISHAFPHTYGQPIAHFLRNTTVVPDAKVISEHQAVRVGIVFCGRQSPGGHNVVWGLYEAIKAHNQNSKLIGFLGGSDGLLAQRTLEITDKVIASYKNPRWDMTCFGSKQKDQY

SEQ ID NO: 91520 - DNA, 1297 bp, Zea mays
  misc_feature: Ceres CLONE 1579914
  misc_feature: Encodes the peptide sequence at SEQ ID NO. 91521
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
tttttcgttttttnntncatttttattattaaaatatatattattaaaccacagatagaagttcgtttttctaactgggactccccgcggtggcggccgctctagactagtggatcccccgggctgcaggaattcgtctcacccctagaaaaatttttttcgtcgcaatcctcaaaaagggaagacatggtcggcgagcgcactgctgacggggtcgccgtggctgcgcatgcacctcctaccggacgcgcccgcgcgccccttccgccacctccacctccgccggagcttctccgtccgcgcctccggcgccgacggcagccccgcccccgtccgcgtccgccttcgcgccgtcgcccaccggcaaactccacgtcggcggcgcccgcaccgcgctcttcaacaacctcttcgcgtgctacaaggggggggccgcttcctggctccccagtccaggacacaccacctctaggcgccccacccggaaaatccgaaggaaggtcgttctccacccgaacatcaccctggcctccggtcctagatcttggggaaccaaaaggcccccccaatgtatagagtggggggaatttttggggcgctttttttcttgcctctgtttgagaggcgggaaaaattcccttgtgttacaaaaacttgcaaaaggttacgaagaaaaacccctatttatagaaacactcctcggtgtgggcggggtattctaaccggcgcggtcttttatttacattctctcagtctcaagagtaatatttccttttagcctattacattctaaaaggggcggcgattcttcatctccgagtggacgtgtgatgaccacatacacatatttcccgcctccccggggatggtgatacaaatatggtcggggaaacaaactttgggagtctcataaagagtgcccttctctcgttaaagtgttgtatgaacggaaggtatccccccataccgggtggagtgttgtatgaagtttaaaaaggggaggaagaactgctatatgtatgtctatatttatatacacgctgctctctccaccgtctatatgtaggctataaaagaagacaaacaagggctgctcttttctgttgacaaacagacatagagaggggtatattgctcgatactatccgcgtggatgttgacacctgtcgccgctagttgtgcggcaaacacgcataaaacaaaataaacgtacttctgagaaatagataacactaacactagcagattgtatctacctatatcacagattattgatgtcgacacataccctctttag

SEQ ID NO: 91521 - protein, 69 aa, Zea mays
  misc_feature: Ceres CLONE 1579914
MYRVGGIFGALFFLPLFERREKFPCVTKTCKRLRRKTPIYRNTPRCGRGILTGAVFYLHSLSLKSNISF

SEQ ID NO: 91522 - DNA, 808 bp, Zea mays
  misc_feature: Ceres CLONE 1579922
  misc_feature: Encodes the peptide sequence at SEQ ID NO. 91523
  misc_feature (641)..(641): n is a, c, t, g, unknown, or other
  misc_feature (642)..(642): n is a, c, t, g, unknown, or other
  misc_feature (647)..(647): n is a, c, t, g, unknown, or other
  misc_feature (661)..(661): n is a, c, t, g, unknown, or other
  misc_feature (714)..(714): n is a, c, t, g, unknown, or other
ctggagctccccgcggtggcggccgctctagaactagtggatcccccgggctgcaggaattcgtctcacccctagaaaaaggacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgccctcgtcggcggcttcctcgccgacgccaagctcggccgctacctcaccatcgccatctccgccacaatcgccgccacgggcgtgagcttgctgacggtggacacgacggtgccgagcatgcgtccgccggcgtgcctggacgccnngcggncgcgcgcgcacaantgcgtgccggcgcgcggcgggcagctggcgctgctgtacagcgcgctgtcacnggtggcggcgggggccggcggcttcaagcgaacgtgtcccggttcgggtcggacaatttcgacgggcgcgaaccgcgggaagagcgcgcatggg

SEQ ID NO: 91523 - protein, 192 aa, Zea mays
  misc_feature: Ceres CLONE 1579922
  misc_feature (137)..(137): Xaa is any aa, unknown, or other
  misc_feature (139)..(139): Xaa is any aa, unknown, or other
  misc_feature (143)..(143): Xaa is any aa, unknown, or other
  misc_feature (161)..(161): Xaa is any aa, unknown, or other
MVSGAGHGGYGGGDDGQAVDFRGNPADKSRTGGWLGAGLILGTELAERVCVMGISMNLVTYLVGELHLSNSKSATVVTNFMGTLNLLALVGGFLADAKLGRYLTIAISATIAATGVSLLTVDTTVPSMRPPACLDAXRXRAHXCVPARGGQLALLYSALSXVAAGAGGFKRTCPGSGRTISTGANRGKSAHG

SEQ ID NO: 91524 - DNA, 868 bp, Zea mays
  misc_feature: Ceres CLONE 1579932
  misc_feature: Encodes the peptide sequence at SEQ ID NO. 91525
  misc_feature (395)..(395): n is a, c, t, g, unknown, or other
ctggagctccccgcggtggcggccgctctagaactagtggatcccccgggctgcaggaattcgtctcacccctagaaaaaacctcgactctcaatacccaaattccttccccgaggaggaacatttccaccgcactataaaacacccaaatttgcaacacgatagattggacctaggctaccatcgccaagcccgcttttggttatcgttccttctctccagtctagacttagcctctccctccctctctctctctcttcccggcggggcggccggaaatctccccctaagttcagctggtttcacgggagagctatctcccggaggagaggaaaggacgagtctagagctggacttcttggcggattggctgctggcaatcccaggaacagacnccccctgctaaggagccgggagatgagctgcttaccgtgctccggatcctcggggaaggaggacaagagcttggcggcgctctcaccgagaccccggcctgcggccaaggcggcaccagtacgatcaaattcacgtgcttccagctccacgaaggaagattctgtacctgttcacagaggaggaaacactgcgcatggcccggcacacattttcactttccgggagttggctgttgccaccaaaaatttcacaagagattgcctgttcggagaaagtggctttgctcgcgtgtatgaaggacatatgcaacatgggcacgtcattgctgtgaagcaccttgatagagatggtgtttcaagaaatcacggattcccttgagggagtttctcatgcaaagactccatgcaccaatcttaatctgggtcagaataattggctttttgctccagaaaggttgaccatcttcctccta

SEQ ID NO: 91525 - protein, 118 aa, Zea mays
  misc_feature: Ceres CLONE 1579932
  misc_feature: SWISSPROT Homolog: EC 2.7.11.1 Non-specific serine/threonine protein kinase
MSCLPCSGSSGKEDKSLAALSPRPRPAAKAAPVRSNSRASSSTKEDSVPVHRGGNTAHGPAHIFTFRELAVATKNFTRDCLFGESGFARVYEGHMQHGHVIAVKHLDRDGVSRNHGFP

SEQ ID NO: 91526 - DNA, 845 bp, Zea mays
  misc_feature: Ceres CLONE 1579933
  misc_feature: Encodes the peptide sequence at SEQ ID NO. 91527
tggagctcaccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtccgcctcggcgacgaagaacgacggagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacgggccggacctgatgctgctccgcctcggcgccgtgccgaccgtggtggtctcgtcgccgcgcgtatccgaggccgtgcctcgcacctaagacaagtttttttcctccggccgcgactcccgggtgtccgaaatcatcatggtaggggccacccaactcgggctttgggcccttaaggggaacaatttcggcaagggggcgaagactgggcaacggtgaaccgggtttaaaaaaagaaaaaggtggggttcctaaaaggcccccagcgggaaaaaaaaaaaaagg

SEQ ID NO: 91527 - protein, 128 aa, Zea mays
  misc_feature: Ceres CLONE 1579933
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASATKNDGAAPASDPDKLLSLLPSPPMKLPIIGHLHLMGDIPYVSLAALATRYGPDLMLLRLGAVPTVVVSSPRVSEAVPRT

SEQ ID NO: 91528 - DNA, 1245 bp, Zea mays
  misc_feature: Ceres CLONE 1579935
  misc_feature: Translation starting site: 395
gtcgggcccttttacttgttactcctctcccctcacctctctcttgaatctgtttttttttctcccatactgggactccccgcggtggcggccgctctagaactagtggatcccccgggctgcaggaattcgtctcacccctagaaaaaccctctcgatccggaaacctctcaaaccctagccgcctcctgcaagtttcagagctcaggaatctgctccatggcgagtgagacggagaccttcgcatttcaggctgagatctaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagctttttcatccaccttgtcccagacaaggccacgaacacgctctccatcatcgacagcggcccccgcatgacctagtccgaccttgtcaacaacctcggtaccctctccagggtccgggaccaaggagttcatggaaagccccttgctgccggcgctggatgtgtccaagattgggcccagtctcagtatctgttttttactttggccaattcttcttcggcggatagaatctgtcgtgagccacccaagccccaacgaacgacttatgcagcaacggtggtggtgagtccccaaagccggggccgggcgagtttcacacgtgtcacacggtaggataaaccctatttggcgaaagctacacttcggtttagggggcccactctagtattcaccacccctggttcccctcccaatggcccacgtttaccggctttgtgagagaccctcctttttaagagatatccagtcccatttttctcagggaacccttgtggccccctgggaagcgcaccttgccgggagtatggcaagctagggcgtgacccccattctttcccctgtgttgagtttggtcacagataatatgcctgaacaaaagggaaatttttcctcagtcgctgtcagtgacactagtgtacggagtctccgaagcggtctcctttagtaatagggataaccgttgtgattgaatttgtgcacgcacccgacgtcatacctatatgaacctcctccttttatcaggcacctatggggggtttctcccgcggaggagcatccttttccccaccacgaaaatatacctacatcggtgtgtgatatccgcgaaatgttatccg

SEQ ID NO: 91529 - DNA, 929 bp, Zea mays
  misc_feature: Ceres CLONE 1579937
  misc_feature: Encodes the peptide sequence at SEQ ID NO. 91530
acccgcggtggcggccgctctagaactagtggatcccccgggctgcaggaattcgtctcacccctagaaaaaattccattccacccacgccgcctgcctgccccctcgcctcgggggcgaaccacgagaaggggattccggctagggtttcgcggatcgagaagagtcagggaagaagcggggggagagaagagggcggcacctagggtttccgcgggcggcccccccgcatggcctcgccagctgcagcggcggcggcggcgccaccgccggccgccaaggagaaggagaaggacgcggaggaggcaccggtcacgggggacatggtcagcgccggcttcgcagagctcgagcgccagcagcagctgctggccacctgcacgcgcctctaccaccagctgtccgaccacttcggctcgctcgagcgggggctcgcggcgcgctccgacgcgctccgcgtccgccgcagggccttcgacgcgcgcacccaccgcacgctcgactcgctccaccgccgggaggcctccatcgacgcctccgtctcgcgcgcgctcgaccacctccactccatctccgcctccgcctccgccgccgccgccgcttcctccaaggcccccgccacctccgactccgactccgagggcctcgccgagagcctgcgcgcgctgtgcgcgcggatggactccgccgcgttcctgggcttcgtggtggcccgcccccaagaggcggacgcgctgcgggccgagaatgcgccggggcttcagctcctgcgggatccgggccaagttcgtcatgggacgccgtccccgaccatcttccccgtccaaccgccgcggaggtccgggaacccccgccgacctgggcctgggccctggcgtgcttatccttcagaggccccgggtgccccgcttcgcccgaacagggacccc

SEQ ID NO: 91530 - protein, 233 aa, Zea mays
  misc_feature: Ceres CLONE 1579937
MASPAAAAAAAPPPAAKEKEKDAEEAPVTGDMVSAGFAELERQQQLLATCTRLYHQLSDHFGSLERGLAARSDALRVRRRAFDARTHRTLDSLHRREASIDASVSRALDHLHSISASASAAAAASSKAPATSDSDSEGLAESLRALCARMDSAAFLGFVVARPQEADALRAENAPGLQLLRDPGQVRHGTPSPTIFPVQPPRRSGNPRRPGPGPWRAYPSEAPGAPLRPNRDP

SEQ ID NO: 91531 - DNA, 812 bp, Zea mays
  misc_feature: Ceres CLONE 1579939
  misc_feature: Encodes the peptide sequence at SEQ ID NO. 91532
  misc_feature (530)..(530): n is a, c, t, g, unknown, or other
ggagctccccgcggtggcggccgctctagaactagtggatcccccgggctgcaggaattcgtctcacccctagaaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgncttctatagaacgtagtcccccaatcggagaagtgatcagcacaggagtggtggcgcgattcattgattttcttacacgtggaagaccaatccccaaattccagtttgaaggctgcatggggcccctccccaaaatttgggttcgggggcccttccaaaaaaacccttaaggggggggggtttaaaaaaaggggggccttttccccccatttttttgttaaaagtaattttaaaatttccccttaaaaaagagaaaattttctcggtaaaacaaggaggtgt

SEQ ID NO: 91532 - protein, 157 aa, Zea mays
  misc_feature: Ceres CLONE 1579939
  misc_feature (4)..(97): Pfam Name: IBB Pfam Description: Importin beta binding domain
  misc_feature (102)..(102): Xaa is any aa, unknown, or other
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLXSIERSPPIGEVISTGVVARFIDFLTRGRPIPKFQFEGCMGPLPKIWVRGPFQKNP

SEQ ID NO: 91533 - DNA, 812 bp, Zea mays
  misc_feature: Ceres CLONE 1579940
  misc_feature: Translation starting site: 206
  misc_feature: SWISSPROT Homolog: EC 2.7.4.6 Nucleoside-diphosphate kinase
  misc_feature (430)..(430): n is a, c, t, g, unknown, or other
ctggagctccccgcggtggcggccgctctagaactagtggatcccccgggctgcaggaattcgtctcacccctagaaaaactgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgnggaggggaaggacgtcgtgttgactggccgcaggatcattggggccaccaggccttgggaggcagcccccggtaccattcgtggggactacgccgtggaagtcggcaggaatgtcatccatggaagcgactccgtgtagaacggggaagaggagatcgctctctggttccctgagggtgtgggacatgggaaaaccaccttcatcccgggaactacgaagcttgaacaatttaagcttgggatagccttccggctccagtggaaacccaaagttttgggttggggaaatatcggggggggcccgggggggaaaaaaacctatatttgtgccccctctggggggtatacacaccaagattaaaagtcggcgccgaagaaattg

SEQ ID NO: 91534 - DNA, 978 bp, Zea mays
  misc_feature: Ceres CLONE 1579941
  misc_feature: Encodes the peptide sequence at SEQ ID NO. 91535
  misc_feature (844)..(844): n is a, c, t, g, unknown, or other
  misc_feature (853)..(853): n is a, c, t, g, unknown, or other
  misc_feature (870)..(870): n is a, c, t, g, unknown, or other
  misc_feature (871)..(871): n is a, c, t, g, unknown, or other
  misc_feature (876)..(876): n is a, c, t, g, unknown, or other
  misc_feature (884)..(884): n is a, c, t, g, unknown, or other
  misc_feature (890)..(890): n is a, c, t, g, unknown, or other
  misc_feature (895)..(895): n is a, c, t, g, unknown, or other
  misc_feature (978)..(978): n is a, c, t, g, unknown, or other
ggagctccccgcggtggcggccgctctagaactagtggatcccccgggctgcaggaattcgtctcacccctagaaaaagaaacagcagttgagcttatttactttttcgaagaaaccacaaccaaacctcggctgctcggtggtcggtgcccaggtgcgccgattatctccatcaagccgcgcatcccgctgcccccttactcatcctccccgctgctcgaaggagagccaaatccagagcgccgccgcgatggcctcccctgacgcggaacagccggcgccgacggaactcgagcggtggcgtgacctcgacatgctcttgtcccgccctggaaacctcgtggaggccactttcgatcccagccccggcctgcgagacctactggggagcctcgtggaggttttggttgtgggcgcgggcgggcttggctgcgagctcctcaaggacctggctctctccgggtttaagaaactgcacgtcattgatatggacaccatagacgtctccaacctcaatcgccagtttctcttcagagttcaagatgttgggaagtccaaggctgaagtagcagcgaagagggttatggagcgagttaatggggtgaacatagttcctcatttttgcaggattgaagataaagagatagagttctacagtcagttccacataattgtcctaggtctggattcaattgaagctcgaagctacatcaattctgtggcttgtggtttcttagattatgactcaagtgacaatccactccaagagacggttaaacctatggtagatggtggaaactgagggcttcagggacacgctagagtcattatacctggaacacancttgctttngaatgcacatatggctnnttccntcacaggntaaagntcccnttatgtactctcgccgagaacacaagaactgcagctcactgcattgagtatgctcacttgatcaaatgggatgaggttcatcn

SEQ ID NO: 91535 - protein, 183 aa, Zea mays
  misc_feature: Ceres CLONE 1579941
  misc_feature (47)..(171): Pfam Name: ThiF Pfam Description: ThiF family
MASPDAEQPAPTELERWRDLDMLLSRPGNLVEATFDPSPGLRDLLGSLVEVLVVGAGGLGCELLKDLALSGFKKLHVIDMDTIDVSNLNRQFLFRVQDVGKSKAEVAAKRVMERVNGVNIVPHFCRIEDKEIEFYSQFHIIVLGLDSIEARSYINSVACGFLDYDSSDNPLQETVKPMVDGGN

SEQ ID NO: 91536 - DNA, 1217 bp, Zea mays
  misc_feature: Ceres CLONE 1579943
  misc_feature (14)..(14): n is a, c, t, g, unknown, or other
  misc_feature (15)..(15): n is a, c, t, g, unknown, or other
  misc_feature (22)..(22): n is a, c, t, g, unknown, or other
  misc_feature (36)..(36): n is a, c, t, g, unknown, or other
  misc_feature (54)..(54): n is a, c, t, g, unknown, or other
  misc_feature (1136)..(1136): n is a, c, t, g, unknown, or other
  misc_feature (1183)..(1183): n is a, c, t, g, unknown, or other
tgaggcgtaacacnngcagccntccgcctgatgatnatctgtggtgtttgtcancgactaaaattaaaagctggactctcccggtggcggccgctctagaatagtggatcccccgggctgcattgaattcgtctcacccctagaaaaaagggtttttcctgatctcgcctcccgagccacacacgttgccgccgtgagccgccgcccacaaggctaagcaccaaccatggccttcggagctctcgtcacgtcgaggctggccaggtccggccgcacccttgcatctgccgttgtccagggtttccgttgcccagcggatagcacctccttctgctctccaggcttggagcagtagcttcggtcttctcagcacaaaagccagccgccaaccgatgacatgcggtatcggatctagggccctacgaattttgctgcggtctccgctccgtggaaaggaaaaaacacccacggggtggatttgaaattgtcacaaagggcccgagagatcgaaacccccttccatttagtcggctccaacaaatctaaaaatgggtcgaccctgggtgaaactgggaaattaaaaacccaaaacccgggcaaggggaacataaacccagattttccgcggaaagaaaaagaaactcggggcgggttcgaaaatggctacatttaatttggttaaggggatagtttttgggatgggaccccttctggcacccccggaaaagggaattattccaacaaatgggcgccccctctaaacatagaaaataggctcgcagaggccccccggtacatgtggggggttatcccacttgtgtgcttctagcaaataattatggggtggtgtccccaatcatgatgaaccctccccaccctcgtaattctcaaaatcatatggatgccaataatagtgcttcccctcccttgtacggacaggtcaaggggcaaaaatatttcctgtaaaagatgtatataacgtttgtggggggaggacacatgaaccataacaaagggccttgcgcaatttttacacgcttccccgcagaagatattattattatattaagaaaaaggctcacttatatcttcaggctcatctcactcataagagtcattctattgcgataaagaanaatttggttgtgggagaggtggggacatatttttatatagagtgcangattacatacaatcgtcggacctcttctgccggt

SEQ ID NO: 91537 - DNA, 828 bp, Zea mays
  misc_feature: Ceres CLONE 1579945
  misc_feature: Encodes the peptide sequence at SEQ ID NO. 91538
ctccccgcggtggcggccgctctagaactagtggatcccccgggctgctggaattcgtctcacccctagaaaaacagatgaatccgctctccagcagttgttcggaagaaaaagaaggtagaacacgctaacgagacaacaatgatcatggggcgcgggcgcagccacctcctgctgccggcagcagccgcctgcctgtgggagctgtcgtgcgcgcatgctgctgcgcacttcccctcaccgcactggcgacggcgccggcgagctgctgatggtcgggctcaacacgagcggcggcgggctctaccagagcgcgatggctgcggccaacgccaccacgcagcaggaggcaagccgtctcgcggcctccggaggaggcgacatctctctcaccgactacatctacacctagtactacagggtcgtcagcatcagcacgccgacgcagaacttcaccgtattcttctacacgagcagctccaacctctggatcaactcctgcggatgctacttatagattgcatgctacctgctccaactatacaagtcggtcaagtatagcacgtacaaggaggatcgcgagacctgctagatcacctacggctccagctcaatcgccgggttcttcagagactacgacgtgctggtcggggacatgaccgtaaagaaacacaagttcatcgagacaaacgcgcgaaagcaacgtaacggtcataatctggcacatcgaacggcatcctcagtctctgataccccgagatctccgtcggcaaggctccttccgatctgggcagagcatgcatggagcaagtatctgccctgccggaa

SEQ ID NO: 91538 - protein, 64 aa, Zea mays
  misc_feature: Ceres CLONE 1579945
MLLRTSPHRTGDGAGELLMVGLNTSGGGLYQSAMAAANATTQQEASRLAASGGGDISLTDYIYT

SEQ ID NO: 91539 - DNA, 965 bp, Zea mays
  misc_feature: Ceres CLONE 1579946
  misc_feature: Encodes the peptide sequence at SEQ ID NO. 91540
cccgcggtggcggccgctctagaactagtggatcccccgggctgcttgaattcgtctcacccctagaaaaactcctgccgtcctcgctcctccccacctcccgcggcctcccacgcgacatgattgcattgcgggctgccgcggagctcagctctcctgtcctgccaccaccacgccgctgacgatgccttcctctcgcctgcctctgcctgcgcacaaccgaaacggctagcccgcccttcctcccctcccctttgcttccgcaccaagatttgggcgggcgttccttcttccgataaagttgacacccgtcgtctcgtcgtgggcctggcagatactgataggtggtctggttcgtgacttgttcagtcctcctctccaggtgccgagccagggtgactgttccgaggagcgtggcgtggacccatggggaagaagggcaagtggttcggcgccgtcaagatagtcttcagccccgaatccaaggagaagaaagaggagaggctatcgatgtaaacagcagcttacaacccagtaccgggagatctgaccccatctacctcccctggaagtcaatgtttcaggtgccacccccttcgggtccctcctcctatttttctccagaatctaactattgtcagggtcccccttaaatccgaagcaggaaccagatgcaagcctgttcacccctgggaggagggccccttgctgcttgcttgcttccccatgcacaatgctttctggggctttccccctggttgcccccaatcttttaagccccctccccaattttataacccataattggcctttcccaagttttcccgggttaggtgggggcatttaaagctctcccgagagccctttatgtattttaacatcctcgggcttaggtttattcccttttagctttgatctggaaggtaatctcccgtttttggtgatttcaccttggtgtggactgc

SEQ ID NO: 91540 - protein, 29 aa, Zea mays
  misc_feature: Ceres CLONE 1579946
MGKKGKWFGAVKIVFSPESKEKKEERLSM

SEQ ID NO: 91541 - DNA, 888 bp, Zea mays
  misc_feature: Ceres CLONE 1579947
  misc_feature: Encodes the peptide sequence at SEQ ID NO. 91542
  misc_feature (819)..(819): n is a, c, t, g, unknown, or other
gagctccccgcggtggcggccgctctagaactagtggatcccccgggctgcaggaattcgtctcacccctagaaaaaattccccactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttgggacggaggagtgaaacgcgacggtgatcgtgcgaggtggggacgccatcagtgctctgtctggggttcggtctgttctttggctgcagatctggaagggtttcgtgggatccgtcgctactatctgtcccagtcagagcatctgcatcatctcgggttgggccatggagactctgctcatctcggaggagcgcaaccaccagctccaccacttctcgggtcgccgtaagaaggcgttagcagcgtcgcctcagtccacgcgcagctaccatgcgggcaactgccgggcgttccactccggcatcacggtcggcatcctgccgtccccgcccgcgcagagggttgcactgacccgctcctctcctgagccccagacaccgaaacatcagcttcaccatgggaaaaagcgcagccgagcaatctctatgaaccgtttcgacgtccccctccctctcgccctgagctctgggcttggcccggggttttctgcatttgccgccttccaggctccctcccgaatccccaagttctcacttcanccagaaagcgcagtgttcttccctagaaaatctccacctgcctgacccggtcagaaccaacgaaaagga

SEQ ID NO: 91542 - protein, 139 aa, Zea mays
  misc_feature: Ceres CLONE 1579947
  misc_feature (125)..(125): Xaa is any aa, unknown, or other
METLLISEERNHQLHHFSGRRKKALAASPQSTRSYHAGNCRAFHSGITVGILPSPPAQRVALTRSSPEPQTPKHQLHHGKKRSRAISMNRFDVPLPLALSSGLGPGFSAFAAFQAPSRIPKFSLXPESAVFFPRKSPPA

SEQ ID NO: 91543 - DNA, 809 bp, Zea mays
  misc_feature: Ceres CLONE 1579948
  misc_feature: Encodes the peptide sequence at SEQ ID NO. 91544
  misc_feature (674)..(674): n is a, c, t, g, unknown, or other
ctccaccgcggtggcggccgctctagaactagtggatcccccgggctgcaggaattcgtctcacccctagaaaaagcattgaagttgactcccagtcaaataattgagcctttaatatcatttcttgagtctccctctcaagcaattcagcaacttggcactgaggtgctctcacatcttctagaacaggaacattttcaacaggatatcactacaaaaaatgcagttgttcctctggtgcagcttgctggtattggaatcttgagcttacaacaaactgcagttaaagcacttgaaaacatctcacagagttggcccaaggcagtagccgatgcaggtggaatttttgaactttcaaaggtaattgtccaggatgatcctcagccaagtcaagcattatgggaatctgcagcacttgtgttatgcaatgttctgcgttataattctgacaactatgtcaaagtctcaatggctgtacttgtgagattgctgaactccaccatggagagtaccgtcacgaatagctctcagtgctctacttgttcaagagaaaagtagctcacgctgtgctgtggccatggctgaagctggggcagtacgggcactcttggagctcctgaagagccatcgatgtgaggaatctgcagccagatcgcttgaagccctgataaacnattcaaggggtcgtggaaccaaaggtggcaaagtatgctattgcttcactggcacagtacctggttagatcttaaatctaggaacaagtcagcaaaagtttcttgtgtactcttggccctagggtgaacatttta

SEQ ID NO: 91544 - protein, 185 aa, Zea mays
  misc_feature: Ceres CLONE 1579948
LHRGGGRSRTSGSPGLQEFVSPLEKALKLTPSQIIEPLISFLESPSQAIQQLGTEVLSHLLEQEHFQQDITTKNAVVPLVQLAGIGILSLQQTAVKALENISQSWPKAVADAGGIFELSKVIVQDDPQPSQALWESAALVLCNVLRYNSDNYVKVSMAVLVRLLNSTMESTVTNSSQCSTCSREK

SEQ ID NO: 91545 - DNA, 1082 bp, Zea mays
  misc_feature: Ceres CLONE 1579949
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (11)..(11): n is a, c, t, g, unknown, or other
  misc_feature (23)..(23): n is a, c, t, g, unknown, or other
  misc_feature (747)..(747): n is a, c, t, g, unknown, or other
  misc_feature (1082)..(1082): n is a, c, t, g, unknown, or other
nnnnaatattntttgtgtgtccntatgaattttgataccccaccctgttttttcttatcgggcgcgttcttactacaaacaagctggaactcaccgcggtggcggccgctctagaactagtggatcccccgggctgcaggaattcgtctcacccctagaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgactactcttgcgtcggtgtgtggcagcacaaccggtcgagatctccccacgacagggtaaccgcacacaccctctaagtcgccttaccgaatccgagggctcattagaaagccgccaaaaaccgggtccccctgaaacccctataaacccgttttttgatgccaaacggtctccttgggccggggagggttaaggaaccccccctggccccaaaagagaaaataaaaagctggggggcccctttaaaggggctttctccccgggggcccccggggggaaaaaaccccccccgtggtatggttgtgtttcccccccccacaaaggggggggaggaggggaaagaaaacaagcttttttttttcgcccacccccccaacaaaaaaaaaatatactctccccccccccccacgcgaggggaggtctncttccaccacaccaaaaaaaaatagttggcggtagagataaaaacacccctattaaaaaaacactttttcctctcttgtggggcgcgccaccccgcactctcttataaaaaagaacgtgtgtgtgtgtgttgttaaaggaggggccccccccgcccgcgctcttttttttcggcgcaacacgctcccccacagaaggagggggggccccccaccaaaagagaaaaatccggggggggggagaatatatctccgccccccccccacaaagggtcgtggcgtctctcctctatatatatgcaccccacccacccctcgcgctatgttaatatcacan

SEQ ID NO: 91546 - DNA, 1023 bp, Zea mays
  misc_feature: Ceres CLONE 1579950
  misc_feature: Encodes the peptide sequence at SEQ ID NO. 91547
  misc_feature (262)..(262): n is a, c, t, g, unknown, or other
  misc_feature (279)..(279): n is a, c, t, g, unknown, or other
ctggagctccccgcggtggcggccgctctagaactagtggatcccccgggctgcaggaattcgtctcacccctagaaaaaatgcatcccgattactatctgccgagccgaccagcggcaccagaacccacaaggttcactcatggcgcccacgtccatgctcccgttcgcgccctccaatacgtcgctgccctattcctcccgcgccacaactgccgccgcgttcgctcctcgtgggctccaccacgccgcggccggaaggnagcggcggcggacaacngctcgcgtgcgctgcgcctcggcgccaacgcggaaggggtcttgtggtcagggtgtccgacgactactaccctactctgggatgtgccgcgagaacgccggtaaacaatacatctatgtccaccccccttaaaactcccgacggcataatcatcaggaatgttaaaaaaggaccctgtgaccgaactggaaaatttaaaaggagataagttcaaacataatgtacgcgcccgtccggtataaaaaacaaaaaggaccgtttgttaacaaacacaaaggtgggagaagaaaaaagaagtttttggcagcccccaaaaaaagaatcgccccccgcagggggattttttaaatcaaaagacaaaacctcgaataaagaaacgcaggaaatacgataaaacactctgtgtttacgaccactcacaccaaaagaagagtgggggttttttatcagcgggaatagccgtgccaagaaactctcattttttaaatagatacaaagatgtgctaggagaacaacacaaaggcgtaatgccttgggggcggaaaatataaatctgggcaaatcaataaagagggactagcgtatggacgtactctagagaaaccagacaccagatattttgtgtatttttgccaccataatgtttctttggtgaccccaaatgtattacgcacgagttttttggctaaaaaaaagactggggacgcgcccactattaaaccatgtgtaagtattggagaccaa

SEQ ID NO: 91547 - protein, 89 aa, Zea mays
  misc_feature: Ceres CLONE 1579950
  misc_feature (41)..(41): Xaa is any aa, unknown, or other
MAPTSMLPFAPSNTSLPYSSRATTAAAFAPRGLHHAAAGRXRRRTTARVRCASAPTRKGSCGQGVRRLLPYSGMCRENAGKQYIYVHPP

SEQ ID NO: 91548 - DNA, 1236 bp, Zea mays
  misc_feature: Ceres CLONE 1579951
  misc_feature: Encodes the peptide sequence at SEQ ID NO. 91549
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (1095)..(1095): n is a, c, t, g, unknown, or other
  misc_feature (1236)..(1236): n is a, c, t, g, unknown, or other
tgtggtggggcattggcgaacgagaggaaaactaaaaactaacatctctcttcnnnccaagagtgtattttaaaactggactccccgcggtggcggccgctctagaatagtggatcccccgggctgcaggaattcgtctcacccctagaaagctacgtacggctctatacctctcgccctctgagtctcgcgcggtcagtcggtctctctcactctctcttgtctccaagtttgtaaccctagccgccaagcttgaagctccagccgtgctcgtgtagggccgcaggccatccgggctccggcttccagcatctaccaggcgtccttagaatacggtgcagcgagcagcaagtcgccgagcagccgagccaccgccgaacacagggcgccgccgagcagccgagccgccgccgagcgccgagtcttctctgagtgacttcggtacagacgacaaaatttctccacacattaacgcccccctccgccaactcactgtgcctgaccgaatggggggggtgcttcccccgtcccactttcccgggaagcgttcttcttccacgaacctctacttctttaacccctttcgggggccggggtacttccctttaccttttcgggggaatcccacaccttctccctcaacggtcccacaaattgaagagccccccgagagggggtggttctcggatcacgttcttcgccttcggggggaacaccaatatgtcgccgacccccggtggaaaaaataccccctctccccccaaaataaaataaactgcctcgaacaacaaaaggggtgaaggcctccccccgccaacttatttgggggagagtgggtccctccccagggagggagagatatttgcctcctcgggggggaaacccccctggggagagaacaaatataaagtggggcccacgctgggtgccctccccaaacacaaagggggtgctccacccacaaagagcagaggaggctctcttctgtttaccccccggcgaaggtgggagagaagagaaaaataatattcgggtgagccgcccctcaatacaaaaaatgccgtttattatggtgtgggtgggggggagtacccncctcaatattttgtagacgggcacatccccacgtagttttaactaaaaacacacccctcggtcaatccttcttaaagagaaagggaacaaaatatgtggcgtgcaaaaacaccccgccggcggtgggtgtcctcccccttn

SEQ ID NO: 91549 - protein, 97 aa, Zea mays
  misc_feature: Ceres CLONE 1579951
MGGVLPPSHFPGKRSSSTNLYFFNPFRGPGYFPLPFRGNPTPSPSTVPQIEEPPERGWFSDHVLRLRGEHQYVADPRWKKYPLSPQNKINCLEQQKG

SEQ ID NO: 91550 - DNA, 1020 bp, Zea mays
  misc_feature: Ceres CLONE 1579952
  misc_feature: Encodes the peptide sequence at SEQ ID NO. 91551
  misc_feature (407)..(407): n is a, c, t, g, unknown, or other
  misc_feature (424)..(424): n is a, c, t, g, unknown, or other
ctccccgcggtggcggccgctctagaactagtggatcccccgggctgcaggaattcgtctcacccctagaaaaaaccacaccagccaatgggtgaacctaaacccccacgccccactcagtccagccgaccagccaccctcaccatgcctcgccgcgcaggagccgcctggccatgcttcctcctgctccacattatcgcccacctacacctcgccgtcaacgccgccgacgccgacgctctgctcaccttcaagtcctccctcgaccgctccgaccgcctcccgtggcgccccgacacggcgcccgctttctgcgcctcctggcccggcgtgcgccagtgcgcccccgccggccgcgtcaccaagctcgtcctcgagggcctcaacctgactgggctcctcatcgncgcgctcctcgccccgntgggcgagctgcgggtcctcagcctcaagtccaacgccctcacaggcccattcccgtaggccctcccgcgcgcggctcccaattctcaagctgctgtacctcggccgaaaaccggcttcaggtgccgggtcccccgccacccctggccttgtttccccggggccaaccgttatttggcccctccggggaaaccaaatcccgggggcaaaaatcgggcccttcctttgggggccgggaaagagggggaaaacccgggggtcccggaaacgaaaaatggtctccagggggccggggcccccccggggggcaaccaccaccccgggggggcaaataatttcgggaaacacccgtgtgggggaaaaaacccccccctccccccccagtgtttaaaaccctttttttccccccaaaaggggggccgggggggccccccaaaaaccctctttttttttgggggggaaaaaccccccctctccaagggaggagaggtgttttctcccccccccccccccagacagaagagcggagtaaaacccccccccggaccacaaccggggggggggggggggggccccaaacaagggggggccctccct

SEQ ID NO: 91551 - protein, 112 aa, Zea mays
  misc_feature: Ceres CLONE 1579952
  misc_feature (88)..(88): Xaa is any aa, unknown, or other
  misc_feature (94)..(94): Xaa is any aa, unknown, or other
MPRRAGAAWPCFLLLHIIAHLHLAVNAADADALLTFKSSLDRSDRLPWRPDTAPAFCASWPGVRQCAPAGRVTKLVLEGLNLTGLLIXALLAPXGELRVLSLKSNALTGPFP

SEQ ID NO: 91552 - DNA, 1187 bp, Zea mays
  misc_feature: Ceres CLONE 1579953
  misc_feature: Encodes the peptide sequence at SEQ ID NO. 91553
  misc_feature (969)..(969): n is a, c, t, g, unknown, or other
  misc_feature (1043)..(1043): n is a, c, t, g, unknown, or other
tgtggggtgccgggggggggtccttggacgtgtcggtccggacgaagtaataggcgcgtgcccttttcttaggaggaggaaaagtggaactcaccgcggtggcggccgctctagaactagtggatcccccgggctgcaggaattcgtctcacccctagaaaaaaaaaaaaaacacgcgcctgcacgatctcctcctgcgagcgagatctcaccaccgcagcggcgccgtggccatggcgggaaggtactaccagggccagggcggtggcgggggcacgtccatggaggtagtcagcacgccgaaccaggagctggccctcaccaactgtgcatacgtctgccccgcggacctccgtcgcttccccaacgcgctcgccgtcgtcgccgactcctgggtcttcaccctacgtgaacacaatgctgtcgcaagcgggcgcattgccttgaatgctattcaacgtcgtcaggcaaaggtttcagctgggggattcctgttactgttagcagtttttgtcccccccctaatgattttcaagttgggcttttgctcacctttgggaagctaggagtaatgcccaaaggcaaagaagcccaaaccgaaaaaggaacccaagctttgggaatggctggtttggtggcctttgggccccacaaaaaaccctcccccgtaaaagaaagagggttttttccgggggaaaatccacagggggtccactgtgaacacccccttttgggggggggggcccaaaaaaagggggggtggggccccccatttgtgttgtggaaagaatattttttccgcgatggggagagagagacacaaagaacagctaaaagtgggaggaaattttccacaccaccggtttaccaaaacacctacagagaactctttttgtggcgcctaacagaaaggggggcgttcacaaaagaaaaaaacagagttctctctataccccacccaccgttatngggggtaataagaaagggggattttttcttttggtggccgcagagggggggaggctcgccctctccacctctgngaaaattttggacgaggggcgtgggtgcgcctcgaaaatatttggtggagaaatatagggggcgtgtctctcccccccaacaaggggaagaggtgtggttttttggccgcgaaaaacttgtttttaaaacaagataaaagaggg

SEQ ID NO: 91553 - protein, 110 aa, Zea mays
  misc_feature: Ceres CLONE 1579953
  misc_feature: SWISSPROT Homolog: EC 3.6.4.6 Vesicle-fusing ATPase
MAGRYYQGQGGGGGTSMEVVSTPNQELALTNCAYVCPADLRRFPNALAVVADSWVFTLREHNAVASGRIALNAIQRRQAKVSAGGFLLLLAVFVPPLMIFKLGFCSPLGS

SEQ ID NO: 91554 - DNA, 1233 bp, Zea mays
  misc_feature: Ceres CLONE 1579956
  misc_feature: Translation starting site: 221
  misc_feature: SWISSPROT Homolog: EC 1.4.1.2 Glutamate dehydrogenase
  misc_feature (58)..(58): n is a, c, t, g, unknown, or other
  misc_feature (60)..(60): n is a, c, t, g, unknown, or other
  misc_feature (1145)..(1145): n is a, c, t, g, unknown, or other
gctgtggctttctttttcttctgcttgtctccctcttcttgcgcgctccctttatttncntttgtaattattggagctccccgcggtggcggccgctctagaacagtggatcccccgggctgcaggaattcgtctcacccctagaaaaaagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgcccacgaccagggtaaccgcaccacgccctcgtacgtcgccttcaccgactccgagcgccttctcggagatgcggtcaagaaccaggtcgccttgaaccccttcaacaccgtctttgatgcccaagtgtcccattcggaggatggtcactcaatgcttcttgtccagaatgaatatcaagttggtggggccctcctaggccatttttgggggcctgttggggacaccctctggaattttttgtccctccccaatgggtaaggagaaaattttttttttaaccttgaaaaacaatctcacccctaggggtctttatcctaaatagccccgtaagaatctgtgaaaagcttaacctgaggggcgggccccaactctaaaaaaggtcctgtcggcacttaatttcccccgcaccctccgtccttcattgatccctccgagtgcggtggcggccccaccacaaaatttctcgtttgggttggagaatttacacacgctttttttaggctggcgtcgcgcgtttctctctgccctgtagattgtccaaacacggttagtgccgtctattcccctcactttcggttgtgacatcatatagagagcggcaatcccactcgtaatcgggaaaaacataaaacaactctccccaatcttctgcttatttgtggagaggtggttgccacgttttgttttgacccccccctctttctccttgtttataaatttttattttttgccatttatgttacatcatcttcgcagtaactctctctttattgtggcgcttccatgtccgcaaccctagtggtgtttcttttcttctatcccaccntctttggttttaatcgatactcgctttttctccgtgtacccacgattccctactttcgggtacaagtttcccttgttagtcaatacat

SEQ ID NO: 91555 - DNA, 923 bp, Zea mays
  misc_feature: Ceres CLONE 1579959
  misc_feature: Encodes the peptide sequence at SEQ ID NO. 91556
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (78)..(78): n is a, c, t, g, unknown, or other
  misc_feature (79)..(79): n is a, c, t, g, unknown, or other
gttgcttctctttccgttttacacacttgtgtgagtatgtccgtccccccatccaacacctnnntnnanngatgacanntccaaactgggactccccgcggtggcggccgctctagaactagtggatcccccgggctgcaggaattcgtctcacccctagaaaaaatccacaccgccaccaccgcctacctccaccaccagtccatctcctccgcagcgtctaaagccctatccggatatccccactcgccgacgcccggacatatggccagcttcggcgtcgacacccgcccggccgccgcggcctccggcggcggcgtgggcgtggcggggacgagggagggcgcgctctcgttcctctcccgcgggctgcgggaggacctccgtctcatccgcgcgcgggccggggagctcgagaccttcctcagcgcgccggtgccggaacccgagctgttcgcgcgcctccgtcgcgcctactcctgctcggcgtcctcttcgcggacgcggctcgacctgtccgccatcgggaaggcgttcgaggccgacgcgtggaggggcgccaggactgccaggtggaggtgggaggcggagacggaggcggaggagtgggagccagtcaggatggtcaaggcgcacctcagggagctcgagcggaggaggctggcccagtcgcccagcgacatgctgcacaagctcaagctcagcttgaaatcactgacctttgcgccctgaagcgtctggaggatgttcttgccactgggatttagggggaactttcttgcttaattttggtaaagcaaatctggtaccacctattcgaacccaactttgggtataaaaaagaaaatagtaatgtgaaccaagtttgggggggggagtcttcttgttgccaggcaaggccccaaagggaacccaccccccga

SEQ ID NO: 91556 - protein, 155 aa, Zea mays
  misc_feature: Ceres CLONE 1579959
MASFGVDTRPAAAASGGGVGVAGTREGALSFLSRGLREDLRLIRARAGELETFLSAPVPEPELFARLRRAYSCSASSSRTRLDLSAIGKAFEADAWRGARTARWRWEAETEAEEWEPVRMVKAHLRELERRRLAQSPSDMLHKLKLSLKSLTFAP

SEQ ID NO: 91557 - DNA, 991 bp, Zea mays
  misc_feature: Ceres CLONE 1579960
  misc_feature: Encodes the peptide sequence at SEQ ID NO. 91558
  misc_feature (880)..(880): n is a, c, t, g, unknown, or other
gctctgaactagtggatcccccgggctgcaggaattcgtctcacccctagaaaaaacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactggttcccctctgacttcaccttcggtgccgccacttcagcgcaccaaattgaaggtgcttggaatgaagatggaaagggggaaagcaactgggatcacttctgccacaatcatccggaaaggatactggacgggagcaattcagacattggagcgaattcgtaccatatgtacaaaacggacgtcagattgctcaaggaaatggggcatggacgcatatagggttctctatctcttggcccaaaatactgccgaagggaaaccaaagaaggaggttttaacccggaatgggcatcaagtactatcagaaaccctcatcaacgtggtggcggggaaaacggcattaaagcccatatgtaacaattttttccactggggatgcacctcaaagcccctttaaagaaattacggccgccttcctcgaaaagaagcctaaagaaccttgttgaaaaaaataccccttactccgctaagggggggcttttgcaaacctccgcggacaaggcgaaaaatggttgaccctctaagacaccccagaaattntcttctcctaagctaaggaaacgaggttctgtgactcacggggtggtgctcccctggatctaactgtgcgccacccacgaggaaattcccccgcgaaacgctatatggtag

SEQ ID NO: 91558 - protein, 149 aa, Zea mays
  misc_feature: Ceres CLONE 1579960
  misc_feature: SWISSPROT Homolog: EC 3.2.1.21 Beta-glucosidase
MAPLLAAAMNHAAAHPGLRSHLVGPNNESFSRHHLPSSSPQSSKRRCNLSFTTRSARVGSQNGVQMLSPSEIPQRDWFPSDFTFGAATSAHQIEGAWNEDGKGESNWDHFCHNHPERILDGSNSDIGANSYHMYKTDVRLLKEMGHGRI

SEQ ID NO: 91559 - DNA, 873 bp, Zea mays
  misc_feature: Ceres CLONE 1579961
  misc_feature: Encodes the peptide sequence at SEQ ID NO. 91560
  misc_feature (16)..(16): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (73)..(73): n is a, c, t, g, unknown, or other
  misc_feature (81)..(81): n is a, c, t, g, unknown, or other
tgttatttggtggggngatcaaacttttttattggccaatacgatcgtggatcgttaattttttgngtnnngngggagggntggtcaaagctggagctcccctcggtggcggccgctctagaatagtggatcccccgggctgcaggaattcgtctcacccctagaaaaaagcaacttacgaactccgcaccgcttcgcatcccgctaggggaagagctctttccatcagctgtgccgtgcacaacacaaggcacactgaggttggctagcctcgtcccccgccaagaaacacgctgccgtgagccggctgagcgagcgggaagcaccaacacgccggcgacatggccagcgacagcgcgttctccagggacgagaacatcaagcacgtcaagctgaggtaccaatacctaggaagacaattcctataacttctgctggtgcctgtgatagacgccacggcgctggatatggaccaggtccacatcatccgctaggagttcctgatggtcttcgtcatgagcgggttagtcatgtcccgggccacggctgagtacctggtggtatacacctgctacaagcaccccggcagctgcctcgtgcctttctgcaccttcatgtagcagacacgcctcatcagcgacgacgacaagagggtgcgcttccagtacaggatcctggaccactggtgggctccgcgatggacacatgcctccaaggggggcaaacacataaatgccggccctaaccccatcttggtagcccctccgtgggaccaaggccgcaaatttacccaatcttcttcaagccattaaaccaatcttccttgcgggcggaaagggaggtcttaaagacccaagggacaatgggaacttc

SEQ ID NO: 91560 - protein, 38 aa, Zea mays
  misc_feature: Ceres CLONE 1579961
MVFVMSGLVMSRATAEYLVVYTCYKHPGSCLVPFCTFM

SEQ ID NO: 91561 - DNA, 953 bp, Zea mays
  misc_feature: Ceres CLONE 1579974
  misc_feature: Encodes the peptide sequence at SEQ ID NO. 91562
  misc_feature (678)..(678): n is a, c, t, g, unknown, or other
cggccgctctagaactagtggatcccccgggctgcaggaattcgtctcacccctagaaaaaattgctctcccctaagcaaagcactcactagcaatgggcgagataggcacggaccaccgtggcctagccgaggccgaggccggcgtccgcggcaaggaggagggcatcatcctcggcggccacgaggaggaggaggagacttcgccggtggagcaggtgcggctgacggtgccgtcgacggacgacccgtcgctgccggtgtggacgttccggatgtggagcatctggctgctgtcgtgcgcgctcatgagcttcctcaaccagttcttctcgtaccgaacggagccgctgaatcgtgacgcatatcagggggcaggtggcccccccccccgctgggccacttcatgggcccgcgcgcttgccgcgcgcccatgtttccggggcgcccgccactccttggaccgtcggggatatagaaacccttttaccccgggggcccctttcaaccttccaagggaagcaacgtggactcattcttcccatcctttctgccaaaagcccccggggctttcaccggttttagggaaaaacggggcaggtcggcccctaacctccgcggttcggccagtgttattcctaaaaattgtggtcccgggcgggcctttttattaaccagnccagtcccacatgttcttccgttttctttgtaactcggaccctggtgacccccccgtcggtgcatttaaaccacacccccaacagttgtccctgcggcgtgtttcgggggtggggggcaaggaggacaccccccttcacccaacattctatctttgttgtggggatcctgcgtcccgggtatccttttgtgtggggcgggagggccgcgccaccgccgcccccttcaccttggcgaggtgcgctgtctccgcctccgcgcgagtcttattcacaa

SEQ ID NO: 91562 - protein, 192 aa, Zea mays
  misc_feature: Ceres CLONE 1579974
MGEIGTDHRGLAEAEAGVRGKEEGIILGGHEEEEETSPVEQVRLTVPSTDDPSLPVWTFRMWSIWLLSCALMSFLNQFFSYRTEPLNRDAYQGAGGPPPRWATSWARALAARPCFRGARHSLDRRGYRNPFTPGAPFNLPREATWTHSSHPFCQKPPGLSPVLGKNGAGRPLTSAVRPVLFLKIVVPGGPFY

SEQ ID NO: 91563 - DNA, 882 bp, Zea mays
  misc_feature: Ceres CLONE 1579981
  misc_feature: Encodes the peptide sequence at SEQ ID NO. 91564
  misc_feature (810)..(810): n is a, c, t, g, unknown, or other
ctccccgcggtggcggccgctctagaactagtggatcccccgggctgcaggaattcgtctcacccctagaaaaactacacaagtacacaacccgcccattgcattgcatcttcctcctctcccttgctcttccacttcgttgcgcccatccgtctctcgtctcgtgctcccatcgtcgacccatcacacatccacacacaagctaccctacgacgtatacagagaggaaaaagactagtggtacggccgtcgctagctcgactagtgatccgatccatcgatggaggcagcagacgcatcgtcagcgccgccgcctgcggaaggccgggtggtgtgggtgaacgggcccatcgtggtgggcgcggggccggggggcctgtcggtggcggcgtgcctgcgggcgcgcggtgttccgtgcgtggtgctcgaccgcgccgactgcatcgcgtcgctctggcagcgccgcacctacgaccgcctccgcctgcacctgccgcgccagttctgcgagctccccgggatgcccttccccgaccactacccggagtaccccaccaagcgccagttcgtcgactacctccaggcctacgccgagcgcgcgggcgtccagccgcgcttcaaccaggccgtcacgtccgcgcgctacgaccgggccgcggggctctggcgcgtgcgcgccgccgacgctctcgccgacgacgacgtcgccagcgccgcctccaccgagtacatcggccgctggctcgtcgtcgccacgggcgagaacgccgagcgcatcgtgcccgagttcgacggcgcccagaacttcgncggccccgtctcccacgtctccgaagtacagtgcggcgaagcgtaccgcggcaagcgcgtgctcgtcgtcgg

SEQ ID NO: 91564 - protein, 200 aa, Zea mays
  misc_feature: Ceres CLONE 1579981
  misc_feature: SWISSPROT Homolog: EC 1.14.13.8 Flavin-containing monooxygenase
  misc_feature (177)..(177): Xaa is any aa, unknown, or other
MEAADASSAPPPAEGRVVWVNGPIVVGAGPGGLSVAACLRARGVPCVVLDRADCIASLWQRRTYDRLRLHLPRQFCELPGMPFPDHYPEYPTKRQFVDYLQAYAERAGVQPRFNQAVTSARYDRAAGLWRVRAADALADDDVASAASTEYIGRWLVVATGENAERIVPEFDGAQNFXGPVSHVSEVQCGEAYRGKRVLVV

SEQ ID NO: 91565 - DNA, 866 bp, Zea mays
  misc_feature: Ceres CLONE 1579983
  misc_feature: Translation starting site: 163
  misc_feature: SWISSPROT Homolog: EC 1.4.1.2 Glutamate dehydrogenase
ctggagctccccgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggggttctatcagatgcgtgagattgctgaagcttaccttggtagcacgatcaagaatgctgtggtcacagtccctgcctactttcatgactcacagaggcaggcccacaaaggatgctgggggtgattgcttgcccttaatggggctggggaattatcaaaggagccaacaagttgcagcttttcgccctatgggctttgaacaaaaaggcttaccaattttcccgggaaaaaaaaaatccccctccctttttaacttgggggggggggggccccccttaaggggcccccccccccccccccccccggagggaaagagggaatttt

SEQ ID NO: 91566 - DNA, 971 bp, Zea mays
  misc_feature: Ceres CLONE 1579984
  misc_feature: Encodes the peptide sequence at SEQ ID NO. 91567
  misc_feature (677)..(677): n is a, c, t, g, unknown, or other
ctggagctccccgcggtggcggccgctctagaactagtggatcccccgggctgcaggaattcgtctcacccctagaaaaaataatggcataaatccaattttctctacaggaaacacggcatcctcgctgacgccggagaagccgaagctacaagttcgcccgtcggagccgcagcacaggcgcttgcaaacgcgatggggagcgcggacctggtgctcaagatggcttgcgagggctgcggcaacacgtcggatctctacggcacggggtgcaagcacaccactctctgcagtgactgcgggaagtccatggcacgctcccgtgcccgctgcctcgtctgctccgcgcccatcaccaggctcatccgggaatataatgtacgagctaattctgttatggataagacatactctattggacgatttgtcactggtttacctcctttctcgaaaaagaagaatgccgagaacaagtggtctctccataaggagggtctgcaaggccgtcagatagccgagaatatgcgggaaaaatacaacaagaaaccatggattttggaagacgaaacaggccaatatcagtatcaaggtcaaatggaaggatcacagtcagctacagctacatattatttgttaatgaggcacggcaaggaatttaatgcatatcctgctggctnctggtttaatttcagtaaaattgcacagtacaaacaattgacactggaggaggctgaagaaaagatgaattaagaggagaccagtgcaactggttatgaacgctggatgatgaaagcagcggcaaatggaccagctggctttggttcagacatgaagaagcttgaggcacaaatggtggggaaaaaagaaatgctcgtcctaagaaggaaaaattatgaagaggttataaatccgattagggtgggaggagatgaagaagaggaagcacccgcagattgacttggactacttaa

SEQ ID NO: 91567 - protein, 184 aa, Zea mays
  misc_feature: Ceres CLONE 1579984
  misc_feature: SWISSPROT Homolog: EC 2.7.11.1 Non-specific serine/threonine protein kinase
  misc_feature (161)..(161): Xaa is any aa, unknown, or other
MGSADLVLKMACEGCGNTSDLYGTGCKHTTLCSDCGKSMARSRARCLVCSAPITRLIREYNVRANSVMDKTYSIGRFVTGLPPFSKKKNAENKWSLHKEGLQGRQIAENMREKYNKKPWILEDETGQYQYQGQMEGSQSATATYYLLMRHGKEFNAYPAGXWFNFSKIAQYKQLTLEEAEEKMN

SEQ ID NO: 91568 - DNA, 1254 bp, Zea mays
  misc_feature: Ceres CLONE 1579986
  misc_feature (65)..(65): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (876)..(876): n is a, c, t, g, unknown, or other
  misc_feature (897)..(897): n is a, c, t, g, unknown, or other
  misc_feature (1254)..(1254): n is a, c, t, g, unknown, or other
gagtgggtgggctgaggattagtagtacggggcgttaattatttcgtgccttaacatggcgcctncctntnnnnntntaaaaactggagctccccgcggtggcggccgctctagaactagtggatcccccgggctgcaggaattcgtctcacccctagaaaaactcttcacttctaactccggtgggacactcgcttggaccgccgactctcttcgcctccgctactgctgctccccaccccaatcccccgaatgaacgggaggggcggcctccaggtcgcacccaacatccgcgagccacggccgcccccccggaggcaaaagaaagatgctcgggcgttcgcctaacaagagggacaacccccactactacgagatctctcggggtgcccaagtcgagcgtcccaggaggagtctcaagaaggcctaccgctaggctgcaatccagaaccaccccgcacaagggcggcgatgcctagaagtacaaagaggtcgcacaggcctaagagggttttgagtgatccatagggaacgccaccatttattgatccaggcatcctgaaggatcgccccttaaggggaaggaattggcgccggtggggaggggatacccattggcaggaatccccgtttgaaatcaaacaaatcctcccagccatctttatgtttggggaacctcctcttcaaatctagggaaaacgaagtggtattttttccttataatggccagctcccccgtgtggctcaatgttaaaaccgaccccaaaatgaaaaaaggtgtgggtaatgcaaaacagcattttgtgtagagttttgtttccacgcacgccacaccctctccaaaagagagagttttcttctccctcgggcgaccgnagggaaaggataaaaatgttntgtaagacaaaatgctgtggagcacaccctttttttatatattttagaagagcgctttccattttcgagcctagttgtgtgccgcgctatgaaataagcaacaaatgggtgtgggcgttcacccgaaggtggagaaacaaggggctctccagatgcggatcctttccgtgaaaagatattttgggagaggacgcctccaccatttgtggggggggacccccggtgtgtgttactcacaagaaggctcagtgcggcgggaaacaaaaaaactcctccctataatttattccccacctagtgtgggtccccattttaacagatacaagtccatagaaacactgcccctccccccccccn

SEQ ID NO: 91569 - DNA, 964 bp, Zea mays
  misc_feature: Ceres CLONE 1579988
  misc_feature: Encodes the peptide sequence at SEQ ID NO. 91570
  misc_feature (537)..(537): n is a, c, t, g, unknown, or other
  misc_feature (706)..(706): n is a, c, t, g, unknown, or other
ggagctccccgcggtggcggccgctctagaactagtggatcccccgggctgcaggaattcgtctcacccctagaaaaaaaagctattgcttacgtgctgcttcatctttatcctcgtctctgttcgtcatctccatctcccttaccgatccgatcgtcaagcaagctaagccaccctgacatggcatcttcacccccctcctccgcctcgctacggcagaggccagccgccgcggcggcgacgcccgatcagcagcacgagccaccacgtctcgaagacggcctcctcccgaaccaaggcggatccccggcgacatcggcgctgtcccaggcgctgtcctccacggcaaacctggccaacctgctcccgaccggcacgctgctggccttcaacctgctggcgccgacgttcacgaaacacggcgcgtgcgacgccaccacgtcgctcctcatgcggggtcctcctggagtctccctcgccctgccagcgcgctggcccggcttcacgcactccctcaagtccccgcacggagggccncgttctactagggcgtcgccacccgcaagggccctctggcctcatcgactacccgccggggcgcgccgtccgctgcccctagggtggccaacggggcgctacacggctcgcgtttcatcgacttcgtggcacgccgcgtctgtccgcccgccgtcttcgggggcgtcgnccgccagggacaggggacgtcgtcgtctgcctgtaacggcccacgccgggaagggccacgcaagacctgctcgacgttctgccgctcggcgttggggtgctcctgcaactcctcttcgtcgccttcccaacaccaggtacggcatcggatacccgtcgtcccaaatgcctcccgcaagcacggcaatttctccaaaaaaagttaattaatttatttcttcaggcttaagcctaaagaactgcgtcgtagtacaatcat

SEQ ID NO: 91570 - protein, 244 aa, Zea mays
  misc_feature: Ceres CLONE 1579988
  misc_feature (50)..(226): Pfam Name: DUF679 Pfam Description: Protein of unknown function (DUF679)
  misc_feature (176)..(176): Xaa is any aa, unknown, or other
MASSPPSSASLRQRPAAAAATPDQQHEPPRLEDGLLPNQGGSPATSALSQALSSTANLANLLPTGTLLAFNLLAPTFTKHGACDATTSLLMRGPPGVSLALPARWPGFTHSLKSPHGGPRSTRASPPARALWPHRLPAGARRPLPLGWPTGRYTARVSSTSWHAASVRPPSSGASXARDRGRRRLPVTAHAGKGHARPARRSAARRWGAPATPLRRLPNTRYGIGYPSSQMPPASTAISPKKVN

SEQ ID NO: 91571 - DNA, 964 bp, Zea mays
  misc_feature: Ceres CLONE 1579994
  misc_feature: Encodes the peptide sequence at SEQ ID NO. 91572
ctggagctccccgcggtggcggccgctctagaactagtggatcccccgggctgcaggaattcgtctcacccctagaaaaaattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaacgcctggccatcaacgactgcctggagctgctgtccaccacgatggacgagctccgcgccagcaccgccgacctggcgtcccccgccggcagggggtcagcgtcagcgggcgtgtcgcagggcgccaggcgcgcgaccaatggagcacgtgatgacggtgctttcggcggccatcaccaccagtacaccctgcctcgacaggctcgcgtaacatagaggggggcgcctgcagggctacatcgagcccgatctttcaaccactgtccccggtatggtgagacaaccccctagtcattggcccaaaaagcttgaccggaggccggggccccttagtgggggtccaatgtcgcgccgcgggcagtcggttccacggggttcacgggcacacatgtgtgaaaagggtttccccccagaaagggagacgctccccgggg

SEQ ID NO: 91572 - protein, 174 aa, Zea mays
  misc_feature: Ceres CLONE 1579994
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLSARERLAINDCLELLSTTMDELRASTADLASPAGRGSASAGVSQGARRATNGARDDGAFGGHHHQYTLPRQARVT

SEQ ID NO: 91573 - DNA, 820 bp, Zea mays
  misc_feature: Ceres CLONE 1579998
  misc_feature: Encodes the peptide sequence at SEQ ID NO. 91574
  misc_feature (314)..(314): n is a, c, t, g, unknown, or other
ctggagctccccgcggtggcggccgctctagaactagtggatcccccgggctgcaggaattcgtctcacccctagaaaaagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctantctgtggtgtgccagacttcaagatgaggggaaagaagagtgatgagctcgaacctgtcgatgctggcgatgaagatgatgatggtggtgacgatggggacgaggatgggtgactttggggaggaggggtggaagaggacgtctcagaaggggagggatatgacaacccaaagggcaatgagaccaagaagcaaagaggtgatcctgaggaaaatggtgaggaagatgaggaagaaccagaagatcaggatggtggcggcgacgacgatgatgacgacgatgacgatgatgaggacggggatgacagaacagagggatcgtcatccagatccaggcacgtcggccaacccaagcccgtcttctcttctctctctcgtccgtccctcactcggcgcgacgtgtgacaagacacgcgacgcgcgcatacgtcgtccaaagcacgcaggggcaagcaatcaatcgcgtccgtccgcgtccgaggtctggtggtggccgaaatgggctcc

SEQ ID NO: 91574 - protein, 43 aa, Zea mays
  misc_feature: Ceres CLONE 1579998
  misc_feature (30)..(30): Xaa is any aa, unknown, or other
MDTAAPLQLKACAGDAAEKLLLAVAAEGPXLWCARLQDEGKEE

SEQ ID NO: 91575 - DNA, 860 bp, Zea mays
  misc_feature: Ceres CLONE 1580003
  misc_feature: Encodes the peptide sequence at SEQ ID NO. 91576
tccccgcggtggcggccgctctagaactagtggatcccccgggctgcaggaattcgtctcacccctagaaaaactcctcccgccgccgcacttctcccctgaccctaggtcaaagtatcgccgacttcgccagccggatcatgtcgaccagcgccaacccgaaactgaagcggcggcgggggggcttgcggaagcagggtcctgggtaccccacggtggccaccacgggggcaatgtttgcccatgaggtgggcgccgaagggccacggagggacacgaggcaaggacccgcgttgcctagggtggttgccacctcgaccaggggaggaggtgccattgagcagggcgctgacggaatggaaggttcggcgtcgaaaactgataggagcgttcacgaggcagttggcgtcgatggcacgtacctcaccgagacacggtttgatcaatgtgccatttctccactgtcactgaaagccatcaaagatgctggatatgagaggatgactcgggtgcaggaggctactctgccaataattcttcaaagaaaggatgttcttgcaaaagcgaaaacaggaacagggaaaacagttgccttttttgccttccagccattcaagttctctctgcatttccctcgttcaacttcaataaaatttggctggtggatgtgcccctaccaggggagctttgcaaaaccaaatgggcttggcctaagggcccaggaaacccttcctccaagattcattccccctccaacgtgggggggggccagggtttgtaaaaaaagggggggggacacaccgggggttaaccggtccaaagagagcaaaacggggaaacctgtggccaatacctttaac

SEQ ID NO: 91576 - protein, 240 aa, Zea mays
  misc_feature: Ceres CLONE 1580003
MSTSANPKLKRRRGGLRKQGPGYPTVATTGAMFAHEVGAEGPRRDTRQGPALPRVVATSTRGGGAIEQGADGMEGSASKTDRSVHEAVGVDGTYLTETRFDQCAISPLSLKAIKDAGYERMTRVQEATLPIILQRKDVLAKAKTGTGKTVAFFAFQPFKFSLHFPRSTSIKFGWWMCPYQGSFAKPNGLGLRAQETLPPRFIPPPTWGGARVCKKRGGDTPGVNRSKESKTGKPVANTFN

SEQ ID NO: 91577 - DNA, 834 bp, Zea mays
  misc_feature: Ceres CLONE 1580004
  misc_feature: Encodes the peptide sequence at SEQ ID NO. 91578
aaagctggagctcaccgcggtggcggccgctctagaactagtggatcccccgggctgcaggaattcgtctcacccctagaaaaaaaaaaaaaaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaacaaggcagggcgctccgtaagcttgaagatggatgtatccagagcctacttcgtggcttacgtagcagggcagcgctcgtgcctcctcaagagatcaggccgcacgttctcgtcggcgatctgttactacggtggcccgtgggggaacaagttcgggctcctgtcgtcacgcgaccgcggtccactcgcaagggcagtgaccgtgctgctgcccgcgacggcgacagcgaggatcctggggtccccggcctggccagcgagagatctcgacaaggccatctcggtcgctggttcctgttcccaactgggcaacgctaccgaaaaac

SEQ ID NO: 91578 - protein, 214 aa, Zea mays
  misc_feature: Ceres CLONE 1580004
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVNKAGRSVSLKMDVSRAYFVAYVAGQRSCLLKRSGRTFSSAICYYGGPWGNKFGLLSSRDRGPLARAVTVLLPATATARILGSPAWPARDLDKAISVAGSCSQLGNATEK

SEQ ID NO: 91579 - DNA, 923 bp, Zea mays
  misc_feature: Ceres CLONE 1580005
  misc_feature: Encodes the peptide sequence at SEQ ID NO. 91580
ctccccgcggtggcggccgctctagaactagtggatcccccgggctgcaggaattcgtctcacccctagaaaaagtctcttctggaaccgtccctcgctcgtcatctttccgccttcactacgcaattcctgtccacgctgcgggccatttgtgactaccgcgtatctcgtcagagaaagaagatgaggccggcacgcgggcggcgatctgagatggcgccagagaagccccggaaggagcacgatgaggaggaggaggagttgatgctggaggatggacgcatcgaggagagcccgcgccacagcttcgaggactgcggtgattccgaccaggaggacgatgactaccatgaggagcgcgacggccaccgcatcggttcaccgcggctcatccatgcccccaactggccgctgagctgcagggaaacaactgatacttacacaattggatgcattaccgaacttttggatatttggggcccctctaaagggaaaaaactcccccctcaaacttggggcaaaaagggcctggggttttcaaccggaaagtttgcccccccatttttgaaaagggggcgaacagaaaaaaaaaaattcttgggaaaaccccgcgcccaaaaaaccccttgggtttccaaaaaaaaaaaaaaagggggcccccttttccttttgggacaccccggggggaaaaattttctttttgttctagggggggtcatagggggcgcccaaaaagcttttttaaggggggttaatactccccttccggggggggggggctttttttcccccccctgttacccaccccaataaaatcggggggggggggggcccccgctttttataaaatttttaaaaggtttgggggtggtattacgggggttttttatgaaacacgtttttgaaaaaaaaaaatagtttta

SEQ ID NO: 91580 - protein, 199 aa, Zea mays
  misc_feature: Ceres CLONE 1580005
MAPEKPRKEHDEEEEELMLEDGRIEESPRHSFEDCGDSDQEDDDYHEERDGHRIGSPRLIHAPNWPLSCRETTDTYTIGCITELLDIWGPSKGKKLPPQTWGKKGLGFSTGKFAPPFLKRGRTEKKKFLGKPRAQKTPWVSKKKKKGGPLFLLGHPGGKNFLFVLGGVIGGAQKAFLRGVNTPLPGGGGFFSPPCYPPQ

SEQ ID NO: 91581 - DNA, 983 bp, Zea mays
  misc_feature: Ceres CLONE 1580013
  misc_feature: Translation starting site: 160
  misc_feature: SWISSPROT Homolog: EC 1.4.1.2 Glutamate dehydrogenase
  misc_feature (791)..(791): n is a, c, t, g, unknown, or other
ggagctccccgcggtggcggccgctctagaactagtggatcccccgggctgcaggaattcgtctcacccctagaaaaatcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggatgctggggtgattgctggccttaatgtgctgcgtatcatcaacgagccaacagctgcagctatcgcctatggtcttgacaagaaggctaccagtgtcggtgagaagaatgtcctcatctttgatcttgggaggtggtaccnttgatgtctcccctcctcacattgtagaaaggatctttgaggtcaaagccacagctggggaccccatccttgggggtgaggactttgacaacaggatggcaaccccctcccccaggatgtcaggaggaaaacaagaatgattccctggcaaccccggggctctcggaagcttgagaccgcttggtaaaaggg

SEQ ID NO: 91582 - DNA, 935 bp, Zea mays
  misc_feature: Ceres CLONE 1580019
  misc_feature: Encodes the peptide sequence at SEQ ID NO. 91583
  misc_feature (935)..(935): n is a, c, t, g, unknown, or other
tccccgcggtggcggccgctctagaactagtggatcccccgggctgcaggaattcgtctcacccctagaaaaatattctttctcccgttcaccccgcgtgcacgctctttcccttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactatggcctaccgatgatctccttgtcaagtatcagtacatctcagacttcttcatagccctcgcgtacttctctattccgttggagctcatatatttcgtgaagaagtcgtccttcttcccgcacacatgggtcttgatccagtttggtgcgtttatagttctctgtggggcaacccatctgataaacctgtggacgttcaccacacatacaaagaccgttgcgatggtcatgaccatagcaaaggtttctacagcagttgtgtcctgtgcaactgctttgatgcttgttcatatcatccccgacttattgagcgtgaaaactagagaagtgttcctgaaaaaataaagctgaaagagcttgacagaaaaatggggactgattaaggaccccggaagaaaaccggtagacatgtttggatgctttaccctggaatcccaaattccccttgaccggcttttgaattttgaaaaccaccccttttgaacctaggaaagaccttggggcttggagaaatggccctgggggaacgcccccccaaagtggtaaagcccttcattttttctatcttggccccccaaattaccgtgggaactcgggggccaattatacccccgggcaaaaaaaagggtcactgaaacccgggatttttaatacccccactcctn

SEQ ID NO: 91583 - protein, 124 aa, Zea mays
  misc_feature: Ceres CLONE 1580019
  misc_feature: SWISSPROT Homolog: EC 2.7.13.3 Histidine kinase
MDGCDCIEPLWPTDDLLVKYQYISDFFIALAYFSIPLELIYFVKKSSFFPHTWVLIQFGAFIVLCGATHLINLWTFTTHTKTVAMVMTIAKVSTAVVSCATALMLVHIIPDLLSVKTREVFLKK

SEQ ID NO: 91584 - DNA, 940 bp, Zea mays
  misc_feature: Ceres CLONE 1580023
  misc_feature: Encodes the peptide sequence at SEQ ID NO. 91585
  misc_feature (357)..(357): n is a, c, t, g, unknown, or other
  misc_feature (940)..(940): n is a, c, t, g, unknown, or other
acccgcggtggcggccgctctagaactagtggatcccccgggctgcaggaattcgtctcacccctagaaaaagattttgccaatgcgacggtgaaatcccgcacctacctccttcctctctcaccgaggaccctcgcaccaagaactgagcgggaagagaggtagagaggcaagcgcacgagagtttctgctcctagtctcgtctcgccccgcctccgtctcctttccctctctggttctctctctgcgattctcgtcgcattggttccgttccctcacgaaaggcgggagctttctgtcttccctcatctatctagataatggcgaccacgacgtcagcgaccaccgccgcagcancagccgccaccaccgccaagccgcgggggtcgtcctcggccctctgccagagggtggccggcggcagcaggcggcgctccggggtggtgcggggcgaccccgccggcgtggaaggccaagggccaggccgtggcaaaagcgggcagaggtcgccgcccctcgaagcagtttcaagaaatccgccctaccgggtactttgaagggaaaggggttacccttagcttggggaaaaggcccccgggggtaccacccccggcccccccttggtaagattgcccctgaaaaaaaaacctttctttttgtgcacaaaagaaacttggggggccccccgtcgcgtttttctaaggaaactccccccggccctgagaaccactattttaaaagaagggtcgcttgtttctttagacccccccgtgtgaaacaaaaaggagaaatttttgtgttgggggcgccttctactctggaacccgtggtgtttttccgaaaataaatgggaggtggggtttgcaaaaaaaaaaggggggttttccccccccccccgccatcttgggggagccccttgtttcttttttgaaagaatagn

SEQ ID NO: 91585 - protein, 78 aa, Zea mays
  misc_feature: Ceres CLONE 1580023
  misc_feature (13)..(13): Xaa is any aa, unknown, or other
MATTTSATTAAAXAATTAKPRGSSSALCQRVAGGSRRRSGVVRGDPAGVEGQGPGRGKSGQRSPPLEAVSRNPPYRVL

SEQ ID NO: 91586 - DNA, 926 bp, Zea mays
  misc_feature: Ceres CLONE 1580026
  misc_feature: Encodes the peptide sequence at SEQ ID NO. 91587
  misc_feature (850)..(850): n is a, c, t, g, unknown, or other
  misc_feature (893)..(893): n is a, c, t, g, unknown, or other
ggagctccccgcggtggcggccgctctagaactagtggatcccccgggctgcaggaattcgtctcacccctagaaaaacgtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggcgtctacgtgatcaacttcgtcatgtccatgtccacgcagatcttctgcgggcagctcggcaacctggagctcgccgccgcgtcgctcggcaacaccggcatccagtccctcgcctacggcctcatgctggggatgggcagcgcggtggagacgctgtgcgggcaggcgtacggcgcgcacaagcacggcatgctgggggtgtacctgcagcggtcgacggtgctgctgatggccaccgccgtgcctctgaccgtggtgtacgccttctcggcgcgcatcctggtgctcctgggcgagtcggagcgcatctccagggccgccgccgtgttcgtgtacgggctcatcccgcagatcttcgcgtacgcggccaacttcccccatcagaagttcctgcaggcgcagagcatcgtgggcgccagcgccttacatctcgtggccacgctgggggtcanctggggctcagctggctcgccgtctaccggctgggcctgggcntgctgggcggctcgctcggcccagcttcaatgg

SEQ ID NO: 91587 - protein, 248 aa, Zea mays
  misc_feature: Ceres CLONE 1580026
  misc_feature (69)..(229): Pfam Name: MatE Pfam Description: MatE
  misc_feature (223)..(223): Xaa is any aa, unknown, or other
MDSTTTTTAPLLQPAAAASSKEEPAPASPHGAGSWELEAVLADASSPVLRRAWEGARLELPLLLRVALPAVGVYVINFVMSMSTQIFCGQLGNLELAAASLGNTGIQSLAYGLMLGMGSAVETLCGQAYGAHKHGMLGVYLQRSTVLLMATAVPLTVVYAFSARILVLLGESERISRAAAVFVYGLIPQIFAYAANFPHQKFLQAQSIVGASALHLVATLGVXWGSAGSPSTGWAWACWAARSAQLQW

SEQ ID NO: 91588 - DNA, 871 bp, Zea mays
  misc_feature: Ceres CLONE 1580027
  misc_feature: Encodes the peptide sequence at SEQ ID NO. 91589
acccgcggtggcggccgctctagaactagtggatcccccgggctgcaggaattcgtctcacccctagaaaaaaggggcaccatcacatcctcctcctgccccgatccgccagccgcgccgctcgccgcaccccgatgtgggccgccgacccctctgcagctccggccgcggccgtggtcgctgacccagatggccctgatgccgtgcggctcacctggaacacctggccacggtcaaaggtcgaggccagccgctgcgtcgtgccgctcgccgccaccatctcgcccggtcgcgtcccggacccctccgcggcgtccccgccgccgctcccttaccctccgctccgctgcaaggctccctgctccgcgctcctcaaccccttcgcgcgcgtcgacttcgccgccaagatctggatctgcccgttctgcttctcccgcaaccacttccccccgcactactcttgccatctctgagtacaacgtttcctgccgagctcttcccgcagtggctccacccgtcgaagtacatcggtcgggcggaacccgggggtccctgggggtggggcagatttggccccctccgggcccgtatttttttctttcgtccatcaaaacccctgggttcaattaaaggaggaaccttggggttacctccaaaattgggccctgggcgaaaagggccccccggggttttttggccggaaagacgacacccctgggggggctccttttcccctttttgggagcgacagggggcccccctgtaccaaaaaacttggaaattcttcccaagatttccccaagagaatttttccttttttccccggggggaaccaagggagatatctcctcagggggcccaaatattgggg

SEQ ID NO: 91589 - protein, 112 aa, Zea mays
  misc_feature: Ceres CLONE 1580027
  misc_feature (68)..(108): Pfam Name: zf-Sec23_Sec24 Pfam Description: Sec23/Sec24 zinc finger
MWAADPSAAPAAAVVADPDGPDAVRLTWNTWPRSKVEASRCVVPLAATISPGRVPDPSAASPPPLPYPPLRCKAPCSALLNPFARVDFAAKIWICPFCFSRNHFPPHYSCHL

SEQ ID NO: 91590 - DNA, 1331 bp, Zea mays
  misc_feature: Ceres CLONE 1580029
  misc_feature: Encodes the peptide sequence at SEQ ID NO. 91591
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (1050)..(1050): n is a, c, t, g, unknown, or other
  misc_feature (1206)..(1206): n is a, c, t, g, unknown, or other
ggtgggggttgtttttnnnttttatttttctgtggggcaacccaaactccacccggcgcgtggaagtatgaattaggtgggtttcaaagctgtagctccccacggtggcggccgctctagaatagtggatcccccgggctgctggaattcgtctcacccctagaaaaaacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagccgccaaatgcgccggcgagcagccttaccgcctcgcgggcttcctggccgtctgcgccgtggccttcgtcgtgacatgcctcctccactggtgcttcccgggaggcccggcgtgggggaggtggtggtggacacggcggctcagtgccggtgccggtggcggcgcgacggcggtggcccccgccctgccggggccgaggggccctgcccgtgggtccgggagcaggtgggttcatgacggggcccgggcgcaaacgcaaacctccccggcgggccgtcgggggaaaccctccggcgacccaggtcgccctggaaagtgggcctttcctccccctcccgaggggggccaccctaaaggaggtggggtggggtggggtacccctccctcaaacccccgtggatactcaggagttggccgccccggaagaaaatctcccctcccacaaaaccagaagcccccgcagtttccgcttttttccctgccggtgtaatactacgcctgcggttaccacccccaatttccccaaatgggggggaaagaagtgttctccccagacccggcgtttttgaatgggggggggggggccttttcacccctcgcgggatttttttgggccccaaaggagtgcaagggggggatccccctatatttgctgtggggatatttttgttaagagcagcggggaccccccttagtagttgaggaggcggcgggccctcctctttataccgtggggggtgcggncccagagactgatcctgtatgcacataatccccaccggctatggggagatgtcgtcgtcaaaagaatacacacatacccacaaccttttttctttcctaacccctatctggtggggacaggagtgtttccctactccaatcgaattcttaggtagnctcgcttgtctcttgtcctgtcggaacatgttatgcagatctattacaaggcatcatccacaaatagagacaacgtgggccgccgccgttcgcatatgtgtacaccgttatatcctgtgtgttag

SEQ ID NO: 91591 - protein, 179 aa, Zea mays
  misc_feature: Ceres CLONE 1580029
MATPDDRGSWLLYLSLAAKCAGEQPYRLAGFLAVCAVAFVVTCLLHWCFPGGPAWGRWWWTRRLSAGAGGGATAVAPALPGPRGPARGSGSRWVHDGARAQTQTSPAGRRGKPSGDPGRPGKWAFPPPPEGGHPKGGGVGWGTPPSNPRGYSGVGRPGRKSPLPQNQKPPQFPLFSLPV

SEQ ID NO: 91592 - DNA, 1190 bp, Zea mays
  misc_feature: Ceres CLONE 1580034
  misc_feature: Encodes the peptide sequence at SEQ ID NO. 91593
  misc_feature (19)..(19): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
ttttttttccattcccttnctcactttcttcctttacactcttttttggtaattgaatacgagtttcctaaannnancaaaactggagctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtcaagatcgagggctccaccctccgcgtcggccaggtggccgccgtcgcctccgccaaggacgcgtccggcgtcgccgtcgagctcgacgaggaggcccgcccccgcgtcaaggccagcagcgagtggatcctcgactgcatcgcccacggcggcgacatctacggcgtcaccaccgggcttcggggggcaacctcccaccgtccgtcaccaaaggacgggggcccggcggctcccagggtccaagcctggcttcagggcattctacaaccgccccggaaaatctttcggggcaacccggggcaagccgaaacaggggccaaacaccgccttgtgcctcgtttcggggaaagggtttcaacccccggccgggccgggggacgtaaataggcatcgggggatagagcccctcacaattcacaaaaacaaacccctcgttctcctttctcccaaggggggggcctttaaccttccccgcgggggccaatttacccggggctgttttccggaggagaattaactctccccgagggggccccaccttcctaccgagaaaagtccttgggttatccaaaaccaccccgggagtgtgttcaaactcccccccctggcacctgggccccgactctcccggggggggccaccccaattaacctccggcgcgttccggggggggaaactctggggtttcccggaggatttctccatataaaatgtgagtcgggggccctcaattaaagggggggcacggcctctcaaaaagctgccaagggtgcggtctccccgttccgaaatgcggaaggg

SEQ ID NO: 91593 - protein, 170 aa, Zea mays
  misc_feature: Ceres CLONE 1580034
  misc_feature: SWISSPROT Homolog: EC 4.3.1.5 Phenylalanine ammonia-lyase
MAGNGAIVESDPLNWGAAAAELAGSHLDEVKRMVAQARQPVVKIEGSTLRVGQVAAVASAKDASGVAVELDEEARPRVKASSEWILDCIAHGGDIYGVTTGLRGATSHRPSPKDGGPAAPRVQAWLQGILQPPRKIFRGNPGQAETGAKHRLVPRFGERVSTPGRAGGRK

SEQ ID NO: 91594 - DNA, 959 bp, Zea mays
  misc_feature: Ceres CLONE 1580035
  misc_feature: Translation starting site: 203
  misc_feature: SWISSPROT Homolog: EC 2.4.1.67 Galactinol--raffinose galactosyltransferase
ggagctccccgcggtggcggccgctctagaactagtggatcccccgggctgcaggaattcgtctcacccctagaaaaagccggccggaccacccagagccagaagcgcgtcgccagccaactatcgccgctgataaccaacccaatccaacctaacccaaccctgctctctgccgacgcggattcgaatccgaggacgatcgatgacggtgggcgccggcatcgccgtccaggacggcagcctcctggcgctgggcgccaaggtcctgcgggaggtgcgcggcaacgtgctcgtgacgccggccgccggcgggggcctaaccaacggcgcgttcctcggcgtccggtccgcgcccgccgccagccgcagcatcttccccgtcgggaagctccgggaccagcggttcgtgtgcacgttccggttcaagatgtggtggatgacgcagaggatgggctccgcaggccgcgacatcccctccgagacgcagttcctgctggtggaagggtccggcggcggcgagcagcccgtcgtgtacaccgtcttcctccccgtgctggagggctcgttccgtgccgttcttcaagggaacgccgccgacgagctggagatctgcctggagagcggcgacccggacgtggaatctttccaaggctcccatctggtcttcgttggcgccggatcggaccgttcgaggtcatcacaagtcagtcaaagcggtcgagaggacttgcagacgttctctcacggggagaagaaaaagtgccagacattctgaactgggttggctggtgcccgtgggacgccttctacaccaatgtccccgcccagggaggtaaccaaggattgcaaaactgggaaaaaggggggtcctcccctaggttcggtataatcctacgaaggatgggagtcccgtccccttggaacccggtgggaatacgttggccttcaggaaactcagg

SEQ ID NO: 91595 - DNA, 1011 bp, Zea mays
  misc_feature: Ceres CLONE 1580036
  misc_feature (14)..(14): n is a, c, t, g, unknown, or other
  misc_feature (545)..(545): n is a, c, t, g, unknown, or other
tttttttccccccnttctcgagcaaattagccacaataatcgagggtcactgtgtaacttcactataaatcgacaaaaaaaactggagctccccgcggtggcggccgctctagaatagtggatcccccgggctgcaggaattcgtctcacccctagaaaaaacatctattgcatggctccaccctcaatgacgacaagggtgtcgcggctgcaggcaatccctcgctcgtgctctctctcttcacgtctccgtcctcaccctcgtcgccaacaccaccacccacggtcgctacacggccatcctcgatgccggcaagggtgtcgcggtcgcagggcatcggcgtagccaggggccagggcggaggtgggtgcgaggaccggtcctcgctgctgctccgtgagcgaggccaattctcccgcacgctccttcgtagaggaggtcatcaccggctatgacaagaccgatctctacaagacctggcagaaacagccatggccgatagtcctgaagcagaaaggagaaaaacatgcccaaatcctagatnggccttttacgtcttccgcgttttgatatatgtatctgtattttgatattctgtctgaacattatttcaattttgttctaatttttacgtaatattggccaaatgtcccaggccttttaaaaggggcagtttaattttcgcttctagccggacctggaacgaagttttcacaaatttgaaaatgggcattcccaagcaagtaagaaatcaacggaacaggggttggtaagttgggaaaaagtttctttttaataagaaatccgctttcctgttttgttatgaaaattattttgggggaagtgacccaaagtgaataccggaaaggtggtgccacccaccccctaatggtgtttaccaagacaattttgtgttccttggaaaccgaaaaatttttgggggaaacttggccacaggcaaaaattcgaaccgaaatatcccccgcccatgtttctatttcgcccaaggt

SEQ ID NO: 91596 - DNA, 855 bp, Zea mays
  misc_feature: Ceres CLONE 1580041
  misc_feature: Encodes the peptide sequence at SEQ ID NO. 91597
ccccgcggtggcggccgctctagaactagtggatcccccgggctgcaggaattcgtctcacccctagaaaaagcgacgaactcatcactgcactggtggtgcccgtggtgctccacagagtgaagcgatagccaggagaggcgacgatgcgcaagtgggcgctctcctccgcgctcctcctcctctttctcctcaccacactccccgacccagctaagaagctacaagtgaatgccgaggagagcagcgatgacttggctaacccaccgaaggtagaggagaagtttggtgctgtccctcatggcctgtccaccgactctgaggttgcccagagggaagccgagtctatctctaggaagactctcaggagctcagccgagaagtttgagttccaagctgaggtttccagactcatggacatcatcatcaactcactctacagcaacaaggatatcttcctgagggagctcatatctaatgcctctgatgcgttggataagattaggttcctttctcttactgataaggaagttctaggtgaaggggacactgcaaagcttgagattcagattaagttggacaaagagaagaaaatcctctccattcgggatagggggtatggtatgaccaaaggaagatcttattaagaacccttggaacgattgctaaaatctggcactttcagctttttgtgggaaaagatgccagtctgggaggtgaccctcaaatctttattggaacaggtttggggggttgggccttctaactcctggtgtaaccttgggttcgctgaacctattgtttgaaaggggggtccgccaaggccccaattggagtgaattaaacccggtgggt

SEQ ID NO: 91597 - protein, 166 aa, Zea mays
  misc_feature: Ceres CLONE 1580041
MRKWALSSALLLLFLLTTLPDPAKKLQVNAEESSDDLANPPKVEEKFGAVPHGLSTDSEVAQREAESISRKTLRSSAEKFEFQAEVSRLMDIIINSLYSNKDIFLRELISNASDALDKIRFLSLTDKEVLGEGDTAKLEIQIKLDKEKKILSIRDRGYGMTKGRSY

SEQ ID NO: 91598 - DNA, 947 bp, Zea mays
  misc_feature: Ceres CLONE 1580042
  misc_feature: Translation starting site: 644
  misc_feature: SWISSPROT Homolog: EC 3.5.1.14 Aminoacylase
ggagctccccgcggtggcggccgctctagaactagtggatcccccgggctgcaggaattcgtctcacccctagaaaaatttttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgatgcgcggcggcggtgaggaagggcgccgcgaccgcgaacgcgagcgggaggcaccagcaccggcgccagcgctacggcgtgggggcgccgtggagggaggagatccggggtctggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgcaccggcgtcgtcgccacgctcggcaccggccgcccgcccgtcgtcgcgctccgggccgacatggacgcgctgcccatccatgaaggccgtggagtgggagcacatgagccgggtccccgggaagatgcacgcgtgcggccacgacgcgcatgtggccatgctgctcggcgccgccagcatcctcatagctcgcgagcacaactcaagggcacggtgaagcttctgttcaacccggcgaagaatccggctgcggcgcgaaccgtatgatcaaggaggcgcccctgtagggctggaagccatcctcgccgtgcacctgtcgaacaacaccccaaatccggggtcgggtccagaacggggcctccttgccggtgcgtttcttagct

SEQ ID NO: 91599 - DNA, 1152 bp, Zea mays
  misc_feature: Ceres CLONE 1580043
atgggtgggggttaacgggatgtataaaggggagtggggttaggaggggtgatttgagggggggcgtgaaggttcacgctctgctcggccgtttgtaaaaactggggctccccacggtggcggccgctctagaactgtggatcccccgggctgcaggaattcgtctcacccctagaaaaaatacaaccgcgcactccaaacgcgcacgcgctgttcgttcctcggccgctctctccaccccctccttctccgcccccaacagatctccgccggccgtggcggtttcctttaattcgccttctccggggactgtcggatctccgccggcggctggaggatggggcaactgctggcgtgaccccccaaaaggcagccaaagaaccccgggggggggggaaaaaagcccccaggggagccttaacccaaaaaaaggggaaaaaaaacccaaaccccccttttccgaatggaagaaaaaaccgtttcggggggaggggaaaaccccccccaaaaatgggggggggccttggggggaaccccccccgggggggggggggaaaactcccggggccgggggaaaaaaaaaccttcgggcgggggaaaattctgggggggcgcggggaaaattttgggggggggtatcaaactaccctgtgtggagaaaacacagccccccccccccaagggggggggaggccctttctccccccccacaaaagctccctcttccccccaaaaaaaaagaaacccccccctcccccgccccctttttaattcccttttaaaaaaagcatttcccccccgcggggggggggggggggggaaaatatatattccccccccccctctcccctcctcggggaggcgcccccccgccaaaatttttttctcccccccccgtggggggggggcgcctttagggggagaggggaagaaaagaagaggggggggtggcccccccccccccctggaggggagaggtctccctccctccgagggggggggggggggagtgattttttttctctaacagaatcgtatagtgggtgggggggggggagaggaaaacgcaaccacacatgaagggcggggcgggcgcccgcccccccttcgtttcttctcttcaccccacgaccaagagggtggggggggggg

SEQ ID NO: 91600 - DNA, 964 bp, Zea mays
  misc_feature: Ceres CLONE 1580044
  misc_feature: Encodes the peptide sequence at SEQ ID NO. 91601
  misc_feature (59)..(59): n is a, c, t, g, unknown, or other
  misc_feature (60)..(60): n is a, c, t, g, unknown, or other
  misc_feature (67)..(67): n is a, c, t, g, unknown, or other
  misc_feature (68)..(68): n is a, c, t, g, unknown, or other
  misc_feature (70)..(70): n is a, c, t, g, unknown, or other
tgggggggcggtcctttccctacttcagtttccacctttcctcggcctgcgcgagcgannttggtgnntnttgcaaaactggaactccccccggtggcggccgctctagaactagtggatcccccgggctgcaggaattcgtctcacccctagaaaaaacccagccgcccattggcggcattgctcgcagcgctagcttcttgcgctcatcactcgtctccgaccaagatcagcaaggacggcatggctctcgaagcagcgtacgactacctgcacgtcgccgtcgtccagtgcacgcccacaaaagcagcagcaatcctcggcgacctcctcctcctcgccatccggctagccgcggcggcgaggagctcgtccgcgacgtcccccaaatggaagcagcacaggctgccgccgacgcctccggggaagctccccatcatcgggcacctccacctcatcggctcccacccgcacgtctccttccgcgacctccacgccaagtacggccacaacgggctgatgctggtgcaggtcggcgccgtgcccaccatcgtggtgtccacgccgcaggccgccgaggccgtgctccgcacgcacgaccacctgctggcgtcccgcccgcggaaccccgtccccgacatcatccgaatacaacttccacgggacgtgggccttcgccgcccgcaccggcgcagtaactggacgcacgggccgcggaaagggtggtccaccacgtcaccttgctcagacgcccaagaagggtcattcttccaaagcggacaggtagcccgggatgtaggaaggtgcccccctggggggatggccgccacaattccggcaaaccgcttggccaaaaggccgtccccccggaggaaacggcggctttcgacaatggaacggaaacttttctggggggcgggctaacacacaaggcgcaccttttcctggattgcccaccgccact

SEQ ID NO: 91601 - protein, 226 aa, Zea mays
  misc_feature: Ceres CLONE 1580044
  misc_feature: SWISSPROT Homolog: EC 1.14.13.68 4-hydroxyphenylacetaldehyde oxime monooxygenase
MALEAAYDYLHVAVVQCTPTKAAAILGDLLLLAIRLAAAARSSSATSPKWKQHRLPPTPPGKLPIIGHLHLIGSHPHVSFRDLHAKYGHNGLMLVQVGAVPTIVVSTPQAAEAVLRTHDHLLASRPRNPVPDIIRIQLPRDVGLRRPHRRSNWTHGPRKGWSTTSPCSDAQEGSFFQSGQVARDVGRCPPGGMAATIPANRLAKRPSPRRKRRLSTMERKLFWGAG

SEQ ID NO: 91602 - DNA, 882 bp, Zea mays
  misc_feature: Ceres CLONE 1580045
  misc_feature: Encodes the peptide sequence at SEQ ID NO. 91603
  misc_feature (867)..(867): n is a, c, t, g, unknown, or other
gagctccccgcggtggcggccgctctagaactagtggatcccccgggctgcaggaattcgtctcacccctagaaaaagtcccacccgcttcggcttctccctcctcctcgctcgctcgatcgctcccacgtcctcgcctccctccacaaaccaccaccaccaccaccatccaggatcgcagcgcggcgcgcgagagaggggtgagcaggtcgggcaagatgagggagatcctgcacatccagggcggccagtgcggcaaccagatcggcgccaagttctgggaggtgatctgcggcgagcactgcgtcgactccacgggccgctactcggggacctcctcgcagcagctcgagctcgagcggatcaacgtctactacaacgaggctgggggtggccgctacgtgccccgcgccgtgctcatggacctggagcccggcaccatggaatccatccgcgccggccccttcggcggcatcttccgccccgacaacttcgtctacggccagtccggcgccgggaacaactgggccaagggccactacaccgagggcgccgagctcatcgactccgtcctcgacgtcgtgcgcaaggaggctgagaactgcgactgcctccaagggttccaagtatgccactccctgggtggcggcactggttctggcatgggcacgctgctcatctccaagatccgggaggagtacccggaccgcatgatgctcaccttctccgtgttcccgtcgcccaaggtgtccgacaccgtcgtggagccctacaacgccacgctgtccgtgcaccagctcgtggagaacgccgacgagtgcatggtccttgacacgaggcgctctatgatatttgcttccgcacccntcagctcaccaacct

SEQ ID NO: 91603 - protein, 221 aa, Zea mays
  misc_feature: Ceres CLONE 1580045
  misc_feature (47)..(221): Pfam Name: Tubulin Pfam Description: Tubulin/FtsZ family, GTPase domain
  misc_feature (217)..(217): Xaa is any aa, unknown, or other
MREILHIQGGQCGNQIGAKFWEVICGEHCVDSTGRYSGTSSQQLELERINVYYNEAGGGRYVPRAVLMDLEPGTMESIRAGPFGGIFRPDNFVYGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDTRRSMIFASAPXSSPT

SEQ ID NO: 91604 - DNA, 910 bp, Zea mays
  misc_feature: Ceres CLONE 1580048
  misc_feature: Encodes the peptide sequence at SEQ ID NO. 91605
caaagctggagctccccgcggtggcggccgctctagaactagtggatcccccgggctgcaggaattcgtctcacccctagaaaaagaatcggattaggcagccacccatttcaagccgaagagaggaggagagccaagcggcgactggacctggagagccggcatggcacgcctgctcctctccgtctcagtccccatgtccgctagcagcagccgccgcattgtggttcctggtaccgcgcggcaccgaggccgcagcggcgtctgtgtcgctgtgcccgccacctccaccgccaccgccacccaacaagaatttgaccccgcggcggcgccaccgttcgggctgggcgacatccgcgccgccatccccaagcactgctgggtgaaggacccctggcgctccatgggctacgtggtgcgcagacgtggtcctggtgctgggtctcgccgccgccgcggcgcgcctcgacagctggctcgtctggccgctctactgggcggcacagggcaccatgttctgggcgctcttcgtgctgggacacgactgcggccacggcagcttctccaacaaccccagactcaacagcgtggtcggtcacattctgcactcctccatcctggtgccatacaacggctggcggattagccacaggacgcaccaccagaaccacggccacgtggacaacgacgagtcatggcatctcctcctcgagcgtctgttcaagacctggacagcgtcgtcctgatgctgcgcttcaggctgcccttcgctatgctcgtctaccaatctacctggacaacaggagccccgggcagtccggctgccatttacacccgggcagtcgacatcttcagcccagcgagagcaaacagtgctcagctccaccgcgtgctgactcggcatggtcgc

SEQ ID NO: 91605 - protein, 77 aa, Zea mays
  misc_feature: Ceres CLONE 1580048
  misc_feature: SWISSPROT Homolog: EC 1.14.99.33 Delta(12)-fatty acid dehydrogenase
MFWALFVLGHDCGHGSFSNNPRLNSVVGHILHSSILVPYNGWRISHRTHHQNHGHVDNDESWHLLLERLFKTWTASS

SEQ ID NO: 91606 - DNA, 931 bp, Zea mays
  misc_feature: Ceres CLONE 1580049
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (30)..(30): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (42)..(42): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (693)..(693): n is a, c, t, g, unknown, or other
  misc_feature (802)..(802): n is a, c, t, g, unknown, or other
nttttttttttttttnnnnctgctattaanantanncncatntaaaaaaaaacagaannnnnnncaannnnnnacaaactggaactccccgcggtggcggccgctctagaactagtggatcccccgggctgcaggaattcgtctcacccctagaaaaaataatccgcgaggtccgggaagcaggcgatgttattctttttattgatgaggtccacaaccttattggatctggaactgttggaaagagtaagggttctggtcttgacattggcaacttgctgaagcccgcgcttgctagaggtgaattgcagtgcattgctgctacaactctagatgaacaccggatgcattttgagaaggataaggctttggcccgccgcttccagccagtactagtagatgagcctagtcaggaagatgctgtgaagatattactgggtcttcgtgaaaaatatgaaacttaccataaatgcaaattcacattggaagccatcaatgcagcagtttatttgtcagcaagatacattcctgacagacagcttcctgataaggctattgatctgattgatgaggctggaagtagagctcggatggaatcatttaataggaagaaggaagggcagtcttcgattctcttgaagtcaccagatgaatactggcaagagataagagctgctcaggccatgcatgaangtggtgttatctaacaaggaaaaatattctccaaatgagaatgctgaaagagagtggtagtgctaacgttgaaacactacacagagaccatatttgagtcaacatctancttcatcactctcagctgaatgaaccagttggtagttggggacagagggaaaattgccaagggttgccttcaataatgggtctggggaatacccagttaccgccagtttggactgcccgcaccgattac

SEQ ID NO: 91607 - DNA, 815 bp, Zea mays
  misc_feature: Ceres CLONE 1580052
  misc_feature: Encodes the peptide sequence at SEQ ID NO. 91608
  misc_feature (711)..(711): n is a, c, t, g, unknown, or other
acccgcggtggcggccgctctagaactagtggatcccccgggctgcaggaattcgtctcacccctagaaaaaatcgtgccgtacatttcctagcttcatgctctggctgcctcctcctcctcctcctcctccgcgtacgcgtatagatatttgtgctgacgagaccaattctattttatttgttatcttgtttggtggtggttgtctgccctccatgcatctcgccatcttctatttataatagacccgccttctctctgtcacacgccatacaattctcacacgcgcgcgcccaacacactagcctgcaggatcgtcgagcgcgaggcggctgccccgccggccggttcgttcgctctatagcttgagaccgatcctagggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagatttacctgcttgtacgcgcggtcgacgagccatcagcgaagcagcgcgtccaacaagaggtgatagacacggagctgttcggcctgctgagagagaacacggcaagggcttccagcagttcgtagaggccaaagtcgtcgctttggccggagacatcgtatacgacggcctggggctanaggcagccgtgctggacgcgctggccaaagacgtcgacgtcatcgtcaacatcgcagcaaccacctacttctacgaaagtacgatgtttcgctggacgtgaaca

SEQ ID NO: 91608 - protein, 84 aa, Zea mays
  misc_feature: Ceres CLONE 1580052
MMMDAARIVEYFKGKCILVTGSTGFLGKILVEKILRVQPDVRKIYLLVRAVDEPSAKQRVQQEVIDTELFGLLRENTARASSSS

SEQ ID NO: 91609 - DNA, 1052 bp, Zea mays
  misc_feature: Ceres CLONE 1580055
  misc_feature: Encodes the peptide sequence at SEQ ID NO. 91610
  misc_feature (13)..(13): n is a, c, t, g, unknown, or other
  misc_feature (17)..(17): n is a, c, t, g, unknown, or other
ttttttttgtttnttcncttaacgagtataaagtactattaaataaaccaagaaaaacgagcgcggcacacctcaaataaaattaaagctgggactccccgcggtggcggccgctctagaatagtggatcccccgggctgcaggaattcgtctcaccccttaaaaaaaagaaaagcccagcgcgatgacacgagtgggactggggagtagtgaggtgagagcttctccccgcgccgtcgccaaaaccctcaaaacccgaaacgccggcggcgaagaggagacggcggaggcagacatggcgacgcggatgaaggacgtgacgcggaggtcgaccaagaagtacgtggaggaggcgctgaaccggcgtctgttccggaaggggacgacgccgcacgcggttcaagaggaggtcaatggcttcctcaacagccagaagcgggctttcaagtgggaggtgggcgtttgcgtccgccggatgcgggggaacgcgctctaccacccttcgctcaagctattctgaagcttatggcaaagaaacaggcattgaatccataccgttaactgatcaaggcaatttcacccctgggatcctcacttgcccaaaattccagaagggtatccacgtggctagccccgaaaaaatgtagcctttttttgggaaaccctccccccagaaataaacccggtcccacatgaatttttcaaatttcctttacccaatgaaaggggaacagtccttctgtgttcttataaaaagttttcctataaaatctggggaagaaaaaaaggttcccccaatgggaaaactgcgagaaaaaagggggtcccggaaacccccccgcctttttaagggggaaagaaaaaaaaaatgttccaaggggagaagacttttgcagaaattttttggggggtctgtttttaaacaaggggcggggggtacccctcttataaacacaccccaataaaaggaaccccaaggtgggtcacccccaaatattaaacccaaatctttttaaaaatggcgccccccccacttggaatcttttaaggga

SEQ ID NO: 91610 - protein, 74 aa, Zea mays
  misc_feature: Ceres CLONE 1580055
MATRMKDVTRRSTKKYVEEALNRRLFRKGTTPHAVQEEVNGFLNSQKRAFKWEVGVCVRRMRGNALYHPSLKLF

SEQ ID NO: 91611 - DNA, 702 bp, Zea mays
  misc_feature: Ceres CLONE 1580059
  misc_feature: Translation starting site: 137
  misc_feature (189)..(189): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (656)..(656): n is a, c, t, g, unknown, or other
  misc_feature (657)..(657): n is a, c, t, g, unknown, or other
  misc_feature (659)..(659): n is a, c, t, g, unknown, or other
  misc_feature (662)..(662): n is a, c, t, g, unknown, or other
  misc_feature (672)..(672): n is a, c, t, g, unknown, or other
ctggagctccccgcggtggcggccgctctagaactagtggatcccccgggctgcaggaattcgtctcacccctagaaaaaaccaccaaccaaccagtgctgccctccgccgatccactgacctaccgcgagcgccaatggcgaccgccgcggtcctggccgccacattagcgctgttcctcctgcgctncgccgccgcaacggccgcgacggctgcggcggagggcggaccggatcggcaggctgcctggccagccgccggtcaacttctccatgtactccgggctacggtccacccgtggacgccgcggcgggggcggccccttcttctactggggtcaatcgaggccgggccgggcttgccccccggaaagtccgccccccccctccgggcctgtgggcctcaaagggggggggggcccggggggggccttcctctccgttgggggtaaacgggggggggttaaaaaaagaaagaaccttggggggccccccttctccggggaaataaaaacccccccccaaaaggggggggggggagcccccctttttttttttgtgaaaacccccccccccccccccccccccgggggaaaaaaaaaaaaaaaaaggggggggggggggggacacacaaaaagaaaaaccgcgggnnnncgnnanaanaaaaagtatntttttttttttgaaattgaaccccccaccc

SEQ ID NO: 91612 - DNA, 984 bp, Zea mays
  misc_feature: Ceres CLONE 1580060
  misc_feature: Encodes the peptide sequence at SEQ ID NO. 91613
  misc_feature (894)..(894): n is a, c, t, g, unknown, or other
ccgcggtggcggccgctctagaactagtggatcccccgggctgcaggaattcgtctcacccctagaaaaaacagcgcgcgccaccaccaccgcgccatgccgttctccgccaccgccgccggcgcctccatcgcctctctcccctcttcccatgccttctccatcttcacctccgcctccacgcctcttccccctgtcccggtctctgtgcctcccgccgcactcatcccgggctcccgcttccttgtcgatgccttccgccatgccggaaacttctctgtcgcctacttcctctcgcacttccactccgaccactacagtggcctcggcccttcctggcgccgcggccttgtattctgctccgcgccaaccgcacgcctcgtctcatccatgctctctgtcccgcctcaacttgtcgtctccctcgatatcggtgtccgtatcaccgttgatgggtggggcgtcaccgccgtggacgccaatcattgtcccggtgccgttcagttcctcttcgcctctcctgggccgagagccgagagatatgtgcacaccggtgactttcgttacacagagtctatgacgcgtgatcctaacttgctggagttcgtccatgccgatgcggtgttttctggaccccacatactgcaaacctcaatttaaattcccccttcgcaagaggaattctgcggaattaattagtgaattgcaaaccaaccgtgtgaaagaggaaaagttccttttccaggatagccgggggctttgtcctgataccccacctttgcggccggcaatgaaaaaaaattttgccggaaggcccccaaggctggggggtgtctaatctctggggacaatagtgaaataaacaattctaaccgctgggggttcgtgggatanataaacccgtttctggggaacccccagtggcaggatgtccttttcttgggtgcaaatttttaggggaatatgccccctttttctccctat

SEQ ID NO: 91613 - protein, 187 aa, Zea mays
  misc_feature: Ceres CLONE 1580060
MPFSATAAGASIASLPSSHAFSIFTSASTPLPPVPVSVPPAALIPGSRFLVDAFRHAGNFSVAYFLSHFHSDHYSGLGPSWRRGLVFCSAPTARLVSSMLSVPPQLVVSLDIGVRITVDGWGVTAVDANHCPGAVQFLFASPGPRAERYVHTGDFRYTESMTRDPNLLEFVHADAVFSGPHILQTSI

SEQ ID NO: 91614 - DNA, 891 bp, Zea mays
  misc_feature: Ceres CLONE 1580061
  misc_feature: Encodes the peptide sequence at SEQ ID NO. 91615
ctccccgcggtggcggccgctctagaactagtggatcccccgggctgcaggaattcgtctcacccctagaaaaaaaccatttcattccttcgcttgcttcccctcgatcgccttactggcttcttcctccccagcacacacacgcacacgcacacacccagccttttggctgccctgccggccgtcaccagagagaaaccgagctctaactaactgaagtgacggccacataactagctactcttctgatcctgagcgcgcacgcaccatggctcacgaggacgtgcaccaggacgacgcaggcctcgcgctgggcctgtccctcggcagcggcagcggcggcgcctctgagtgcggcgcgccacggtggtatcatccgccggctgagcagggaggtgcggctgccgtcgccgcacccgatggagccgtcgctgacgctaagcttgccggacgaagcaacctctaccggatccggcaggggcggggtcgcgcacagaatgtgctcttcttcaatgccgggcgtgaagacggatcgtctgaatgacacccagggagagatggcgtcctctacggccacattaccacaggccagcgccagcaccgaggacgacaactaccacgggagcacactctacaagctgacgctgaccaaggagcagtccgcgctcctggaggaccgcttcaaggagcacagcaccctgaacccggtacgtaataatgtacacctgcgtgtgcgacacgttgggcgtgactcactgacttcgatcgattgatgactggttgcttcgctgcatgctacgcacggcactacaaaactgctgctggctcggcatgccttgccatgactagtactacccctagatgaattactagctgacactggttgcgtac

SEQ ID NO: 91615 - protein, 117 aa, Zea mays
  misc_feature: Ceres CLONE 1580061
MEPSLTLSLPDEATSTGSGRGGVAHRMCSSSMPGVKTDRLNDTQGEMASSTATLPQASASTEDDNYHGSTLYKLTLTKEQSALLEDRFKEHSTLNPVRNNVHLRVRHVGRDSLTSID

SEQ ID NO: 91616 - DNA, 792 bp, Zea mays
  misc_feature: Ceres CLONE 1580062
  misc_feature: Encodes the peptide sequence at SEQ ID NO. 91617
tggcggccgctctagaactagtggatcccccgggctgcaggaattcgtctcacccctagaaaaaactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactgggaacgttcgcccgcgacgccgggccaagtgtcacgaacagtttttgttcttgctggaacctgcgggcgtggctcaatggtcctgggggcaaggccgaaaatgggcgtccccgggtccccctccctgggggttgggggggaaacaatactttgtttacaccgttaacccccaggggttttaaaatggaaaaaataaaccccgggccttttccgggggggcccttccccccccctgttggggggggggggggtaatacccacaaaacgggggggcaacaaaaaagaattttgtcccccccccccctttataaaaaaggcataacttttattaccaaaaagtttcttgtggggagagaataatattccccgtgtttcttttgtgaaggggggggcaaataatttctcccgagaggtgggggggaaaaagcc

SEQ ID NO: 91617 - protein, 132 aa, Zea mays
  misc_feature: Ceres CLONE 1580062
MEEARDHRLSSTAGRPFLSGFCAAALRRKPLGARASAAAAATGEGLVRQLGVLDLVLLGIGASIGAGIFVVTGNVRPRRRAKCHEQFLFLLEPAGVAQWSWGQGRKWASPGPPPWGLGGKQYFVYTVNPQGF

SEQ ID NO: 91618 - DNA, 824 bp, Zea mays
  misc_feature: Ceres CLONE 1580063
  misc_feature (590)..(590): n is a, c, t, g, unknown, or other
ccccgcggtggcggccgctctagaactagtggatcccccgggctgcaggaattcgtctcacccctagaaaaaaaaacgcacccccaagctaccaacgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcngcgggtggggccccggggaggcgatggcacggtgctgggcgacttgccggagaactgcggtcgcggaggtgctgctcaggctggaccccgctgaagatctgcccgatggcgcgggttaacccgcccttccgtgggcgcccgcgtccgggggacggtgttctgggaagttcaagcttacggaggaacttcggggcgccttcttccccgtttgcttccggccgggcaaagggggaa

SEQ ID NO: 91619 - DNA, 1194 bp, Zea mays
  misc_feature: Ceres CLONE 1580064
  misc_feature (23)..(23): n is a, c, t, g, unknown, or other
  misc_feature (24)..(24): n is a, c, t, g, unknown, or other
  misc_feature (51)..(51): n is a, c, t, g, unknown, or other
tgtgtgttggttgtgtggggggnngggtgtgggggttgcgggggtgtggtnttttcctgtgtggcgagtcaaaactgggactccccgcggtggcggccgctctagaacagtggatcccccgggctgtatgattcgtctcacccctagaaaaaccgcatcgaccggacggtctctctctcgtctctcccgacgcgcctccacggccggccccgccccggctcgctagcctcctcccactcccagtaccagcccccgcccctccagcaccaccagcagctcgccttcagaccatgaaaacggtcggaagaaacctgcatggcgacggcacgacccctcgggtcgcggaggcggggcaaggcatgatggagcttcaggccaactgagccgccgcccttccggggcccccttggtggtgggggattcagcccggttcagggaaggccctggtgggcggggaaccacaagggggctttccggcaggggggacggggccccggcctcgccttatttgggcaaaaccgtggtccggccatggcccccccaggcaaaaggaaacccctctggggtcgacacgtggaaacttaggggaccccccggggtaaaaaacaaccagaaaccggggtcttggaactgaaatcttctccccggggggaaacaccgtgagaaccccgggggctgagctttaaacccacaaccctcatatggggagcccccatcccagggagtttcccgggggtacatgatctcccacccccggtgtttctcgtaagaacccgcttttgattctggggtgcgcgatcttttttaccccgcctccaaaaaaacaaagcatttaccgctctgttctctcaggagtttaaccgggagagtcgtccagtgaataaggggggcccccgcccaggggtgccctaaattactttccactcctttgcaggacgcgcctctccgcgcggttgttaatacgttgtaaccacccaattggaataagtgtacaaaattgggtttttattgggcaggaactatcttagtaggggtgtggaccctccgtaaacaacaagggtcggtgggtgaaccccccggaggggaaccgaattgggttaggtggccgcgccgaaaaaaaaaggggtgacgctcggcgacgggggaagaaaatggtcgctccactcaccagatgccagccagtgaggtgacccc

SEQ ID NO: 91620 - DNA, 802 bp, Zea mays
  misc_feature: Ceres CLONE 1580066
ctggagctccccgcggtggcggccgctctagaactagtggatcccccgggctgcaggaattcgtctcacccctagaaaaagtgtctccgattctggatctgcccatgccgtaacccgcaggctcccggcatctcgctcttgcctccaaaattcaccttcgccgattgccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgaggctgttgccctcccgggcgccctcggcgcggagctcgcacgcgtcctgcgagcgcgcggcgccgctgaggtacgccttcacctcctcgtaggtgttgtcgttgtcggagacggggccatagcgtgagtagcgcacctcgccgccgggctccgagatgtcgatggtcacgtaggggtccacgacgttgagcaggcaccgggcgcgccggcgaaggaacaagttgaagtaggtccggaacagaggacagggagggacctaaaattcaagcccaaaggaccaaagcccgaagtttcttttcttccccgcaaagaaagaaggcaagagttctcggcttctcgcaagtcgcgacagagaaagaagcggagttgcggagaagatgcagagcagcagcatggaagagggagatcagcgaggc

SEQ ID NO: 91621 - DNA, 910 bp, Zea mays
  misc_feature: Ceres CLONE 1580067
  misc_feature: Encodes the peptide sequence at SEQ ID NO. 91622
  misc_feature (675)..(675): n is a, c, t, g, unknown, or other
aagctggagctccccgcggtggcggccgctctagaactagtggatcccccgggctgcaggaattcgtctcacccctagaaaaacctagaaaaaagtacggaggacgggaggagtgatctccacgcccgctcgctcgcgtcctgtcgccttgtcggcgtccgccactccgccccctccagccagatccctcctattcccccacttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatccgctcctccacccgtcctctcaccagctcaccgatttcctcacctccgccacttccacctccaccttcctcactgacgactccgtgctgcgcaccggggaggacttcaactcctcgtccaccggcgccgccggcgaggtcgccgctgggggtgtcgaagtcgtcgcggaggccgtcccgttcatcaagctctccgaagttggcgccgaggccgagaagacggagcccgagacggagcgggccgtcaccgtcgacactgatgcggccacgggcgagggtgcacngttggccgaagaaaacgccgtttgcgaagcggtttcctgcgacacggaggcgcccgtggactgcacaggagacagggaactctttcacctgctcatgcgcgcggccatcgagcgggtccccgaacctcacttctaccgcttttggccgtcccgtggcggtggccgggaagtcccatgggagtgggacctcgcgtggggctttcggccccgctgccgaagccattcgcacccggcc

SEQ ID NO: 91622 - protein, 226 aa, Zea mays
  misc_feature: Ceres CLONE 1580067
  misc_feature (148)..(148): Xaa is any aa, unknown, or other
MLGRAAALSAPRWRGGVPDLRAALRSGGNLLFALFVAAVLAFTLLAAFHSPDDPLLHPSSHQLTDFLTSATSTSTFLTDDSVLRTGEDFNSSSTGAAGEVAAGGVEVVAEAVPFIKLSEVGAEAEKTEPETERAVTVDTDAATGEGAXLAEENAVCEAVSCDTEAPVDCTGDRELFHLLMRAAIERVPEPHFYRFWPSRGGGREVPWEWDLAWGFRPRCRSHSHPA

SEQ ID NO: 91623 - DNA, 837 bp, Zea mays
  misc_feature: Ceres CLONE 1580070
  misc_feature: Encodes the peptide sequence at SEQ ID NO. 91624
ctccccgcggtggcggccgctctagaactagtggatcccccgggctgcaggaattcgtctcacccctagaaaaaagttactaaaataaaagccaatatggcaggggggaggtcgtgcttctccacttcttgcgatcccctgattccgagacgccatctccgccacttgctgatcactatggtgtcgctcttctacccataagacgtcatcccgatgcgctggtggaagcgctcctcctgcccctgctgccacatctcctcttactcaggatggagcgtcgcttgccccgtgtgtgactccagcctccggaatatgcgcggctggtgtatcagccctaggtcaggactctatggcagctcggccatctactatccaaaaactcgtctgatcagagcgagatgggatactctaccttgtccatgatctttacgacggtgtatccgggcttcgggtggactctccggggaggagggacccggcggctgcggtttcctctagatacacagatctccacgccggatctcgtgggtctctaagccaacttggaggtggcggcatgcgaaatccttctaccgaacccccgtgctggtgtcgcaatcgcaggcccctttctaggtgaagggggaatatttcctgcccaggggtccaggggagggcagtttccgtcaaccgggtgactaacggatgcctctacagggtaaggggaaaaagaaacttgcaagcgcatcgctccccgggtttttttatgaatacctggggagcccttagggatgggaggcccgttttacctcccaaaggaagaagaggggggggcttcaaaaactttttaccaaaaag

SEQ ID NO: 91624 - protein, 69 aa, Zea mays
  misc_feature: Ceres CLONE 1580070
MRWWKRSSCPCCHISSYSGWSVACPVCDSSLRNMRGWCISPRSGLYGSSAIYYPKTRLIRARWDTLPCP

SEQ ID NO: 91625 - DNA, 957 bp, Zea mays
  misc_feature: Ceres CLONE 1580075
  misc_feature: Encodes the peptide sequence at SEQ ID NO. 91626
  misc_feature (783)..(783): n is a, c, t, g, unknown, or other
  misc_feature (857)..(857): n is a, c, t, g, unknown, or other
ctccccgcggtggcggccgctctagaactagtggatcccccgggctgcaggaattcgtctcacccctagaaaaaaactgcttccgtcatctccaccatccccacgttctcctccctccgcctctcgctctgcgcacatccccatgcccacgccgagcgcttgcgcctcaccgcccccgtcgcagccgcggccgtggcggcgtcgacgacctcccccgactttcccgccgtgggcgccgtcctggggaagcccacagtgctcgtgggtagtggtcgagaagatcggagccgcggggttcaagctgaaggaggtggtgcgatgtccatctcctaggtcgtcgtcctcacgctcctggagttctggtcagtgagatgttcatcttcgtgctcagcctcgtcctcgagttgtcgcgcaagcagcgagagcagcgtgggtctcatcatcaggatcacaccaacatggtaagcctgtcattggtcatgactgccatccgcgacgagccggatctcaaagaggcggtaatactcaggcccttgggccacacctcacacctctgattgaggtgttcccgaaaccatcgacttgaacattttttcagatccagcaaaaagcagatccaaaacggatcaagaaaataatgtttcagtttcattcgcgagtttagtacatgattaatgtattttctcgttggactccaatctgccaattgatttttagcattgtttgcacaaaggacggagatctgtcgtcgaagacacctggctgttctcatggcaagctgcntgctctagctgggcacataagcacttcaggcttcagtcggttatgtgatcaccggacattatggctctaaaganggactttgagaaatgccagcgatgtgcatgcatgatgaagtggtgtccattattttacatgatgacagacacgctgggcacggatgatcagaacatcact

SEQ ID NO: 91626 - protein, 61 aa, Zea mays; identical to SEQ ID NO: 70056
  misc_feature: Ceres CLONE 1580075

SEQ ID NO: 91627 - DNA, 1333 bp, Zea mays
  misc_feature: Ceres CLONE 1580078
  misc_feature: Encodes the peptide sequence at SEQ ID NO. 91628
  misc_feature (428)..(428): n is a, c, t, g, unknown, or other
  misc_feature (1219)..(1219): n is a, c, t, g, unknown, or other
aaatagaaatatcttccattaaaagacaatccgtcctcgccccaaacccctctaattcttcaaaactggagctccccgcggtggcggccgctctagactagtggatcccccgggctgcatgaattcgtctcacccctagaaaaaaactgcttccgtcatctccaccatccccacgttctcctccctccgcctctcgctctgcgcacatccccatgcccacgccgagcgcttgcgcctcaccgcccccgtcgcatccgcggccgtggcggcgtcgacgacctcccccgactttcccgccgtgggcgccgtcctggggaagcccacagtgctcgtgggtagcggtcgagaagatcggagccgcggggttcaagctgaaggaggtggtgcgatgtccatctcctaggtcgtcgtcctcacgctcctgaagntccggagagagaaaagaccatcttaccccccccccttcttcctcgattttgtcccgcaaccagcgagagccacctgggtcttcatcctcccgatctccccaacatggtacccctggtcctttactcaatgaattgctttcttcaccaccagctcgggatccttcaaaatgccggtaatataccaatggcgcctttggggcacaaacctccacacacttctgaattgaatgggggttccccctcaaatcccattctatttttgtacaccctttttcacaaaatatctctttaaaaaacccaatataccctaataccgggtcttctacgcaacacataattggactacaaatttttcacatgtccccgcacccgcttaatgctaccacgtgaactctcctacgcttattttctccgttatggtgggggcacctcccaattctgttgcaccgaagatctgtgaatactttctgtagtcctcttgtcgcctactcatcccacccatagagttatcgtatatatattcctctgtcaccctcgtcacaaataataacatacccccgtgccgttgatgtcttttatccatacgaaccggaagcccctctctttactcttcacactgaacttcttgtttctacctatattaatgccccttccctttgtatgctcttccaaactcaatatttagtcacttatcccaacgcctactatatattgatattcaccgacgtattagttctgtcgccttcttgataataaacactcacctcacacgatatccgacttcgccatcntcacatcgtatggtgttcactcttactgcacacccacacgccttcttgttatacacccaccacgtatcttcgtctcttacgaccgtattatatttcaattctcttactattctc

SEQ ID NO: 91628 - protein, 62 aa, Zea mays
  misc_feature: Ceres CLONE 1580078
MVPLVLYSMNCFLHHQLGILQNAGNIPMAPLGHKPPHTSELNGGSPSNPILFLYTLFHKISL

SEQ ID NO: 91629 - DNA, 929 bp, Zea mays
  misc_feature: Ceres CLONE 1580080
  misc_feature: Encodes the peptide sequence at SEQ ID NO. 91630
  misc_feature (789)..(789): n is a, c, t, g, unknown, or other
  misc_feature (790)..(790): n is a, c, t, g, unknown, or other
  misc_feature (819)..(819): n is a, c, t, g, unknown, or other
ctggagctccccgcggtggcggccgctctagaactagtggatcccccgggctgcaggaattcgtctcacccctagaaaaaatcggaccgccagcagtcgccagccccagcaaggcagagcagcgagcggctatgggaagagagacgccggcgatggcggtagcgctgctggcggcgctggtcgcttccgcggccatgttcatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtcagaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggctgatcgcggtgtcggagcccatatcgttcaagaacccctaggcgcccgtgttcccgcgcctggcgcatggcacgtcccacgacgagatgacggtgacgtggaccagcggctacgccatcgatgaggcgtacccgtttcgtggagtggggcgccctggtctccggcggnngggcggggggcttctcccctgaacaccgngcggagcgcccccccgggatgctcaaccttcaaccgcgggcagcatgtgtcggcgaaaccggcgccccccccgtctgggggaaagggactcccgggtacaatccccccct

SEQ ID NO: 91630 - protein, 169 aa, Zea mays
  misc_feature: Ceres CLONE 1580080
MAVALLAALVASAAMFMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNP

SEQ ID NO: 91631 - DNA, 863 bp, Zea mays
  misc_feature: Ceres CLONE 1580081
ctggagctccccgcggtggcggccgctctagaactagtggatcccccgggctgcaggaattcgtctcacccctagaaaaaaaacaacctcatcttctctccttttgcttggaactccatggaggccggtgcccgatctccgatgcccctcgctccatccaagatgcagatttttccgaaaagcctcactggatagactatctccctcgagggggagtcttctgataccattgacaatatgcatgccgacattcacgataaggaggggattcccccggaccagcagcggatcatgttcactggcatgtagatcaaggacgggcggtgacttgccgagtacaacatccagaatgagagcaccctcggaacttgttctccgcctcacgggaggcatgcagatctctcccaagaccctcactggagagactatcaccctcgaggtggagtcttgtgacaccatcgacaacgtcaaggcctagatccaggactaggagggcatcccgtcggatcagcagcggctcatttttgctagcaagcagctggaggacaggcgcacgctggccgactacgacattcagaatgagagcaccctacacatggtgttgcgtctcacgggcggtatgcagatatttgtgaaaactctgactggcaagactatcacccgtgaggtcgagtcttctgataccatgaaaaagtcaaggccaacattcaggacaaaggagggcatccttcccggacaacaggggcttattttttggccggcaaaacaattcgaggacgggcgcaaccctggcccgactgacaaatttcaagaaggagaagaaccctacaactgcgtggctggggtcctaaggggatggacaa

SEQ ID NO: 91632 - DNA, 844 bp, Zea mays
  misc_feature: Ceres CLONE 1580082
  misc_feature: Encodes the peptide sequence at SEQ ID NO. 91633
  misc_feature (202)..(202): n is a, c, t, g, unknown, or other
  misc_feature (541)..(541): n is a, c, t, g, unknown, or other
  misc_feature (654)..(654): n is a, c, t, g, unknown, or other
  misc_feature (677)..(677): n is a, c, t, g, unknown, or other
ctccccgcggtggcggccgctctagaactagtggatcccccgggctgcaggaattcgtctcacccctagaaaaaccctcacagtcacagacacacaccgctgcttcaagaaaccaccgagagcccaaccgcacaggcaggagagagagcagggagccagggacagtagcgtggggccggggaagcaacgatggaggggaagngaggaggacgtgcgcctgggcgccaacaagttctcggagcgtcagcccatcggcatcggcggcgtcagggcgccggcgccggggacgacgacaaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggagggatgatcttcgcgctcgtctactgcaccgccggcatctccggangacacatcaacccagctgtgaccttcgggctgttcttggccaaggagctgtccctgactagggccatcttctacattatcatgcaatgcctgggttgcatctgtggagctggnagtggtggaagggcttccagcangggctttacatggggcaaacggcggttgggcgccaatggttgttcgccccccgggtacacccaaaggggggatgggcctttgggcgcctgagaattgttgggcacccttccatccctggggtgttacaaccgggcttttcttcggggccaccgtattgcccaataag

SEQ ID NO: 91633 - protein, 192 aa, Zea mays
  misc_feature: Ceres CLONE 1580082
  misc_feature (51)..(192): Pfam Name: MIP Pfam Description: Major intrinsic protein
  misc_feature (5)..(5): Xaa is any aa, unknown, or other
  misc_feature (118)..(118): Xaa is any aa, unknown, or other
  misc_feature (163)..(163): Xaa is any aa, unknown, or other
MEGKXGGRAPGRQQVLGASAHRHRRRQGAGAGDDDKDYKEPPPAPLFEPGELKSWSFYRAGIAEFVATFLFLYITVLTVMGVSKSTSKCATVGIQGIAWSFGGMIFALVYCTAGISGXHINPAVTFGLFLAKELSLTRAIFYIIMQCLGCICGAGSGGRASSXGFTWGKRRLGANGCSPPGYTQRGDGPLGA

SEQ ID NO: 91634 - DNA, 958 bp, Zea mays
  misc_feature: Ceres CLONE 1580088
ggagctccccgcggtggcggccgctctagaactagtggatcccccgggctgcaggaattcgtctcacccctagaaaaaatacgactcctccatcctccccccctccccgtgatggctgcaatggatggggtaattgtagtggagctgtagaggcggcgggggtgcggttgcgacggactgtgctgcgccgacaagctgggaagaggaggcagcggcggcggggtgggacttgggatgggtcttctgtcgaaccgggtggagcggtcggagatcaggcccggcgaccacatctacacctggcgggccgtctacgcctactcccaccacggtacgctcctcagtcccctccgaattccgatggtgataagaattcctgccctcgcgagttccactacctaattgctgccgccgatggcacggatcaggaattctagtagtgtgcaagttagctgttcaccggaattctggcccgcgccggctcgctctggacttccttttcgccgccgctggatgctggtatttgttgtttttttgctttgttccccgataggattactagtggtgatttgtgtgtaccctctacaccaacgaagataccacacaaactgaagataccatggtctctacataaacccttccagatggccaggatgccacatgctgtgttctgcttttccgtgcagaaccaatggcacttgttgctgctcacctactgctaaccaacgtgtctatcttgttctgaaccttgttgtctctagtgtggagcagcttcactgttagctcgagtttactgcaggaaagaaacctacctaaggttgacccaggcttcctgggcctctaatgacaagtttagccctagtgctgtaaccctgataccaaaagttctatgtcaattagttggtgaaccttcggccccttttccattgagggaactccttttgtattattgtttctgccg

SEQ ID NO: 91635 - DNA, 860 bp, Zea mays
  misc_feature: Ceres CLONE 1580091
  misc_feature: Encodes the peptide sequence at SEQ ID NO. 91636
ctggagctccccgcggtggcggccgctctagaactagtggatcccccgggctgcaggaattcgtctcaccccctagaaaaaccctcgcagctcaagctcgccactaccattttcgtcggttcttgaggaaatcgatcgaaccgttggagtgccaccactggcagaggctgttgcattcttgagttgagcaggaagaggagaggaagcaatggctctgtcgacgttctctgtcccaagggggttcctcggcgtgccggctcaggactcccatttcgcttcggcggtcgagctccatgttcacaagctactccaggccaggcctatcaatctcaagcctcggcggaggccggcatgcgtgtcggcgtcgctgtcgtcggagcgcgaggcggagtactactcgaagaggccgcccacgccgctgctggacaccatcaactactccgtccacatgaaagaacctgttctgttaaaggagctggcggcacctggcccaaacaagctccgggtcccacgttattctttccgcggtttcccagaccggggggccaacctcggggctcaccctccgggcggggggggaaattcacggtccgggcgttcaatatgttttttaaaaacccccccccagggaccccacttctttttgggaaaaattgggccccccaaaatttttactcccccgcaaaaaaaaaactctaaagaggggggggcgggcccaacagaaaaaatctcccccaaagaaaagagggggaaaaaaaaaacacaaccggtggggggggggtgtttttttatttaaaaaaaagacccccccccccacgggagggagtattatttaaacgcgcctttttaatgtgtggggg

SEQ ID NO: 91636 - protein, 195 aa, Zea mays
  misc_feature: Ceres CLONE 1580091
MALSTFSVPRGFLGVPAQDSHFASAVELHVHKLLQARPINLKPRRRPACVSASLSSEREAEYYSKRPPTPLLDTINYSVHMKEPVLLKELAAPGPNKLRVPRYSFRGFPDRGANLGAHPPGGGGNSRSGRSICFLKTPPQGPHFFLGKIGPPKIFTPPQKKNSKEGGAGPTEKISPKEKRGKKKTQPVGGGCFFI

SEQ ID NO: 91637 - DNA, 1172 bp, Zea mays
  misc_feature: Ceres CLONE 1580093
  misc_feature: Encodes the peptide sequence at SEQ ID NO. 91638
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
ttttttttnntcatntttttttccattaccttttttaatacctccccaacaacttgcgggtgccccggctcattgcggagggaaagcgggagctcccgtcggtggcggccgctctagactagtggatcccccgggctgcaggaattcgtctcacccctagaaaaagcccgttccagcgacgcactactgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacggatgcttgattttgacttcctctgtgggagagaaacaccttctgttgctggaataatcaatcctggttctgatggttttcagaaacttttctttggacaagaggaaattgctattccggttcatcccacagttgaagctgcatgcagtgcacacccaacagctgatgtatttatcaactttgcatccttcacggagtgctggctgcttcttcaatgtcaggcttgtgaagcagccagacaataaggggttggtagcccatttatcggctgaaggggtggttcctggaagtcagaatggccaagggcagcctaaatttaagttaatgccaccgttggcttaaatataacaaaaaagttccaatccaattttggggaccccttgggcacaaccaagattttggagaaagagggacaattttcataaaggccctttgagggttgggcccctatcttttccccaaagggaaaattttgggcgattgggaaatttaacccccgcgccttcggggggaaaaccccccagttgggggcaaatagaaaccgacttgaaatgtgttcgccggggtggcccaaaagagaccctttctaaacaaggggcgccccttgagagagatcctagggagagtggggtgtcttttggcgtggtccctagaaggatcctcgggggccagggctttgggtcacacaagctgggaggaattgtttccagtcgcacgcccgttgtgccccaggttagtggaccacgcatggggggtctctcttattggaaacagaaatttggccaatttgggcaggggggaagtgtctttccgccgggggaatcaaaccgtcga

SEQ ID NO: 91638 - protein, 105 aa, Zea mays
  misc_feature: Ceres CLONE 1580093
  misc_feature: SWISSPROT Homolog: EC 2.3.3.8 ATP citrate synthase
MATGQLFSKTTQALFYNYKQLPIQRMLDFDFLCGRETPSVAGIINPGSDGFQKLFFGQEEIAIPVHPTVEAACSAHPTADVFINFASFTECWLLLQCQACEAARQ

SEQ ID NO: 91639 - DNA, 881 bp, Zea mays
  misc_feature: Ceres CLONE 1580098
  misc_feature: Encodes the peptide sequence at SEQ ID NO. 91640
  misc_feature (511)..(511): n is a, c, t, g, unknown, or other
  misc_feature (516)..(516): n is a, c, t, g, unknown, or other
ctggagctccccgcggtggcggccgctctagaactagtggatcccccgggctgcaggaattcgtctcacccctagaaaaagccccgccaccaagctcgaccgaccgatgatcctcagccgcctgcatgtccgcgtcacccgccgatcccccgcgtccgccgccctccgcgatgcggcaacgcgcgccttggcctccgcgggcctcttccgtggcctccacggcggcgcctcctccgagcacggccgcgaacccgcaggtcctcttacgctctacaggaagctagtgagccaagggaagctcacgcatgatagttaccaggaaaatgtagcttccgaattagacaacctacttagtaggcttcaacggtacgagatggaaatggaggattatcatgacaagctgtacttctgggagaatagcagggagaaagagcggcgcaggcttcttgtcgaagaagctgaagataagcagcgtggtggtgtatggattgatgagaggaaggggatttcntgacnagttggttgcgcggagaagaagaagaagcatagaacctggagttggtaaagtgggtctcgtaccctaaaccgagagaagaaactggattcctttggtagggccatagacccgtcccctcctgtttgcccttaagggattggattcctatgggaaatgttggaaatgggaaaaacaatgtttaagggcatgtttttatgggggccccctaaaggggttcttccaaaaccggggagggggtgttcctttttctggaggcccctgctttgaaaaaacctggacctcttcgcctaaaattttgggaaaaaaaccttttttataaaaaaaaatttttcccccccggggggcttttcgtgggggaaaaaaa

SEQ ID NO: 91640 - protein, 135 aa, Zea mays
  misc_feature: Ceres CLONE 1580098
MILSRLHVRVTRRSPASAALRDAATRALASAGLFRGLHGGASSEHGREPAGPLTLYRKLVSQGKLTHDSYQENVASELDNLLSRLQRYEMEMEDYHDKLYFWENSREKERRRLLVEEAEDKQRGGVWIDERKGIS

SEQ ID NO: 91641 - DNA, 914 bp, Zea mays
  misc_feature: Ceres CLONE 1580104
  misc_feature: Encodes the peptide sequence at SEQ ID NO. 91642
ggagctccccgcggtggcggccgctctagaactagtggatcccccgggctgcaggaattcgtctcacccctagaaaaaaaaacccgcccgcacgacgcattgtccgttccgtttggacccatgatatatctcgctgggatcttgaccgtgcgcgagacgaatctcctcgtgcggtaaccgataccccccaagtcaaaaatcagcccataaaatttttatgggcggaggatcacccgtcgccgcagttcaggacgcgagcgacgacggcgccagggtcgtggtgctagtcgcgggttctcccgtcgattccgcctccgattccctccctcctcccgttgcggcgactcctgctcctgcggcggaggccaagcaggagtcggtgtcggagacggaggaaactaagcaggcggcggcggcggcagcagcagcagcggcaggaggtgtgcaggccatggcggtcaccgtagtgcgggacgtcgagacgggcctggacgcgagcaccagcgaccgggacggtgacaagccttcctggttcacacctaagagattacttgtcatgttctgcattatcaacatgctgaactatattgatcgaggagtaatagcaagtaatggggtcaatggtacccgcaaaagttgttctggtggcacatgcacctcgggctcaggaattcaaggagacttcaatcttaataatcttgaagatggtacactgtcctcagcatttatggttggggttgttggtgtcttcgttgatatttgcaagccttgtaaaaagaataattctttcaggcttattggtgttgggcttgttagtgtggacatcggcaacagctggttgtgaagtatcattataatttccggcccaatacctattggccgcagttttgttggcgtttggcaatacttcattt

SEQ ID NO: 91642 - protein, 208 aa, Zea mays
  misc_feature: Ceres CLONE 1580104
MGGGSPVAAVQDASDDGARVVVLVAGSPVDSASDSLPPPVAATPAPAAEAKQESVSETEETKQAAAAAAAAAAGGVQAMAVTVVRDVETGLDASTSDRDGDKPSWFTPKRLLVMFCIINMLNYIDRGVIASNGVNGTRKSCSGGTCTSGSGIQGDFNLNNLEDGTLSSAFMVGVVGVFVDICKPCKKNNSFRLIGVGLVSVDIGNSWL

SEQ ID NO: 91643 - DNA, 924 bp, Zea mays
  misc_feature: Ceres CLONE 1580106
  misc_feature: Encodes the peptide sequence at SEQ ID NO. 91644
ctggagctccccgcggtggcggccgctctagaactagtggatcccccgggctgcaggaattcgtctcacccctagaaaaactcggacgccgccgttactgcctccttgtgccatggcggagatatcttcggctgctgacgtgcaagccagtgtccttaccacactgcacctcaacgggaaaggtcccccactcacgctctttctcttcctccctcagtctctcccacctctaacttgacggcatcatcaagagcctctcagctttccgcatcgtcaacaccccacacctcctcaaggagacatgggtgctcaccaaggaggccaagggctaccccgccaaaggctcccccgaggcacagctcgtcaccccaatttcaccggagggtgcctctaaggacgcactctaagcaatattgggagatgctttcgatgttggcatgaagcgcatccgcgaggaacaagtggatagggttcgagaaggggaataatgacttagtccttatgaaggttgagagcgtaaaggatgagcatgccgcatctcttagaatactagagaatggggaggttgtttctgataaactgatcgatgatttcaagagaacgaaacttattacgacagagaaatcaatttggtactctctacagaccgcgtctgagtttgttgtagatagagaaacgttagctactgatgtgactacaggacaccttaggagtggtgactggcaagagcttgaattcaaagactatcattgtggagctcgaggacaatctctacccaaagctatgttgcagcatctgatggaggctccctgacgaactctagaacatcgattctattgatgggattccctgagatggcgaaccacattttcggtggaaaggacttttagaaatttcgaggcacggtttcagtctcagaagtta

SEQ ID NO: 91644 - protein, 103 aa, Zea mays
  misc_feature: Ceres CLONE 1580106
  misc_feature: SWISSPROT Homolog: EC 6.1.1.20 Phenylalanine--tRNA ligase
MKVESVKDEHAASLRILENGEVVSDKLIDDFKRTKLITTEKSIWYSLQTASEFVVDRETLATDVTTGHLRSGDWQELEFKDYHCGARGQSLPKAMLQHLMEAP

SEQ ID NO: 91645 - DNA, 990 bp, Zea mays
  misc_feature: Ceres CLONE 1580108
  misc_feature: Encodes the peptide sequence at SEQ ID NO. 91646
  misc_feature (13)..(13): n is a, c, t, g, unknown, or other
  misc_feature (21)..(21): n is a, c, t, g, unknown, or other
  misc_feature (23)..(23): n is a, c, t, g, unknown, or other
  misc_feature (54)..(54): n is a, c, t, g, unknown, or other
  misc_feature (57)..(57): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (990)..(990): n is a, c, t, g, unknown, or other
aggggatagaacnacacaggncncaagggctcgaggaataattaaaagactttnggnttttgggggggnnnnncaaaactggagctcaccgcggtggcggccgctcctcaactagtggagcccccgggctgcgttacttcgtcgagccctagaaaaatccccgtgtcctccaggtccaactccacccaaccccaccccgtcccgtgatcgtttgcccgtccctatcgttctctctcccccccttttttcctgcgaccaatccgcgcgcttttgtttttgttcctgctcctcggccctcgcaccgcgcgccgccgacgccgcatccatgaacggtgacggcagcaaggaggacgccaacaggcgcctcgagtgggccaccttgaacatggagcgcgccgtcgtcgtgagcgagacgacgaagggcgacggcaatggcaatgcaggccggaaggcgccgataagcatcgtccggctcttctcgccctgcatgggctccggcggcatccagtacggctgggcgctgcagctctccctcctctcgccctactctcagactcttgggatctcgcacagctacgtgtctctgacatggatctgcgggcctatcgccggatttgtggggcaacccatcgtggggctactacagggaccggtggcacctcgaaaatggggccggaagaggccctatcatccctcgcgggaaggcaccagcaatctggccacaactgtggttgggggaaacaggatactccggggggaaaaccgagcaggcgcccgcgggccgaaaacccaagggaagcacctagagaataacgtttcagccggggagcgccggagtgggggcacgcccgaccgacgccgtcttgaatagtgggggcgggcgatatcgagggatacgcctccggaacgcttcgcccgcgaaaacaaaacaggggataccccaaggggaaaaacggggccgtgccaacggagcaaaaatgagaatggggn

SEQ ID NO: 91646 - protein, 181 aa, Zea mays
  misc_feature: Ceres CLONE 1580108
MNGDGSKEDANRRLEWATLNMERAVVVSETTKGDGNGNAGRKAPISIVRLFSPCMGSGGIQYGWALQLSLLSPYSQTLGISHSYVSLTWICGPIAGFVGQPIVGLLQGPVAPRKWGRKRPYHPSREGTSNLATTVVGGNRILRGENRAGARGPKTQGKHLENNVSAGERRSGGTPDRRRLE

SEQ ID NO: 91647 - DNA, 977 bp, Zea mays
  misc_feature: Ceres CLONE 1580109
  misc_feature: Encodes the peptide sequence at SEQ ID NO. 91648
agctccccgcggtggcggccgctctagaactagtggatcccccgggctgcaggaattcgtctcacccctagaaaaaaaccgcgcccccacaccccgctcctctcgctgctcgctcccttttcaccttccccttcccaggctcaggctcccccctcccctgccgtgccgtgctctctcaacaagggagaaggggaaaccaccaccaccaccaccaccaccaccaccacacctgataagaagggggccttcccgctcccgccgctacgccatggacgcctgggaggccaccaaggcggtgttcgaccgggtgcgggcactggacccggacaacgcgtccaagatcatgggcctgctactcatccaggacaacagcgacaatgagctcatccgcctcgccttcggccccgaccacctcctccacgccttcgtctccgccgcgcgcgccgacctcgccgccatagccggcgtccccgccgtccccccgtgctggggccccgctccaccagaactgggggaggcgccaaacccacccgaaagccctttccgccggggtcccaaaacacccaaaaccatgggcccccttttggcccgcccaaacattcggggttcggggtaaaaaaattttcaaaaaggggccccgggggcccgggggggctataaacccattttcctttcccccgaaaaaaactaaaagagatggcgtggttaaccgggagcggggtgccccccccacccgcggggaaaccttctcccccttattgttacccccaagagccccccccccccccacccgggaagacccccccgtgggagcccccttctttttttttctgacccgcgagtgtctcccaataagaaggtccccccgtgggggtttccccaagggttttttcaaaaagaaaaaaaaaaccccctcggaaacacaaaaattgttttttattttccaaaatattttttgccccccccccctcttctcc

SEQ ID NO: 91648 - protein, 115 aa, Zea mays
  misc_feature: Ceres CLONE 1580109
MDAWEATKAVFDRVRALDPDNASKIMGLLLIQDNSDNELIRLAFGPDHLLHAFVSAARADLAAIAGVPAVPPCWGPAPPELGEAPNPPESPFRRGPKTPKTMGPLLARPNIRGSG

SEQ ID NO: 91649 - DNA, 839 bp, Zea mays
  misc_feature: Ceres CLONE 1580110
  misc_feature: Encodes the peptide sequence at SEQ ID NO. 91650
  misc_feature (440)..(440): n is a, c, t, g, unknown, or other
ctccccgcggtggcggccgctctagaactagtggatcccccgggctgcaggaattcgtctcacccctagaaaaagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggaggggtgaangaggacgtctcagaaggggagggatatgacaacccaaagggcaatgagaccaagaagcaaagaggtgatcctgaggaaaatggtgagggaagatgaggaagaaccagaagatcaggagggtggcggcgacgacgatgatgacgacgatgacgatgatgagaacggggatgacagaacagagggatcgtcatccagatccaagcacgtcggccaaccaaagccgtcttctcttctctctctcgtccgtccctcactcgccggcgacgggtgacagacaacgcgacgcgcgcattcgtcgtccaagggacggcagggcccagcaaatcattcgcgtccgtccgcctcccgggtcttggtggtggccgggaaggggcctcccccatcagctctggggaacat

SEQ ID NO: 91650 - protein, 72 aa, Zea mays; identical to SEQ ID NO: 81329
  misc_feature: Ceres CLONE 1580110

SEQ ID NO: 91651 - DNA, 1000 bp, Zea mays
  misc_feature: Ceres CLONE 1580111
  misc_feature: Translation starting site: 326
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (309)..(309): n is a, c, t, g, unknown, or other
  misc_feature (311)..(311): n is a, c, t, g, unknown, or other
  misc_feature (331)..(331): n is a, c, t, g, unknown, or other
  misc_feature (334)..(334): n is a, c, t, g, unknown, or other
  misc_feature (337)..(337): n is a, c, t, g, unknown, or other
  misc_feature (341)..(341): n is a, c, t, g, unknown, or other
  misc_feature (342)..(342): n is a, c, t, g, unknown, or other
  misc_feature (346)..(346): n is a, c, t, g, unknown, or other
  misc_feature (349)..(349): n is a, c, t, g, unknown, or other
  misc_feature (361)..(361): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnncaaagctgggactccccgcggtggcggccgctctagactagtggatcccccgggctgcaggaattcgtctcacccctagaaaaaatcccagatcaggattagccgaccacccgccgaaggccagagagaaatatctcatcttctctccaccggatcggtatcatcgagagcgagggagaaagggaggtggtgcgtcaaggggggccgagattttgccggttngnagccagataggggtatgagntgnttngggnnacgncgncgcttcgacgtngcccgcccgcaggacggcctcctcggcttcgtcttcttcctctcaaatcccataaggtaccgggggtttttaatttaagtgggaggaaatgggcgaagccacccctttggaaaacgggccccccctttgcgggtgcgggggcccttttggggtttttcggcccccctttttttctaaaaacccccccataattcctcccccctcccccggaaaacacccggggggggggtttggtcccccaaggcccccaaaaaaaaagggggcttttttttttccccacaccaccaaaagaggggggggggaaaacccccccccccccccccctttattttttaccccggggggggggtttccccggggggggaaaaaaaacccccgcccccccccccccccaatttttttttattaaaagggggaggttctttataaaaaaaacaaaaaaattttttgggggggggcccacaccaccaaaaaaaaaaaaaatctgggggggggcccccacaaaataaaaggggcgccctcttttttctcccgggggggggggagaaaaaaaaaaaccccccccccccaaaaaaaaaatatttgtgggtgggggggggggccacccccaccaaaaaaaaaaacacctcttttttattt

SEQ ID NO: 91652 - DNA, 793 bp, Zea mays
  misc_feature: Ceres CLONE 1580114
  misc_feature: Encodes the peptide sequence at SEQ ID NO. 91653
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccatgagctcatccgctacggcgagttcgcccaggccacctacgacagcttcgactacgaccgcttctccccctactgcggcagctgcaagtacccggcgaagaccttcttccacgacgtcggcctcggaggcatcggctacgaggtcacccctctctttttggcccaacttgcaaacaacctcaagttccccaacttcggcatcaagacgggccgccaacgccaagatgtggagcgtagtcgg

SEQ ID NO: 91653 - protein, 182 aa, Zea mays
  misc_feature: Ceres CLONE 1580114
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLHELIRYGEFAQATYDSFDYDRFSPYCGSCKYPAKTFFHDVGLGGIGYEVTPLFLAQLANNLKFPNFGIKTGRQRQDVERSR

SEQ ID NO: 91654 - DNA, 1015 bp, Zea mays
  misc_feature: Ceres CLONE 1580115
  misc_feature: Translation starting site: 156
ctccccgcggtggcggccgctctagaactagtggatcccccgggctgcaggaattcgtctcacccctagaaaaactgctactcaatttgatcaaccgccatccattctcctcctccgttgcagctgcggcatccatccagtagtccgaccaatccatggcttcagcgttcgggaccgcctccacttgcggcattaaacatgcacctgccggcgttgcgcttgctgcgcccatgaagcacctttccctcgtctcgccctcgctggtttcgcttccgcgcaagatgaggccgcgaaggaagtacaacttcagggtaaacgctgcaaaggagctgcatttcaacaaggatggctcggctatcaggaaaatgcaaaatgggggtcaacaagcttgcagatctcgtcggggttactctttggacaaaggggcgaaatgtagtcctcgaaagcaagtatggctcacctaaaattgtcaatgatggtgtcactgtgggcaaagaaggtgaacttgaggaccctgtttgaaaaaattgtggctaatttggtcccccaagctgctgctaaaaaaaatgaactggctgggggatgggaaaaccaccttgggttggcccttgcccaagggatgattaccgaagggtgtaaaaggtttaaacccccggggggccaaacccgggggaaaaaaccccccgggggttttggaaaaaaacgcccaaaccccctgtcggggaaaacccaaaaaaattccccaggaggttgaaaaaaaaggaccttcttaatatttccccccattttgtggggaaaaaacacctaaaagggggaaaaataccccgggggcctaaaaaaagggggggggggggagggggccccccttagaaagaagaagaggggaaaaaccccccttttcttgggaaaaaatattacccgcgctttttctcccccttgtgggggggaaaaaaaaaaacccgcgagaaaaacccccctcccgcgagagaaaataaagcgggaattttcttcgggg

SEQ ID NO: 91655 - DNA, 1093 bp, Zea mays
  misc_feature: Ceres CLONE 1580118
  misc_feature (35)..(35): n is a, c, t, g, unknown, or other
  misc_feature (68)..(68): n is a, c, t, g, unknown, or other
aacagaaaaacaggggttagtagaagggacgagcngggggcgcagcctaccccgacaccacccccccncccaagctggagctccccgcggtggcggccgctctataatagagggtcccccgggctgcttttcttcctgtcacccctacaaatgctccgcgttcgacgatgaccggctgctccatgcggccttgacgatggaggaagtatccagatcggaaggacacccttcagtatctctagctaaatcaaggtctgcactatgttgtagccgtgtcgtctgtgcttgccaccatgcgcgcgcagctgcctaatggcggcggcaaacaaacaattgacccgtacgacatcctcctccgcccctagcactgtatcgtcgagtgccccaggccggtgcagaggaaagcctccgcaatgaacgctgctatggaggtgctgcaaccagtaccatcgccacgaagggttcagtcaccccccaccagaacaaggtattttgtctctcaaacaaaaaaaacaaagacccccctcccttctaccccactgggcatctggcccactgcgccgcaccccacgaaagtctgccctcctcgggatccgtacgcctctcccatcgaatcacgctcatccgcaacacgaaatacaatgaacccgagccccctcgagcctcgcctaaaggggcttcaggggcaccatcacccgccggtgaatagggcttaaacgggcctggccatggaaaacggggtcaaaaccaaaaattctagccagttgcccccccagggtccgaaaacccagacggggttaaacggacaccctcccgagtcttaggagcttgccttcccttggccccactgaaccccccattgcctcaccaaacccacctccaagaatttcctgaaaaacgccttaaccaactagatttggaatttttaaaaagcccctgctaaaccaagtttgataccaaagaaaacctctagtcgccgtgggggttcaccttccccccataaaactccgcacaagatattacaccgggaggtctttacggtggccgcaaaaatttccgtacttctaataacctccacgtgccggctgggcaa

SEQ ID NO: 91656 - DNA, 1333 bp, Zea mays
  misc_feature: Ceres CLONE 1580121
  misc_feature (958)..(958): n is a, c, t, g, unknown, or other
  misc_feature (1175)..(1175): n is a, c, t, g, unknown, or other
ttctcttttttcccacctacctcacccccaccccttgctgatgcaacgccctaaaataaaaacaaaaacttcacgttcaccccggggaggccgctctacaactagtggatcccccgggctgcaggaattcgtctcacccctagaaaaatctcgccttcacctccactaacgacctcacctcgttcacccacccaacccgcctcgcctccattcacagtggaccacgcccattcttcgttctgtccgcatcactcccatctctccgcccccttctcctcttcgcacccgtccgcctccgacttctccgtggcccagcgggatccggacctaaactcgaccctgttcatgaaggagagcccgaatctcggtgggcgggaagactcttttttactagccccgtcagaggtcggccgccccatgggctagtcgcctgagcgtcgctacgtacccactcatcgaccggcgggacacacagcttgtttctgttggacgctttgatcccgtactatcattcaagcaaaaccatggccctgggctaaattgaccacttaaaagccatctcctttttttacaagctaacccttgcgcttctaacatcatgctcacagacgttaactccaatcaacacccaacgtctgtttccccgctccgtcactacattgtctgttgccacaagtcctcttgattcaggcaatagatcttcattcacccctcccactccactatagtccacccaacagctcctgtctcccaaaccaaatcggtgcgtcataaacaatcccgttcctagggaaatccacttatcggcgttagtctctaaggtttaccacgctttagaaattgttcgcgtcgattatcataccgtttctgttggacaataaagacataccgccctttcgtcgactacgtaatcttctgcggaagtgtgcacctcgtttggtattggcgtggcaatcgngttgtccaacgacttgactcacatagatcacatcctatcgcgagtaattttagtgatacacgctaatgacacgtcaatactcatcgtgttatatacataattcacactgcctgcatatcatacttctactattcccctcttctctgctggttaactaccctctaaagtgtgtgctacgatttctgattcctctcttcttattttatctaccacgtgntgctatatatgttcgtgaaatatggctttctacccgcgtctgtttcattgtaagaagctatcaataccctatatttttacacatactacactgtactactgtttaccacgcataccaaatgctgcgtgcacactgttctttccatagcgcacccacca

SEQ ID NO: 91657 - DNA, 878 bp, Zea mays
  misc_feature: Ceres CLONE 1580124
  misc_feature: Encodes the peptide sequence at SEQ ID NO. 91658
ctggagctcaccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacagcggtctgctccagcttgccgccgtcgacggccgccgcgaaaccgtcgtcgtccccgactaccccgaactcataggactccctcgacaactaagggggtcggaaatcctcagtattaccaagggcgaattcggggggggcccggggagggttttcgtctgcctatcgaagggaaaaccaggcccccttccctattttataccaggattcgcgggggacaccttttacttccctctattcccacgcaaggatgaaatgggggggggaaccccgggcgcaccgggaggacagggtgaggggacactgatgggggagggcccaaaggggagaaattctcggacccag

SEQ ID NO: 91658 - protein, 242 aa, Zea mays
  misc_feature: Ceres CLONE 1580124
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDSGLLQLAAVDGRRETVVVPDYPELIGLPRQLRGSEILSITKGEFGGGPGRVFVCLSKGKPGPLPYFIPGFAGDTFYFPLFPRKDEMGGGTPGAPGGQGEGTLMGEGPKGRNSRTQ

SEQ ID NO: 91659 - DNA, 921 bp, Zea mays
  misc_feature: Ceres CLONE 1580125
  misc_feature: Translation starting site: 111
gcggtggcggccgctctagaactagtggatcccccgggctgcaggaattcgtctcacccctagaaaaaattcgagtgataagcggtccccaatttctactgtaagcagcaatggcgctctcctgttgcttgctcgccgagctcccgggggggagcctccccttccttctccatcctccgctgtcttcctgctgcgggacctccggctgctgaccttgtgcgtggatccgcttgccctcgtctcagggatgtcggcacgggctccgcgtgagctgtgcctccaccacctcttcgtgatatccgccgccggtaactgccgaggagcccggacgacttcgacttattggacacacgtgggaattgtgaccctcctatgctcggcgtgataaagtgagctcacagtacttggaagctaacgactgaccaaagaatgaccttctaaaagctttaactatacattggcacagccttgactggtgcagccacaataaatgcgttcctgggttggtgctaagctcgacattgcaatggtgttggtttttggtattggctatgcacgtatcgtttttgaggaatcactatcatttaacaaaagtggagttgcggtatcgatggttgtatgcctattggtcatcagaggcattaggactgactcgactgacgtagctggtcgagagttgagcacgcaacttctgaaatagtgcaactgtgtatctctcgctggcgcgatgatggtgacgataatgatgatgagacttacggtttctagtcgagactgatatgtatcttctccagacgacaactactcagcggatgatcgacttagtactttcttacatgagtcgtcatcgctagtgacatccgcagtgcgacgctagcttgactgctaagctgacgacatatcatctagaagtgcggtgag

SEQ ID NO: 91660 - DNA, 1275 bp, Zea mays
  misc_feature: Ceres CLONE 1580126
  misc_feature: Encodes the peptide sequence at SEQ ID NO. 91661
  misc_feature (14)..(14): n is a, c, t, g, unknown, or other
  misc_feature (66)..(66): n is a, c, t, g, unknown, or other
  misc_feature (67)..(67): n is a, c, t, g, unknown, or other
  misc_feature (1113)..(1113): n is a, c, t, g, unknown, or other
  misc_feature (1192)..(1192): n is a, c, t, g, unknown, or other
tactcaaaaaaccnccccctgtgggtagggcatagagggaagagaaaaataatgttttgttttatnngttcaaagctggactccccgcggtggcggccgctctagaactagtggatcccccgggctgcaggaattcgtctcacccctagaaaaacttctgaaccctacccgactccgccgccgctccgccgccgctccgcctcagcgcatcgccctccgccacagcgtaccgcgacctcatcgatcaccttcaactttcaatcatggcggacgtcgatgtcgaaccggaagttgccgccggcgctcccaagaagaggaccttccgcaaatacagctaccgcggcgtcgacctagatgcacttctcgacaagtccacggacgaccctcgcgcagctctaaccccgcgcgcgccacggagaacgatccagaggggtctgaaatagaaacccatggtgatcatcaataatgctgcggaaggcgacaaaggatgcatcctgctggcgaaaaagaccagagccaatcaagaacgccccgtccgggaaacatgaatcatgtggtcacctgaacacgaatttggggagccgtttggctggggtgatcccaacaaacgaaagaaggaactattccagccgccaaggttttgtacgatccccacctccccgggtaacattgtgattgagtgcccaacaggaccacctggcagataaaaagagtgatcccgcaagactcagccacctatgtttaaaatcagcaccggttccaacaagttgatatatgcgtgcgtatgagagttccgataaaatatattcaaatatataagtaaataatacaaaacaacacaaaaaattaatcgactcataacggcgggatacaatgattaattacgccgctgcgccaaacaagaaaatcaaacaacacggtgcggaatgaaacacagaactgtgacagtgactcgttgggtggaggccctctctaccctacccgtacttctgttcccaactcacgggggcgatcgcgagacatatacacccacaacaacaacgaagaggatcttatctggcaatcgctggacatgtactgggtgacagacgcacgcagagggcacatagtagnctaacaacgacacggtctctgatcgacgagtggtgagaagtcgagcgattcgctcacgatagatataagagaagtgtancagacgaggacgcctgagagagacagtggagggctgcgcctgataacgtaccttattttagcgcgtcagagcgacacagcaaa

SEQ ID NO: 91661 - protein, 59 aa, Zea mays
  misc_feature: Ceres CLONE 1580126
MADVDVEPEVAAGAPKKRTFRKYSYRGVDLDALLDKSTDDPRAALTPRAPRRTIQRGLK

SEQ ID NO: 91662 - DNA, 810 bp, Zea mays
  misc_feature: Ceres CLONE 1580131
  misc_feature: Encodes the peptide sequence at SEQ ID NO. 91663
tggagctccccgcggtggcggccgctctagaactagtggatcccccgggctgcaggaattcgtctcacccctagaaaaaagtaccacaccactccgcgctagctgaggacggtacagcggcacagaggtgcgacgtacgacgacgacgacgcaggcgccacacatggcatcccagctctccgccgccgtgccccggttccacggcctccggggctacgccgcgcccaggtccgcggtggcagcgctgccgtccgtgagggtgggcaggaagaggtcgtcgtcgcagggcatccgctgcgactacatcggctccgccaccaacctgatcatggtgacgacgacgacgctgatgctgttcgcggggcggttcgggctggcgccgtcggcgaaccgcaaggccaccccttggctgaagctggaggcgcgcgactccggcctgcagacgggtgaccccgccgggttcaccctcgccgacacgctggcctgcggcgccgtcggccacatcctcggcgtcggcatcgtgctcgggctcaagaacaccggcgccctcgaccagatcatcggctagatccctacgtcgtcgttgttaagatcagactcagcagcctcgatcgcgccgccggccggcaggtgcctgcaggtggtgactttgtaacgtgtgtgcgtgcgtacgtgtacattgcatccatcttggttcccatggaaatatagctccctgtggctcctctaaaaaaaaagggggcagctgcccatcccagtaacaggtgggggcgactggggccgaggccaagccaagggatttccacccgc

SEQ ID NO: 91663 - protein, 134 aa, Zea mays
  misc_feature: Ceres CLONE 1580131
  misc_feature (49)..(129): Pfam Name: PSI_PSAK Pfam Description: Photosystem I psaG / psaK
MASQLSAAVPRFHGLRGYAAPRSAVAALPSVRVGRKRSSSQGIRCDYIGSATNLIMVTTTTLMLFAGRFGLAPSANRKATPWLKLEARDSGLQTGDPAGFTLADTLACGAVGHILGVGIVLGLKNTGALDQIIG

SEQ ID NO: 91664 - DNA, 871 bp, Zea mays
  misc_feature: Ceres CLONE 1580136
  misc_feature: Encodes the peptide sequence at SEQ ID NO. 91665
  misc_feature (768)..(768): n is a, c, t, g, unknown, or other
ctggagctccccgcggtggcggccgctctagaactagtggatcccccgggctgcaggaattcgtctcacccctagaaaaagggattgtagttcaattggtcagagcaccgccctgtcaaggcggaagctgcgggttcgagccccgtcagtcccaacgaccaaccaggccatcaccgcgctgaagctgctaagggagaacagggacatgttcgatctggtcatcagcgacgtgcacatgcccgacatggacggattcaagctccttgagcttgtagggcttgagatggacctacctgtcatcatgttgtcagtgaacggggagacgaaatccgtgatgaaggggataacccatggcgcctgcgactatctcctgaaacccgtccgcatcgaagagctaaggaacatatggcagcacgtcgtcaggaggaagttcagcaagcgagagcgcagcaaccttgacgtctacaaagatttcaacaggctgccaggcgcggatccatgccacagccacggccacggccacggccagaccactgccggggcttccgaccagagcgggaggatcggcaggaagaggaaggaaatgcacagcgacgaggaggacgacggcgaggagaacgatttccaggagggcgacgagccctccgcggctaagaagccgagagtcgtctggtcgattgagctgcaccggaaattcgtcgcggccgtcaaccagcttgggattgataaagctgttccgaaaaggggatctgaggctatgaaatgtgnagaactcaccagggaaaatgtcgcgagccatctacagaaatacaggctctatctgaaaacggtaagtgctgtggcatcacagcagctagcattgtcgccgcat

SEQ ID NO: 91665 - protein, 222 aa, Zea mays
  misc_feature: Ceres CLONE 1580136
  misc_feature (153)..(203): Pfam Name: Myb_DNA-binding Pfam Description: Myb-like DNA-binding domain
  misc_feature: SWISSPROT Homolog: EC 3.1.1.61 Protein-glutamate methylesterase
  misc_feature (188)..(188): Xaa is any aa, unknown, or other
MFDLVISDVHMPDMDGFKLLELVGLEMDLPVIMLSVNGETKSVMKGITHGACDYLLKPVRIEELRNIWQHVVRRKFSKRERSNLDVYKDFNRLPGADPCHSHGHGHGQTTAGASDQSGRIGRKRKEMHSDEEDDGEENDFQEGDEPSAAKKPRVVWSIELHRKFVAAVNQLGIDKAVPKRGSEAMKCXELTRENVASHLQKYRLYLKTVSAVASQQLALSPH

SEQ ID NO: 91666 - DNA, 797 bp, Zea mays
  misc_feature: Ceres CLONE 1580137
  misc_feature: Encodes the peptide sequence at SEQ ID NO. 91667
gagctccccgcggtggcggccgctctagaactagtggatcccccgggctgcaggaattcgtctcacccctagaaaaagaccacacggcacctggcactgccagcctcgtcgcgcacggcctatatatccccagtctcttcatctgcagcgacaaaaataggaaccgagcaaaggtctggcgagctaccaataaactaccatctccacaaacaggccagcacgtagctatatgccagaactgacctagctagtagaggatcgatcgcagatggtgtttcctgccatcctccccaaggtggccgcacgatggctcttcacgttctaccgcgccgccagaaagctcaggcgccacgccttccagctctactaccgcaacactaccgccgccaagccgtcccccgccgccgccgccgccgtctcgcagcaacagaccggggccgccgccactgccgccttgaagaccggggccgccatccctgacgccgccggccggaccgttgtgtgcgagatgcacggcgccctgctgcgctccaccgcgctcttcccctacttcatgctcgtggcctgcgagggcggcagcctcgtccgcgccatgctgctgctctgcgccttccccctcgtctgggcgctcggggagcgccgcggcgccggcgtccgggtgatggcgttcgtcaccttcgcggggctcaagcccagagacgtggaactcgtggcccgcgccgtcctgcccaagcactacatggagcagctcagcgcgctggcgtacagcaaccctctgggctcccggccaggaggaa

SEQ ID NO: 91667 - protein, 176 aa, Zea mays
  misc_feature: Ceres CLONE 1580137
  misc_feature: SWISSPROT Homolog: EC 2.3.1.15 Glycerol-3-phosphate O-acyltransferase
MVFPAILPKVAARWLFTFYRAARKLRRHAFQLYYRNTTAAKPSPAAAAAVSQQQTGAAATAALKTGAAIPDAAGRTVVCEMHGALLRSTALFPYFMLVACEGGSLVRAMLLLCAFPLVWALGERRGAGVRVMAFVTFAGLKPRDVELVARAVLPKHYMEQLSALAYSNPLGSRPGG

SEQ ID NO: 91668 - DNA, 984 bp, Zea mays
  misc_feature: Ceres CLONE 1580138
  misc_feature: Encodes the peptide sequence at SEQ ID NO. 91669
  misc_feature (777)..(777): n is a, c, t, g, unknown, or other
  misc_feature (840)..(840): n is a, c, t, g, unknown, or other
  misc_feature (952)..(952): n is a, c, t, g, unknown, or other
ctggagctccccgcggtggcggccgctctagaactagtggatcccccgggctgcaggaattcgtctcacccctagaaaaaaccaactcacatgcacacctcaccttccactccagaagaagaagccagaccggaatcccgagagccctgcccctgctccctcggttcctcctccgttgggcgtttggccgccgggggtggtgggccgagaccgagatgatatcgtggaacgatgtatacacggtgctgaccgcgatggtgcccctgtacgtggccatgttcctggcgtacgggtcggtgcggtggtggcgcatcttcacggcggaccagtgctccggcatcaaccgcttcgtggccatcttcgccgtgccgctgctgtccttccacttcatctccaccaacgacccgtacgccatgaacctccggttcctggccgcggacacgctgcagaagctggtcgtcctcgcggggctggccgcgtgctcgcgcctgccctccaggctggcggcgccgcggctggactggtccatcacgctcttctccgtgtcgacgctgcccaacacgctggtgatgggcatcccgctgctgatcgccatgtacggtccctacgccgggtccctgatggtgcacgtggtggtgctccagtgcatcatctggtacacactgctgctgttcctcttcgagttcgcgccgcgcggacactcatcgcggaccagttcccggacaccgcggcagccatcgagtcgctgcacgtggacccggacgtgctgtctctggnaggcgggcgcgactagaccgacgccaagctgcagaggacggccgctgcaatgacagtgccccngtcgtcggcgtcccggcggtccctgctgatgacacgacgcggccgtcccactgacgagcgcggataatactcgagagctcctcgcgcagccatccccgcgaggtcaacttgnacagccgacttgttctcttggtcgagggccgc

SEQ ID NO: 91669 - protein, 204 aa, Zea mays
  misc_feature: Ceres CLONE 1580138
  misc_feature (9)..(204): Pfam Name: Mem_trans Pfam Description: Membrane transport protein
  misc_feature (188)..(188): Xaa is any aa, unknown, or other
MISWNDVYTVLTAMVPLYVAMFLAYGSVRWWRIFTADQCSGINRFVAIFAVPLLSFHFISTNDPYAMNLRFLAADTLQKLVVLAGLAACSRLPSRLAAPRLDWSITLFSVSTLPNTLVMGIPLLIAMYGPYAGSLMVHVVVLQCIIWYTLLLFLFEFAPRGHSSRTSSRTPRQPSSRCTWTRTCCLWXAGATRPTPSCRGRPLQ

SEQ ID NO: 91670 - DNA, 908 bp, Zea mays
  misc_feature: Ceres CLONE 1580139
  misc_feature: Encodes the peptide sequence at SEQ ID NO. 91671
  misc_feature (718)..(718): n is a, c, t, g, unknown, or other
  misc_feature (743)..(743): n is a, c, t, g, unknown, or other
  misc_feature (745)..(745): n is a, c, t, g, unknown, or other
  misc_feature (747)..(747): n is a, c, t, g, unknown, or other
  misc_feature (748)..(748): n is a, c, t, g, unknown, or other
  misc_feature (811)..(811): n is a, c, t, g, unknown, or other
  misc_feature (832)..(832): n is a, c, t, g, unknown, or other
  misc_feature (908)..(908): n is a, c, t, g, unknown, or other
ctggagctccccgcggtggcggccgctctagaactagtggatcccccgggctgcaggaattcgtctcacccctagaaaaagttaccctattctttctgctcaacttggcctcacgcacgatagccgccgccgtcgaccagagcactcccccctcgtcgccacgatgtcgtcggagcctccacccgcctcctctgccgccgccggagaggaactcgctgctgacctttccgccgctaccctcagcaagaagcagcagaagaaggacgcgaggaaggcggagaaggcggagcagcgccagcgccagcagcagcagcagcagcagccggccgacgccgaggacccgttcgcggccaactacggcgaggtccccgtcgaggagatccagtcaaaggccatctccggccgctcgtggtcccatgtcggcgacctcgacgactccgctgcgggccgctccgtgcttatccgcggagccgcgcaggccatccgtccggtcagcaagaagatggctttcgtcgtgctgcgccagagtatgagcaccgtgcagtgcgtgctcgtcgctagcgccgacgccggcgtcagcacgcagatggtgcgcttcgccaccgccctcagcaaggagtccatcgtcgacgttgagggcgtcgtatccctcccaaaggagcccctcaaggccaccacacagcaggttgagatccaagtgaggaagatctattgcatncatagggctattccgacccttccantnanncttgagatgcggctcggaagtgagcagattttgagaaggctgaattggctggagaaaagctgntcgcgttggcccagaaccccngctgactacagagctattgatctacgacaccctcgaaccagccatattccggatcagtgtcaagtgaaacaatttn

SEQ ID NO: 91671 - protein, 248 aa, Zea mays
  misc_feature: Ceres CLONE 1580139
  misc_feature (98)..(185): Pfam Name: tRNA_anti Pfam Description: OB-fold nucleic acid binding domain
  misc_feature: SWISSPROT Homolog: EC 6.1.1.12 Aspartate--tRNA ligase
  misc_feature (185)..(185): Xaa is any aa, unknown, or other
  misc_feature (194)..(194): Xaa is any aa, unknown, or other
  misc_feature (195)..(195): Xaa is any aa, unknown, or other
  misc_feature (216)..(216): Xaa is any aa, unknown, or other
MSSEPPPASSAAAGEELAADLSAATLSKKQQKKDARKAEKAEQRQRQQQQQQQPADAEDPFAANYGEVPVEEIQSKAISGRSWSHVGDLDDSAAGRSVLIRGAAQAIRPVSKKMAFVVLRQSMSTVQCVLVASADAGVSTQMVRFATALSKESIVDVEGVVSLPKEPLKATTQQVEIQVRKIYCXHRAIPTLPXXLEMRLGSEQILRRLNWLEKSXSRWPRTPADYRAIDLRHPRTSHIPDQCQVKQF

SEQ ID NO: 91672 - DNA, 762 bp, Zea mays
  misc_feature: Ceres CLONE 1580140
  misc_feature: Encodes the peptide sequence at SEQ ID NO. 91673
  misc_feature (294)..(294): n is a, c, t, g, unknown, or other
  misc_feature (323)..(323): n is a, c, t, g, unknown, or other
tccccgcggtggcggccgctctgaactagtggatcccccgggctgcggaattcgtctcacccctagaaaaactccaaccaaacgagctgctagcccttctaaccttgctcgacccttgcccgccgcctgaactcgcctcccccgcggccggtcccctgcatctgttcgccgcgccgcaacccggaggagactacgactacgagcaccaccaggtagcagcaactgttttgctgcaatctgacaaagtggagggtttaagagtcgctgcttcttttatgtctgaacaatctttgncttattttggattgctgggagagtattcntgcgcgacgagaaaaaggcacaagtttctggctccctgcatgcatcaagaggccatccgggtttcattggtcctgagggggcattccctaggggtccaagcccggctgggtttccccgaaaaaacacgcgccccccccttgattcagggaatttggtcccccccgaaaagccccccgttttaaaccacttttttttccaaaaggggggcccgcgaaaaaacattgggggggctccaaaaaggggggggaagggcgcccctctcccgggggaacaaaaaagcccccccagaatgtgttttccccccaaaaaaaaaagggggggcgggggtttattggtggttcaccaaaaaccaaaaatttttgggggaaaaacaggggggtgaaaataaaccccaaaaaaaaaattttttttttgggggggggggggggggggtgtctt

SEQ ID NO: 91673 - protein, 76 aa, Zea mays
  misc_feature: Ceres CLONE 1580140
  misc_feature (7)..(7): Xaa is any aa, unknown, or other
MSEQSLXYFGLLGEYSCATRKRHKFLAPCMHQEAIRVSLVLRGHSLGVQARLGFPEKTRAPPLIQGIWSPPKSPPF

SEQ ID NO: 91674 - DNA, 1270 bp, Zea mays
  misc_feature: Ceres CLONE 1580141
  misc_feature: Encodes the peptide sequence at SEQ ID NO. 91675
  misc_feature (1123)..(1123): n is a, c, t, g, unknown, or other
tttttctcgttactttccttttttttatcactttctgtccttttgcattcattttacccttttattaaagctgggactccaccgcggtggcggccgctctagaactgtggatcccccgggctgcaggaattcgtctcacccctagaaaaaggggagaaaaaacagaggaggaaaaaaacacccaaaaaaccaccttcttttcctgcgttcccctgctcgatccccgacgaggaattcgctcccgaacccatcgatctgctctccgcagtccgccgatccgtggatcgatccgtgcgcgggctcggtccgccccgggttccgatctggtcgccgcctcgcctgaggagatgaacggcgccgggggcagccaccaccagcagcagcagaggctccggcagcagcagcagcaggcgctcctgatgcatcaggcgctgcatcagcagcagcagcagcatcagtaccagtccggcgtcctcgccgcggcggcggcggcggccatgacccagatggaacctgtttccaatggcaaccttccacctgggtttgatccttccacttgtcgcattgtgtatgtccggaaatgtaaaccctaatgccacggcacagccctttagatttgaagttcttccgaaaacgctgggcctttggtgaaaagactcctagctccatccgggtaagaaaaattctttccgtttggggtcaggtgggactacttcaggtttcttagcaattttgctgaggtttttagtccgatccctctatctcttatccaatgtaagtgtgtttaattttgttcttgagattacaaggtgaataccgcttgggcgctcgatctatggcggcgttataatgttggtcatagaatcactggtacgttattggtaaagacaatatacacttggttgttgtgcccctattcatctccatacacatgtactgtgccgatactgcgaatgttttattcacacagatatgcgttgtcaagttgttttatttgcccgctattcatttttttttcgccttgttttacatgcgttgtattagaatgcaacactccgttctatacgggtatgtgactgccgatgtcgcattacacgctatatgagggggagtagatatccgntaacatctgtagatccaagcctccacttcgatgtttcttatgtgcactgtattacgcttctagacagcacagtcttacatatagtgatacgctgaaagaaccttgttttgtctaaggagaaaatgatcatagctttaatatacttgg

SEQ ID NO: 91675 - protein, 81 aa, Zea mays
  misc_feature: Ceres CLONE 1580141
MNGAGGSHHQQQQRLRQQQQQALLMHQALHQQQQQHQYQSGVLAAAAAAAMTQMEPVSNGNLPPGFDPSTCRIVYVRKCKP

SEQ ID NO: 91676 - DNA, 898 bp, Zea mays
  misc_feature: Ceres CLONE 1580142
  misc_feature: Encodes the peptide sequence at SEQ ID NO. 91677
  misc_feature (865)..(865): n is a, c, t, g, unknown, or other
ctccccgcggtggcggccgctctagaactagtggatcccccgggctgcaggaattcgtctcacccctagaaaaagttaccctattctttctgctcactttggcctcacgcgtgataggcgccgccgtcgatcagaggactcccccctcgtcgccgcgatgtcgtcggagcctccacccgcctcctctgccgccgccggagaggaactcgctgctgacctttccgccgctaccctcagcaagaagcagcagaagaaggacgcgaggaaggcggataaggcggagcagcgccagcgccagcagcagcaccagcagcagccggccgacgccgaggacccgttcgcggccaactacggtgaggaccccgtcgaggagatccagtcaaaggccatctccggccgctcgtggtcccatgtcggcgacctcaacgactccgctgcgggccgctccgtgcttatccgcggagccgcgcatgccatccgtccggtcagcaagaagatggctttcgtcgtgctgcgccagagtatgagcaccgtgcagtgcgtgctcgtcgctagcgccgaggccggcgtcagcacgcagatggtgtgcttctctaccgccctcagcaacgagtgcatcttcgacgatgagggcgtcgtatccctctcaaggatcccctgaggtcaccacacagcaggttgagatcctagtgaggaagatctattgcctctaaagggctacttccgacccgttccaataacctttgaagaggccgctctcgactggggcacattttttattagggctaacattggctcgaagcaaaaccatggttcctgttccgccacaaaaaccctccttggaccttgcaagttttttggttcntacttaataaccctccgaaccaaagcccttatt

SEQ ID NO: 91677 - protein, 167 aa, Zea mays
  misc_feature: Ceres CLONE 1580142
  misc_feature: SWISSPROT Homolog: EC 6.1.1.12 Aspartate--tRNA ligase
MSSEPPPASSAAAGEELAADLSAATLSKKQQKKDARKADKAEQRQRQQQHQQQPADAEDPFAANYGEDPVEEIQSKAISGRSWSHVGDLNDSAAGRSVLIRGAAHAIRPVSKKMAFVVLRQSMSTVQCVLVASAEAGVSTQMVCFSTALSNECIFDDEGVVSLSRIP

SEQ ID NO: 91678 - DNA, 842 bp, Zea mays
  misc_feature: Ceres CLONE 1580144
  misc_feature (270)..(270): n is a, c, t, g, unknown, or other
  misc_feature (279)..(279): n is a, c, t, g, unknown, or other
  misc_feature (280)..(280): n is a, c, t, g, unknown, or other
  misc_feature (342)..(342): n is a, c, t, g, unknown, or other
  misc_feature (353)..(353): n is a, c, t, g, unknown, or other
ctggagctccccgcggtggcggccgctctagaactagtggatcccccgggctgcaggaattcgtctcacccctagaaaaaactcctatccatccatctcttccccacgcacacaacaaaagatctcagagccacacagcgagcgcgagcgagaggcgcgctgttgcggaaatgccgctcccggcgttcctggcggcggcggcgaggctcgccgtcctgctggccgccgccgtgactgcggccaacgcggtctccttcgcgcgctaccggngcgccaccnntcgcgcatccccaacccatcgacgagtccgccgacccccgtcgcgaatttcggggccttcgncccggcttggncgaagacgccgccaaagattacagcttttttcttttggcttacgaccggcccgggcattgtggaggacgggttggaaaaaccttgggcttcatttttcgggggaaacctccctccaaaccaaggggggcctttgcgccccccttaaaaccaaaaaggggggggatgcgcccccccctccggggaaaaggggggccccatggggttttccccagggcccccccaaaaggggaaataaaaagggggtgggggtgaaaaaatttttaaacccccctttttacttccccggggagggaccccccggggggggttaaaaatatttctccggggggggggggcatattttctttccggcggggggggagaaaaaaaaacacaaccacaccggggggggaagaaacaccccccctccccacccaaaaaaagaagtaattttttcttcctcccccccccctaggagtccactcccacgcggggggggggggggtttt

SEQ ID NO: 91679 - DNA, 1266 bp, Zea mays
  misc_feature: Ceres CLONE 1580145
  misc_feature: Encodes the peptide sequence at SEQ ID NO. 91680
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
tatttcctctctctgctcctctttctcccacaactctccttctcccttccnnnnccttttttttttaaaactggagctcaccgcggtggcggccgttctagaacagtggatcccccgggctgtttgaattcgtctcacccctagaaaaaatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcataagaccgtctagctcaagcctgactgggccaagggctactcccgcctcagcgcggcgcacctcggcctcggcgacgccgccagcgccgtcgccgcatacgagaagggccttgcgctcgaccccagcatcgaaagtctctaggcggcggctcgaagacgccctttatgcctccgtccgccccgccgcgtcgtcgggtctgtccggtccccgtacgccattctggccaagatgtttccaagggcccccgtaatttgtggaatcaaagaaccgccgtccctgaaccccctctattacgccgtcctttacccttttaaacgaaggcccccaaacttttttatcgccaacatatgcccttggcggcccttaatgttggcccattatatggaaaatcccctcagagcgccatgtccctatcccatatcctaaagtgtgttatcccctctctttcccccgtaattataccccccccagcagatggtaataggccacccaggtgggactatatcaaagtacacatctaaaggtgcgcatcatatatattgttacaacagaaaacttcatatcaacacatctctctgtagtgggcctctcttcctgttaatcaccattttcggctatggtgttatttaccccgcaatcccagttcgctatcagttctcgtctacgccatatccgttcaccgacattacccaatgacacattcttctcttcctctttcatatacaacacataagcccctatatatattatgtgcgaatacaccggataactcaccctgaactactcagagacctgtgctaggaatactctcaccgcgctatgtaagaaaataatagatgtgcccttgagggt

SEQ ID NO: 91680 - protein, 63 aa, Zea mays
  misc_feature: Ceres CLONE 1580145
  misc_feature (2)..(35): Pfam Name: TPR_2 Pfam Description: Tetratricopeptide repeat
  misc_feature: SWISSPROT Homolog: EC 3.1.3.16 Phosphoprotein phosphatase
MADEAKAKGNAAFSAGRFEEAARHFTDAIALAPGNHVLYSNRSAALASLHRYSDALADAHKTV

SEQ ID NO: 91681 - DNA, 886 bp, Zea mays
  misc_feature: Ceres CLONE 1580146
  misc_feature: Encodes the peptide sequence at SEQ ID NO. 91682
  misc_feature (396)..(396): n is a, c, t, g, unknown, or other
ccccgcggtggcggccgctctagaactagtggatcccccgggctgcttgaattcgtctcacccctagaaaaaactcctcatcagccatccccaaaaggccaaaacccgcgcacaccggcgacggccggagaacctcctgccggccgccgccatgccgccgcctctacaggcccaccgcctactcatctcccaccgccacctacccactccagctcgccgccggttcaccgccgcctcttccgtccaatccgctcccaccacaaccttggccccgggccccgccacatcctacatcctctccatccgcgagtcgctcctctcaagagagaggaccgcggcggacatcacctccgagtacctctcccgcctccgccgtaccgagccgaccttgcgcancttcatccacgtcgcggacaccgccgccgaacgggaggcgggagaactcgaccggaagaattgctcccgggagaaagatgcggtgggtccgctcgctggagtcgcggcgggagtgaaagacaatcctttgcacagccaacatggcccccccacgggggggtcgccggattcctgggaggggtaccggggcgggcgttacaaccccacctgcccatgccggggggctgtccgggaggaccggaccccatttttggtgtggggaaaaacaaaacccccaacgaaatttcggaaaggggggaacaccccccgaaagggcctcccccgttttccaggggaacaacaaaacccccgggggaatgaaattccaaggttgggccgggaggggaaacacccctggagggggtttaagagcgtgccgcgcaattatcctgggatgaggggaaagcccggggggggtgcccccgagagaaaggggcaccccaccgggtgg

SEQ ID NO: 91682 - protein, 245 aa, Zea mays
  misc_feature: Ceres CLONE 1580146
  misc_feature (82)..(82): Xaa is any aa, unknown, or other
MPPPLQAHRLLISHRHLPTPARRRFTAASSVQSAPTTTLAPGPATSYILSIRESLLSRERTAADITSEYLSRLRRTEPTLRXFIHVADTAAEREAGELDRKNCSREKDAVGPLAGVAAGVKDNPLHSQHGPPTGGSPDSWEGYRGGRYNPTCPCRGAVREDRTPFLVWGKTKPPTKFRKGGNTPRKGLPRFPGEQQNPRGNEIPRLGREGKHPWRGFKSVPRNYPGMRGKPGGGAPERKGHPTGW

SEQ ID NO: 91683 - DNA, 810 bp, Zea mays
  misc_feature: Ceres CLONE 1580147
  misc_feature: Encodes the peptide sequence at SEQ ID NO. 91684
ctccccgcggtggcggccgctctagaactagtggatcccccgggctgcaggaattcgtctcacccctagaaaaaatcttcctcgcaacgccgacgctgcaacttccgctccctccccgactcgcgctcggcacgcaggcaggcgactgcggtggcgctcaggctcgggctctcagcaacggcggggttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatgggcattggcaagggtggggtattgccatggaagcttcttggtgatcttaaattcttcaaagaacttacactaactacaactgatcctgccaaaaagaatgcagttataatgggaaggaaaacatgggagagcattccctgtaagtcaaggccactgcctggtcgttttgatgtcatacttactcgatctggtagttttgattttgcaacagtagagaatgggtgtatatgtggaagtatgaaatctgccttagagctgctagcatcaactccatactgcttatcaattgagaaagtttttgtcataagaggtgggcaagtactgagagattatttgaatggacctgcatgtgaaggctttcatctgactgaaaattcatccaagcattgaagtgggaaactttccctcccctccagtggactcc

SEQ ID NO: 91684 - protein, 159 aa, Zea mays
  misc_feature: Ceres CLONE 1580147
  misc_feature (19)..(158): Pfam Name: DHFR_1 Pfam Description: Dihydrofolate reductase
  misc_feature: SWISSPROT Homolog: EC 1.5.1.3 Dihydrofolate reductase
MALTAAPASGDSQSGPQRNYQVVVAATCDMGIGKGGVLPWKLLGDLKFFKELTLTTTDPAKKNAVIMGRKTWESIPCKSRPLPGRFDVILTRSGSFDFATVENGCICGSMKSALELLASTPYCLSIEKVFVIRGGQVLRDYLNGPACEGFHLTENSSKH

SEQ ID NO: 91685 - DNA, 821 bp, Zea mays
  misc_feature: Ceres CLONE 1580155
  misc_feature: Encodes the peptide sequence at SEQ ID NO. 91686
  misc_feature (391)..(391): n is a, c, t, g, unknown, or other
  misc_feature (411)..(411): n is a, c, t, g, unknown, or other
  misc_feature (494)..(494): n is a, c, t, g, unknown, or other
  misc_feature (498)..(498): n is a, c, t, g, unknown, or other
  misc_feature (529)..(529): n is a, c, t, g, unknown, or other
  misc_feature (561)..(561): n is a, c, t, g, unknown, or other
  misc_feature (635)..(635): n is a, c, t, g, unknown, or other
  misc_feature (636)..(636): n is a, c, t, g, unknown, or other
  misc_feature (647)..(647): n is a, c, t, g, unknown, or other
  misc_feature (751)..(751): n is a, c, t, g, unknown, or other
ggagctccccgcggtggcggccgctctagactagtggatcccccgggctgcaggaattcgtctcacccctagaaaagttcacgtcttcctcctcgcgttcctctcgtcagtacggcgacgccgcaaggctcgcaccgctgacagtcccccttcccggatcgagcctctcttttcccagatcggattctaattgggctatcgccgccgccgtgccaggtgccgagtccttagccgatcttcgccggcgaggagcgcccaccaggagttacagactgaatgacaagaatgttctctatatcatcctcagtatgtgtgaagaaatagtctgtaactacacatacctttcattgcaattaccagaactggaaatggacgatgataatgggcttgnagcttagtttggggctatcntttgggcgggtccatcagggaaggccaaggctagagatgcacctctagaaccaaaagcaggaaccccaagtggaagaaagcantagncaaaggtggtttacaaactcctgatgctccnttctgggaaattttatcaaaagagcgctgatnaccatgaaacaaatagtaaacagaggcacagccctgttgcaccacaattttgggaacttctggggacaaccagnngaattcctccngtccagtgggtagatgggttctgttgaaccggtgagtcatcagccctcagctttcccagtatcaagatggaaggatgccaaataacagtggaaataattctgangagcagaagccagtttcgggtaccacaagttgccttctggagagatgaactttcagaagaacatcagacc

SEQ ID NO: 91686 - protein, 29 aa, Zea mays
  misc_feature: Ceres CLONE 1580155
  misc_feature (28)..(28): Xaa is any aa, unknown, or other
MCEEIVCNYTYLSLQLPELEMDDDNGLXA

SEQ ID NO: 91687 - DNA, 664 bp, Zea mays
  misc_feature: Ceres CLONE 1580156
  misc_feature: Encodes the peptide sequence at SEQ ID NO. 91688
ggagctccccgcggtggcggccgctctagaactagtggatcccccgggctgcaggaattcgtctcacccctagaaaaactccgtcttgctcaacaccagtcaccactgctctccaagcctccaccagcgtccagccgaaccatcgccaccgcaggatggcctcccgcctcctcctccacctccacctgcgccgccgcgggcgcgggatcccgggctgccccgtgcccgcgctacccctccacgccgcgcggctcctctcctcctccccaccaaccgcagctgcgggcctcgtcgtcgagcggcgggtgcggcggggggcattcgagaagggtgctgggtgggcgaaccggggggcgaagatccgcgtgcccggggtcatggcgcaacggcggcggccggccttcggggggtcgcccccccggtgggcccggggtttacaagcgaaacccccccaaacccgcgggggggggcgcctttcccccccggtgggccccccccccccccccaaaacaaaaaaggcccccgtttaaaggggaaatttggggggcccccccccccccccccccccctttgtgggggggggggaaaaaaaaaaatttttttccccctccctaaaaaaaaaccccccccccgcgggggggggggcccccaaaaaataaacaaa

SEQ ID NO: 91688 - protein, 124 aa, Zea mays
  misc_feature: Ceres CLONE 1580156
MASRLLLHLHLRRRGRGIPGCPVPALPLHAARLLSSSPPTAAAGLVVERRVRRGAFEKGAGWANRGAKIRVPGVMAQRRRPAFGGSPPRWARGLQAKPPQTRGGGRLSPPVGPPPPPKTKKAPV

SEQ ID NO: 91689 - DNA, 865 bp, Zea mays
  misc_feature: Ceres CLONE 1580162
  misc_feature: Encodes the peptide sequence at SEQ ID NO. 91690
tggagctccccgcggtggcggccgctctagaactagtggatcccccgggctgcaggaattcgtctcacccctagaaaaaaacaaatcgacctagctaggcacaagagcgctagacgccgcagcgcagcacgcaccacccaccgagcggcggcggaggcagggcaatccgcagggagcagaggccgcgcgcgcaggcatgggcgcgccggtgcacggcgccctcgccttgttcctcctgctcctggtgggggcaggggcggcgcccgaggagacggcgccgcaggaacccacattgccagccaccggctccggcgctaccggcgcgccggcggtcggggtcaactccaactccgtgctggtggcgctgctggattcgcactacacggagctggcggagctggtggagaaggcgctgctcctgcagacgctggaggacgccgtcgggaagcacaacgtcaccatcttcgcgccgcggaacgaggcgctggagcgggacctggacccggagttcaagcgcttcctgctggagccgcccaacctcaggtcgctgcaggcgctgctgctctaccacgtcctcccctcgcgcccgccctccgactcctggcccgcgacgtcccaccccaggctgtcccggcgaggaggtcaagctccggcccccgcaatgggcgtccgaacaacgccacccgttaacgcgcccgggaagcccggtgcttctggcccccaacggggtccatcccaccggccaatcaaagcgcccctccttgggagggcgggggcttccctttgcgaaggaaggaaactttttaagacccacccggctcggcaagtgcctttattagtgggcaaatttctcctgagaaacgag

SEQ ID NO: 91690 - protein, 223 aa, Zea mays
  misc_feature: Ceres CLONE 1580162
  misc_feature (61)..(175): Pfam Name: Fasciclin Pfam Description: Fasciclin domain
MGAPVHGALALFLLLLVGAGAAPEETAPQEPTLPATGSGATGAPAVGVNSNSVLVALLDSHYTELAELVEKALLLQTLEDAVGKHNVTIFAPRNEALERDLDPEFKRFLLEPPNLRSLQALLLYHVLPSRPPSDSWPATSHPRLSRRGGQAPAPAMGVRTTPPVNAPGKPGASGPQRGPSHRPIKAPLLGRAGASLCEGRKLFKTHPARQVPLLVGKFLLRNE

SEQ ID NO: 91691 - DNA, 1008 bp, Zea mays
  misc_feature: Ceres CLONE 1580163
ctccccgcggtggcggccgctctagaactagtggatcccccgggctgcaggaattcgtctcacccctagaaaaactctcctcgcttctccctgtagagaacaggccgaggcgggcgagtgctccagtacacctcgagctacatatcccagctcgcacggtccagctctgagctccctcctctccacctccacgcccgatcgtgaatcgtcacttgctctgcaaaggcgacagcgccatctttgctgctacccattaactcaggcgggcattccgtcgagcaccttccgttcggcgccgggtggcgtggggagcgagtcctgccgggttgcttggtccgttgcgtgaacgggcgacagttgctgctttcccgggggcgctccttgatgccgctgttgtggcaggcgctgggttctagcggatggaatgcaacagctcctacgcgccaaaagtcaagaaggttcgttgccgtagctgatgtgggatttgaggatgctgtagtcggccccagcgattttggagaacacgatgaggcccccacccaaagcagatggttgtcggggaaaaccttggaaaccgaggaagaacaggaagtttggttggaaaaccaaacccggcccccctaaaaggaagaggggggattcccgttcttcccggggatggagcccccaagacgggggtttcccttggggggggaaaaccaccatgggggtgggtattggaaagggctggggaaaattcctaaccaatttgggcgggtgtgggagaaaccccttgaccccaagggggggtgtttgtttcgcggacacaaaacagagggggggaaaaaaacccttggggttttgggggggcccaaaaccaataaaagggggtttatttttacacccccccaaaaaaacacccacacttccaaaaagggggggtctccccaagagggaaaaatagttgctcagggaagagaatattgtcttcttccccccaaaaaagagagaagaaattttttttaatgg

SEQ ID NO: 91692 - DNA, 1068 bp, Zea mays
  misc_feature: Ceres CLONE 1580164
  misc_feature: Encodes the peptide sequence at SEQ ID NO. 91693
  misc_feature (68)..(68): n is a, c, t, g, unknown, or other
  misc_feature (71)..(71): n is a, c, t, g, unknown, or other
gaatgagggaagctagagatttggttgtcaaacaaatcctcgtcccccaaaaatctctcgtgcccggnatntaaaaactggagctcaccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccatttgacaacgtcaaggccaaaatccaggacaagggagggcatccctcccaaaccagcaggcggctcatcttttgctggggaagcagccttgaaggacggggcgcaaccgctttgccgaactaccacattccaggaaaggaaaagccaccccctcccacttgggtggctggcgccctcaagggggaaaggccaatgccaaaattcttttcgttggaaaaaaccccctgggaccccgggcaaaaaaactaattccccccccttctaaagggtggggaggtcctttccaaaaacacccatttcgaaaaaaaccgttcaagagggcccaaaaaatccccgcggaacacagagggagggggaaatttcccccccagaaaccaaacaaagggggctccaattatttatgcccggaaaaaaacacctctttataggaaccggggcgccaacccctttggcccgaaattacacaacatttcaaaaaaggggaagaaccaccccccccacctctggggtccgtcccccccccagggggaaaggactt

SEQ ID NO: 91693 - protein, 99 aa, Zea mays; identical to SEQ ID NO: 66107
  misc_feature: Ceres CLONE 1580164
  misc_feature (6)..(74): Pfam Name: ubiquitin Pfam Description: Ubiquitin family
  misc_feature: SWISSPROT Homolog: EC 3.1.2.15 Ubiquitin thiolesterase

SEQ ID NO: 91694 - DNA, 827 bp, Zea mays
  misc_feature: Ceres CLONE 1580169
  misc_feature: Encodes the peptide sequence at SEQ ID NO. 91695
  misc_feature (639)..(639): n is a, c, t, g, unknown, or other
  misc_feature (717)..(717): n is a, c, t, g, unknown, or other
ctccccgcggtggcggccgctctagaactagtggatcccccgggctgcaggaattcgtctcacccctagaaaaagctacaagtcatctcgccgcaaccgcaacccgcagccatggggacggaggcggagcagccggacatggacagccaccgaaacgacggcgtcgtggtggtgccagcgccgcgcccgcgtaaggggctcgcctcctgggcgcttgacctgctcgagtccctcgccgtgcgcctcggccacgacaagaccaagccgctccactggctctccggcaacttcgcccccgtcgtcgaggagaccccgccggccccaaaccttaccgtccgcggacacctcccggagtgcttgaatggagagtttgtcagggttgggcctaatccgaagtttgctcctgttgcggggtatcactggtttgatggagacgggatgattcatgccatgcgtattaaagatggaaaagctacctatgtatcaagatatgtgaagactgcccgcctcaaacaagaggagtattttggtggagcgaagtttatgaagattggagacctgaagggattttttggattgtttatggtcccaatgcagcaacttcggaaaaaattcaaagtcttggattttacctatggnatttggacagctaatactgcacttatatatcatcatggtaaactcatgggcttgtcagaagcgataagccatatgttngttagggtcttgaaggatggagactgcagactcttggcttgttggattatgacaaaaggtgaaacattctttcactgccccatcaagggttggacctttttacagatgaa

SEQ ID NO: 91695 - protein, 238 aa, Zea mays
  misc_feature: Ceres CLONE 1580169
  misc_feature (43)..(238): Pfam Name: RPE65 Pfam Description: Retinal pigment epithelial membrane protein
  misc_feature: SWISSPROT Homolog: EC 1.13.11.51 9-cis-epoxycarotenoid dioxygenase
  misc_feature (202)..(202): Xaa is any aa, unknown, or other
MGTEAEQPDMDSHRNDGVVVVPAPRPRKGLASWALDLLESLAVRLGHDKTKPLHWLSGNFAPVVEETPPAPNLTVRGHLPECLNGEFVRVGPNPKFAPVAGYHWFDGDGMIHAMRIKDGKATYVSRYVKTARLKQEEYFGGAKFMKIGDLKGFFGLFMVPMQQLRKKFKVLDFTYGIWTANTALIYHHGKLMGLSEAISHMXVRVLKDGDCRLLACWIMTKGETFFHCPIKGWTFLQM

SEQ ID NO: 91696 - DNA, 1235 bp, Zea mays
  misc_feature: Ceres CLONE 1580170
  misc_feature: Encodes the peptide sequence at SEQ ID NO. 91697
  misc_feature (54)..(54): n is a, c, t, g, unknown, or other
  misc_feature (55)..(55): n is a, c, t, g, unknown, or other
ggtgcggtgttcctttctccttttgtctcgctcttcgggctctttcccataacnncccctttaaagtgggactacccgcggtggcggccgctttttaatagtggatccccccggctgcttgtttggtctcacccctagaaaaaaagaaacgcctctcgatcgatgcacgccgccgcgacccatcgcgacctgacccgaccctcccgaggccggcagagttatgtgtctcaggctccgcctcccgccgtcccccgcgacccatcgccagcgcgagtagaagacatgtcctcgacgttcggtgcgcaccttctacagttggcgtcatggctggtccagcggggaagaatgtgcgcctccataggagggctcacttcggagcaacagcgggtaaggagtctgcacattcccttggaggggtctgcgttgacgatagctccctactggggttttccatctcggccatatctttcccactttcgctcgccccctaacggaaggaatgtcctttgtggaaaaacaaatactggcccctcccacgatttctttcccattggcgtttcccgctgtgagcaaaagtgttagctgtggagggacccctggggggaaacgttgggacccccaatttgtgtttcgggtcacccgcccagctgtgtggcaacgaatccttgtcttggaagagggggacaacccaccctcgtggtggaccctttgtctagggggacccacacctgtcttaagagcggttctatagcccgcgaatcaatcctttctcccatatatcccgtcctctggaatttttttcgaggttactttcgagaagacaaccctttgtatgtccacgtttttgaaaaaaatcacttgtcaacgttcttccgattaaggcgcctatagaacacctttgtgcctccctggtttaacactcgtccctttttgttcgcggtagttttctcacttttgtggcgagcttattttgtctccacctcgccttgtctctgagttctttgaccctttttttgttcgccgcgtaagtctcctcctgctcccacttaggggaatacttgcttaatacctctgtgcgtaccacgctcaccgcgcttttttgtggccttggttcatgcccacccgctccccccgtgtttaatctcacttttgcgcctgttttatgcactgagagtagtagataatcgtggtgtcgctgttcgtcaattccgcgtgtcctccccttgtagagcgtt

SEQ ID NO: 91697 - protein, 55 aa, Zea mays
  misc_feature: Ceres CLONE 1580170
MAGPAGKNVRLHRRAHFGATAGKESAHSLGGVCVDDSSLLGFSISAISFPLSLAP

SEQ ID NO: 91698 - DNA, 1089 bp, Zea mays
  misc_feature: Ceres CLONE 1580172
  misc_feature: Encodes the peptide sequence at SEQ ID NO. 91699
  misc_feature (1047)..(1047): n is a, c, t, g, unknown, or other
aaagctggagctccccgcggtggcggccgctctagaactagtggatcccccgggctgctggaattcgtctcacccctagaaaaaatccaccatccttcttcttccctggccacggccgccaaacagcagtcaacaccaaccgcccccaccccacccccacccccacccactcttctgatcttctccatgtgccgcctccgtctcctcctccgccccatctcgcggcctcatctccatccccttccgcctcccatgtgccgcctccgtctcctccttcccttcttcctcctcctccgccccatcccacacgcgtcccaaccggccgccccctctccggcgctgcaatgcgctctcaacttaacggcgctgctccccttcctcgcgccggtggtgccgtccgaagaaccctcccgctgcgcggttggccacccagtcccgtcaccttttctcctcttggcttcaacttcgggggcaaaatccttcccttgttggttcccaaccccaaggccccccctctgggcctgtttcccgggttccgggggcggggccttcccctaaacgcccttcccccatgtttggggaccggggggtgtctcttgtgggtgccctgcaaggtccccccccctgggtttttcccccgggggttgtgggggaaaaaatgttcttcccaaggggttggctccgaaatatttccaatagaggccctttgcgtttcccgcggcccgcgatatttcttggcgtcgggggaaaaaaatgtctatgtccccggcttggcgcaataggcgggataatctttcctcgcgcccgcgcttcccgggaaattggtgcaacgggcccggggttcttcaccgtggtgtctcaacctaagggttcgcctccgggggcctccaattctcctcgcgggttggggaattcccccctaagcgctccgggaaaacaaaataagtttcaccggggtggtgtgggtaatttattcccctccacttcttagcttgggtcccgtaagaccaaacccgtcagtggtcccccccaaacgcgcgccagtgntataaggcccccttttataaaaaagaggaaaccgtctcctcc

SEQ ID NO: 91699 - protein, 123 aa, Zea mays
  misc_feature: Ceres CLONE 1580172
MCRLRLLLRPISRPHLHPLPPPMCRLRLLLPFFLLLRPIPHASQPAAPSPALQCALNLTALLPFLAPVVPSEEPSRCAVGHPVPSPFLLLASTSGAKSFPCWFPTPRPPLWACFPGSGGGAFP

SEQ ID NO: 91700 - DNA, 978 bp, Zea mays
  misc_feature: Ceres CLONE 1580174
  misc_feature: Encodes the peptide sequence at SEQ ID NO. 91701
  misc_feature (812)..(812): n is a, c, t, g, unknown, or other
  misc_feature (817)..(817): n is a, c, t, g, unknown, or other
  misc_feature (854)..(854): n is a, c, t, g, unknown, or other
  misc_feature (891)..(891): n is a, c, t, g, unknown, or other
ctccccgcggtggcggccgctctagaactagtggatcccccgggctgcaggaattcgtctcacccctagaaaaaaccgtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggcgtctacgtgatcaacttcgtcatgtccatgtccacgcagatcttctgcgggcagctcggcaacctggagctcgccgccgcgtcgctcggcaacaccggcatccagtccctcgcctacggcctcatgctggggatgggcagcgcggtggagacgctgtgcgggcaggcgtacggcgcgcacaagcacggcatgctgggggtgtacctgcagcggtcgacggtgctgctgatggccaccgccgtgcctctgtacgtggtgtacgccttctcggcgcgcatcctggtgctcctgggcgagtcggagcgcatctccagggccgccgccgtgttcgtgtacgggctcatcccgcagatcttcgcgtacgcggtctactccccatccagaaagtcctgcaggcgcagagcatcgtggcgccnagcgnctacatctccgtgggcacgctggggctccacctgggnctcagctggctcgccgtctaccggctggggctgggcntgctggggcgctcgctcgtgctcagcttcagctgttcggtcatctcgccgcccagtcgcgttaatcgtaccagccccggtgcaggga

SEQ ID NO: 91701 - protein, 266 aa, Zea mays
  misc_feature: Ceres CLONE 1580174
  misc_feature (69)..(217): Pfam Name: MatE Pfam Description: MatE
  misc_feature (211)..(211): Xaa is any aa, unknown, or other
  misc_feature (213)..(213): Xaa is any aa, unknown, or other
  misc_feature (225)..(225): Xaa is any aa, unknown, or other
MDSTTTTTAPLLQPAAAASSKEEPAPASPHGAGSWELEAVLADASSPVLRRAWEGARLELPLLLRVALPAVGVYVINFVMSMSTQIFCGQLGNLELAAASLGNTGIQSLAYGLMLGMGSAVETLCGQAYGAHKHGMLGVYLQRSTVLLMATAVPLYVVYAFSARILVLLGESERISRAAAVFVYGLIPQIFAYAVYSPSRKSCRRRASWRXAXTSPWARWGSTWXSAGSPSTGWGWACWGARSCSASAVRSSRRPVALIVPAPVQG

SEQ ID NO: 91702 - DNA, 1290 bp, Zea mays
  misc_feature: Ceres CLONE 1580177
  misc_feature: Encodes the peptide sequence at SEQ ID NO. 91703
  misc_feature (901)..(901): n is a, c, t, g, unknown, or other
  misc_feature (1253)..(1253): n is a, c, t, g, unknown, or other
  misc_feature (1260)..(1260): n is a, c, t, g, unknown, or other
  misc_feature (1290)..(1290): n is a, c, t, g, unknown, or other
aaaacttatttctccgcctctttctttttttattcatctttcttctcccctctccttcctccttttttttctcaaagctggagctccccgcggtggcggccgctctagaactagtggatcccccgggctgctggaattcgtctcacccctagaaaaaatccccatcaaacccctagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggatcccatcgcgcttgccccagacaaccacgtcctctactccaactgtgtcggcggtggatgccctccctcacacccttatcccaatgttcttgctctaaccgcaaaataccggtcgaacttcaagcccgaactggggccacagggcttacccccgtcccctgggagcgtgtgaattccttcgccccccggcaaaaacccggccatttcacctctcccccccctcttatttataaaggggcccctccagaacctttgaaccccccaggaataacaaaggggtccctctaaaatctcgcgggtgtctcccacttttctttcccccaacaaaaattatttcttttcaacaaagtacccccccccccctccaccttccagtatatgggtctttctatcccgacgcgttccccctcaaaatacgcctctcttttcgggctctctctcgatatgaattcttctcaccaacgagaggtgtcctctcccagtccaaagaccattcgtttggggggtgtttatcaccatcatctcaatctgtgtggacgatacatcctcatataaaatataccccnctacgcacacagaggcgtcggcgtatgtcgccctccacgttcctttattatttattattaaccgcccctcctcttactcatttattttttctcacgcccgtcattttctatcactctattgccctccaactacacatttcctctaaaactatttcatataaacccccacttcaaaaactacttttattattaatacacgtggttttcagctcttctccgcattattactctccaccatcactactatttactacggtgtctctcaactatatgtctcatcttgtcgtaccaccacacgtatttttcaccctcctgttatatcatttctgcctatgtttatcctcctagcgtnaaactcngacatttgtcctatttacccggcgacgggn

SEQ ID NO: 91703 - protein, 83 aa, Zea mays
  misc_feature: Ceres CLONE 1580177
MADEAKAKGNAAFSAGRFEEAARHFTDPIALAPDNHVLYSNCVGGGCPPSHPYPNVLALTAKYRSNFKPELGPQGLPPSPGSV

SEQ ID NO: 91704 - DNA, 1333 bp, Zea mays
  misc_feature: Ceres CLONE 1580179
gctcgctagttcatcaaggttgtggatatcccttaactccaaaccccgccctatattcttcaaagctggagctcaccgcggtggcggccgctctagaactgtggatcccccgggctgcaggaattcgtctcacccctagaataattttttgggggctctatataactctcccctcctcgtgccttatcttcatctcacctgctctttctcctccgtgctgatctgaagtccctaagccccgcaacaattgattagccgaattccgcgcgccggtccctataataatgtaagtacctacgaagcagataagatgcatttccctgtaattgttcgttattatatatactcaacacgggcatgtggggaagacacttctgtacaacctccaagccgatctccgcgcgtcacattcatggtccatttttaaccccccttcttttgatatacgattagcatgtggtgcccccccccccaattgcctcgggtattgcttcccctgattctgagcccggcccgtatggtcttctcttattagtccgctttctttccatccatccgctttttttccttcttacgctcaatacttcgtctttcgtttgccttttttcgcataacttgccccttatcccgactctccgttcatctatatgcctacgggtcgtgtctttaagcgcattactcttattaccccgctcaatatcttttcttctctttgcctctcccccttctcactcacttctatcttagtggccttgattttatctccaacattgtttctccttcttgtgcttcgtcccttacttgttcttttttccccacatgtgcttgtgtatctcttttgttgctctccgcctaaaacgcatcttcatttaaattgcgaatcatagtctcgtatctctttttcttcgttatgctcactccagttattatgtttcatataatgtctctcgccgtcacgactcacctcgcgccgcacaatgtctatacgcgttgcctcgttagatacttcctgcactctttgttcaccaccctctcttctcctatcttacgtgattttatcccagtccggcttacttattctccctggctcctcttgtgctacactcgtcgcttctatatagttattctatctccccccctccttgtatctgatccccctcttctattatttaggtcgcacggtctcaggtatgacggtaccgcacatttccccatctatttctatgttctgttattgcactccccttcactgcctcatatgtttttcttctcgcactggtttactactatattttcgtccccatataatatatacactctcgtctcagtcttc

SEQ ID NO: 91705 - DNA, 875 bp, Zea mays
  misc_feature: Ceres CLONE 1580181
  misc_feature: Encodes the peptide sequence at SEQ ID NO. 91706
aaagctggagctcaccgcggtggcggccgctctagaactagtggatcccccgggctgcaggaattcgtctcacccctagaaaaaaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccgggcactcgcacgcgcgctcgccgtcgccgcgaccctcgctgacctccagatggatgctgaagtcatatcagccggcatactaagagaagcattagatgcaggagctgttagaatgagggatgtaaaaacacagattgggatcagcacagctcatttgctggatgacacctaagggattagcatgctcctttcaaacttgacttattggataaagaaaggtgcagcccttttaaaagggttaatcctttcaaaccaagaaaaccggggcagtcaatatggaaccttggaaataaaacttgtaattataaaaaaccaccttaatacccctccccaaaaattttggcgccaaaaaaaaatatcctcccgaaaccctgaagaaatttttcccccctttttaaaacacgttttggg

SEQ ID NO: 91706 - protein, 163 aa, Zea mays
  misc_feature: Ceres CLONE 1580181
MATATAAPVPAGGHPYRRARTRCGPPRLHRLRFPAAAAAASSSLPAPSSMLPPLPDGGGRLVAELVCAFNELTERMGEDLATSSSSSLLFRVLKLALPALRDVEGGRALARALAVAATLADLQMDAEVISAGILREALDAGAVRMRDVKTQIGISTAHLLDDT

SEQ ID NO: 91707 - DNA, 912 bp, Zea mays
  misc_feature: Ceres CLONE 1580187
  misc_feature: Encodes the peptide sequence at SEQ ID NO. 91708
ctggagctcaccgcggtggcggccgctctagaactagtggatcccccgggctgcaggaattcgtctcacccctagaaaaaggccctcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtgggtgtggctgatggaatgggtggtgctgccatgtatgaaactgttcgtgtcggacatgataacctcattggggaaaatatcccgtctgagggcgattcagctacaatccaagtttatgaagaaacagctggactgattggttatggacccggaattgggaaacaaaaaaccccctttcagttgaaatgggggccctaaaattcctgggaaacatttttgaagggtatcccggggccccttaaaaaacctccgttttttattcgggaagggggggttttccccccggggggttttaaattccccgcccccttaaaaaaaagtgttttggggggatattttccccaccaaaaacgggggggggggggagagtttcccgggggggggggaatatccccccccctctttttttttgaaaaacattgggtggcccccccctgtgttttcccccccccggggtggttgtggggggaaaaaaaatattttttttcccccgggggggggggaaaccccccgaggaaaaaaaagggaaatatttattattttcccgcgaaaaaaaaaaaaaaaatattttttttttaaggaggggggggggcgccccaacgcgggggggtggataaaaaggggggggccccc

SEQ ID NO: 91708 - protein, 94 aa, Zea mays
  misc_feature: Ceres CLONE 1580187
  misc_feature: SWISSPROT Homolog: EC 3.6.3.14 H(+)-transporting two-sector ATPase
MAYGDRVTTFEDSEKESEYGYVRKVSGPVGVADGMGGAAMYETVRVGHDNLIGENIPSEGDSATIQVYEETAGLIGYGPGIGKQKTPFQLKWGP

SEQ ID NO: 91709 - DNA, 843 bp, Zea mays
  misc_feature: Ceres CLONE 1580194
  misc_feature: Encodes the peptide sequence at SEQ ID NO. 91710
ccccgcggtggcggccgctctagaactagtggatcccccgggctgcaggaattcgtctcacccctagaaaaaactcgcagtcgcactagtgctaggcgcatccggcatccccatcccttgcctccgaatcggatcgccgccgccgctgccgctaccgccgagcggaagcagccatcaccccaaaccctagccagccatccaactatggagccgcccgccgccgactcctcgcccgatccgacgccgcaggaccagtttcctgccccgtccccttctccctccgcctccccggtcaagcgctccgcctggaagcacccctcccccaacggccccgccgtcatggatgccaaccactggcccgcgctctccgacgccgccaagggcatcaagctcccagactcctcgtcttcctcgcctgcgcccgtcgccgccccatcggccgttgccaattcctccagttcgcaaaagcacggcgcccatcacgtccgccacaagtccgccaggcgtggcggcggcggggagcactctccacgagaccatcctgaccggaccacagccacgggttgggaccacgcctgcggcggtgggggtaggggtgcccagaggaacataataacggaggcggcaggaggggcaacgccgccgctgcctctgccggcggaccttctcacaatggtgcccgtggcagcggcggaagtggaagctttggtgccatgcgaagaagggcctacgagccgtccttcaatcgtggccctccacaacagtgggcatggcactacaggaggccaccacctcccccagagcgtcctagcgcgcatacagctcgaagtcgagccgtctatc

SEQ ID NO: 91710 - protein, 213 aa, Zea mays
  misc_feature: Ceres CLONE 1580194
MEPPAADSSPDPTPQDQFPAPSPSPSASPVKRSAWKHPSPNGPAVMDANHWPALSDAAKGIKLPDSSSSSPAPVAAPSAVANSSSSQKHGAHHVRHKSARRGGGGEHSPRDHPDRTTATGWDHACGGGGRGAQRNIITEAAGGATPPLPLPADLLTMVPVAAAEVEALVPCEEGPTSRPSIVALHNSGHGTTGGHHLPQSVLARIQLEVEPSI

SEQ ID NO: 91711 - DNA, 1015 bp, Zea mays
  misc_feature: Ceres CLONE 1580196
  misc_feature: Translation starting site: 434
  misc_feature: SWISSPROT Homolog: EC 1.4.1.2 Glutamate dehydrogenase
  misc_feature (64)..(64): n is a, c, t, g, unknown, or other
accaggtcgtcttatcatttcacaaaagtctccgcgaatacccatatccccgattgtttgtgantgacataaattacaaaactggagctcaccgcggtggcggccgctctagaactagtggatcccccgggctgcaggaattcgtctcacccctagaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcaatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcaccagggtgaggagaagcagtttgcagctgaagagatctccctctatggttcttatcaagatgcgtgagattgctgaagcttaccttggtaagcacgaacaaagaatgcttgtgggccaaagtcccctggcccactttcaatggacctcacagaagggcaaggccacaaaaggaatgcctggggggtgattgggctgggcacttaaatgtggctggcggtatttcatcaaacgaagaccaaaacagccttgccggcttatccgcccttatgggtcctttgaacaaagaaagggctaacccaggtggtcccggtgaaaaaaggaaaaggcccctcccatccttttgaattccttggggagggggggggacaccctttggaaagggtttcacccttccttttaaccaaatttggagggaaaagggaaatttttttgagggga

SEQ ID NO: 91712 - DNA, 1150 bp, Zea mays
  misc_feature: Ceres CLONE 1580201
  misc_feature: Encodes the peptide sequence at SEQ ID NO. 91713
  misc_feature (1)..(1): n is a, c, t, g, unknown, or other
  misc_feature (40)..(40): n is a, c, t, g, unknown, or other
nccccgtccctgggcgctgggagagcgtgggctcgcactnacctttcaccgtggcggtcggcgcggggccatggtacacaaagctggtactccccgcggtggcggccgctctagaactagtggatcccccgggctgcaggaattcgtctcacccctagaaaaaatcgcaccgcacgagctacggatctgcggcccgacgactacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatctggatgggagtaccggagacctgaaagagtcccacctgcatgtccatacaagcctgcagctcagaagaacgatgagggtgcgaccgaatcaaaactcctggccgaaccgcacggtgtctggttgctgcggcgcgcgcaagataagaaagtggaacgatgtcagcaggccgctttaaaaatggtgggcccaccgtctctggtgggggtcagcttaagaaaatcattaaattggttgcgcggacggtttatgttaacttggggttggaggggggcttgggaaactttgatgtccgggaagacttccgcgcggtttccgttaaccacagattgccccccttaccttaaagataccctcggccctgacctgggggttcccttagggtcaccgcgtcccctcggaaaaaatgccaggggcgtctaaatctcgagaaatacttcggccccggtttccctcagatatatatgttaaatacaccctcgagagaggcctcgaaattttcctgccgcttggtgcttcaagagaggacacttaatatatgaatcccccaaagcacattttttgagcctccggcccaagaaaaagggacagtctttccaaaagaattttggtcgaccttattctccagacacacacggtgggtaagagcggccctctagtcggcgtgtgcgcgctcccgcccccccaaattagaaaaacccggcagatagaccccccaatgtctgtgctgcttccttccgcaaacagctttgg

SEQ ID NO: 91713 - protein, 173 aa, Zea mays
  misc_feature: Ceres CLONE 1580201
MVCVACLLPLFLIPVVNALPYLIDLIISKVYRLSGWEYRRPERVPPACPYKPAAQKNDEGATESKLLAEPHGVWLLRRAQDKKVERCQQAALKMVGPPSLVGVSLRKSLNWLRGRFMLTWGWRGAWETLMSGKTSARFPLTTDCPPYLKDTLGPDLGVPLGSPRPLGKNARGV

SEQ ID NO: 91714 - DNA, 1081 bp, Zea mays
  misc_feature: Ceres CLONE 1580202
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (29)..(29): n is a, c, t, g, unknown, or other
  misc_feature (52)..(52): n is a, c, t, g, unknown, or other
  misc_feature (760)..(760): n is a, c, t, g, unknown, or other
  misc_feature (799)..(799): n is a, c, t, g, unknown, or other
  misc_feature (822)..(822): n is a, c, t, g, unknown, or other
  misc_feature (901)..(901): n is a, c, t, g, unknown, or other
  misc_feature (1018)..(1018): n is a, c, t, g, unknown, or other
  misc_feature (1019)..(1019): n is a, c, t, g, unknown, or other
  misc_feature (1048)..(1048): n is a, c, t, g, unknown, or other
  misc_feature (1058)..(1058): n is a, c, t, g, unknown, or other
nnnttttnnnnnnnnnttaaacttccgcncacacttaagatattcacaccanccccaccaagaaggtggggggttccaaactggaactccccgcggtggcggcctctctagaactagtggatcccccgggctgcttgaattcgtctcacccctagaaaaactctctctctctctccttcctgccttctgcctgcgggcggcccatgtccgtggcgcccctcctgccctgcgagctgcttctccagcgaaaaggttgctgcgccttgacgcaccaccgatccaccgccgcccaacccgagcgttctgtccggcagctaggtagcgagctgcgcggtggctgcgaccggaagcagggaggggaacagggcagcgaacgccgggcgattgccttgcttgcctgtgtgctccgcccggcgcgagttggtcggtcgttccatgcatggatgacaaggaacttatctcacagtccgacctgcaatcattctaccagcagcagcagcagcaccaccggggccttcggccggcggcggcgggcagcattagccccgtccctcgctgggccggggatgcacttccgtcatttcgcccccatggcccaaacatggaacaatgaagccccgttcagccgaatcccttaaacctctaatccgggcgggggggccttctccttccacccgggttattggcaggttttcccaagaaatggggaccccccgccggccgggccccaacactatttggcatgggcaaccaaccccgngcccggccccaatgtggggtttggtccctcccggagccntccctttaacccgttccaaaacnccccggagtgtggccccgatccccccccggcggaaaccccccacaacgtgaagacccctggttctaaaggccttcctanggaaaaagaggggtataaacccggccggccagatatatacgaggtctccccggaaacgcgggcacccccatttagaaagacaaagcaagagcataattttcgtttactctcctccgnntaatgcctaaagggattatgaggccccgntcctgggggncccccagacattgtaatatcaaa

SEQ ID NO: 91715 - DNA, 803 bp, Zea mays
  misc_feature: Ceres CLONE 1580204
  misc_feature: Translation starting site: 308
  misc_feature: SWISSPROT Homolog: EC 5.4.2.2 Phosphoglucomutase
  misc_feature (803)..(803): n is a, c, t, g, unknown, or other
ctggagctccccgcggtggcggccgctctagaactagtggatcccccgggctgcaggaattcgtctcacccctagaaaaaaaaaaggtgagataaaacgcgaggagaacaacggaatgatccaacaccgccctcttgtgctctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtcctaaggaggacttcgggatcaaaacaacatgggaaatggtgggcctgctcctgaatctgttaccgacaagaatttctctaatacaacgacaatctctgaatacctcan

SEQ ID NO: 91716 - DNA, 819 bp, Zea mays
  misc_feature: Ceres CLONE 1580205
  misc_feature: Encodes the peptide sequence at SEQ ID NO. 91717
  misc_feature (635)..(635): n is a, c, t, g, unknown, or other
ccccgcggtggcggccgctctagaactagtggatcccccgggctgcaggaattcgtctcacccctagaaaaagaagacgtcgatgcataacctcctcgtgcgttgtttgtctctctacttctctagtctagcccctctgtcgctctcagacgacgggtgcgccgccgccgccgccctaagccaggtgctgactgctgaggctttctttggtctcttcgccggcgacgacacccgccagtatccacggtgtcattgcaagacaagatggtttccttcgagatgaatgacctcaagagtatggacttgtcaccactctttttttaattgtcttcccaatttttgttccatttgtttctgataggagcatagatagtttgtgctaggcatgaatgtgtattgatttgcttgacgtcctttgtttctccctcataattcagaacttaacaagctagcatgtttgcaaattgtcttgtgatgaatgtgagaaagtcaccctcagggatgctactttgttttgaaggtttgcatgtctttaactgatatttgatgatttttcaatcatataaactgtgacatgcacctcatatcatgtaaaaacagtagtttttaatgtgttgatccatcagggtaatatncatgtggggaacgtgctgtataattttacctgcatttttttgtctaaatgtgttagtgttacaattgaccatgagtggcagcatatatcatgtactggtgtgcctgtagtctacaatatgtcaatatcttggagtggtaattttgcaagagaggcaactttgctaattcctttttttttccttc

SEQ ID NO: 91717 - protein, 66 aa, Zea mays; identical to SEQ ID NO: 85250
  misc_feature: Ceres CLONE 1580205

SEQ ID NO: 91718 - DNA, 824 bp, Zea mays
  misc_feature: Ceres CLONE 1580207
  misc_feature: Translation starting site: 319
  misc_feature: SWISSPROT Homolog: EC 2.3.1.15 Glycerol-3-phosphate O-acyltransferase
tccccgcggtggcggccgctctagaactagtggatcccccgggctgcaggaattcgtctcacccctagaaaaacacccagacctagccactccccagcaggcaagcaacctcgccaaaaccctacgccgctcaactatgctcatccggcgaccgctccaaaccctcaccctccccctcctccgccgccacttctccgccgccaccgtcgaggcctttgtgtctcccgaccaagccactgccaagcaactcgcacgcagcagtacgacgtctctcctctgggtctggggccgagacagcgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgaagccttcgccagggcctttctcggcgcccaacaagtcgtcgggaccaacctggaagtcggaagggacggcaaaggccacgggcctcatggcccgggccagga

SEQ ID NO: 91719 - DNA, 942 bp, Zea mays
  misc_feature: Ceres CLONE 1580208
  misc_feature: Encodes the peptide sequence at SEQ ID NO. 91720
tccccgcggtggcggccgctctagaactagtggatcccccgggctgcaggaattcgtctcacccctagaaaaaagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgatctatccccccaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggccttctcgacagcaccgtccgccggaccctggtcggaagcttctacgacgctgggggagcccatcaggttcaactaccccatggcatggtccatgaccctggctcagctggagcgtcctcccagtacagggcccaggttcgaggcccttcggggagcccctcccattacagggaagctccttcacggggggggaagggacctacttccctctagagcactttaaatttcttcttgcccacaccctaatgaaaagggatttgcttgtctctg

SEQ ID NO: 91720 - protein, 143 aa, Zea mays
  misc_feature: Ceres CLONE 1580208
  misc_feature: SWISSPROT Homolog: EC 3.2.1.4 Cellulase
MWTVGTVLGLGVFIGFVIMIVKLVPHKRPPPPPPDQYTQALHKALMFFNAQRSGPLPKHNGVSWRGNSCMKDGLLDSTVRRTLVGSFYDAGGAHQVQLPHGMVHDPGSAGASSQYRAQVRGPSGSPSHYREAPSRGGKGPTSL

SEQ ID NO: 91721 - DNA, 899 bp, Zea mays
  misc_feature: Ceres CLONE 1580209
  misc_feature: Encodes the peptide sequence at SEQ ID NO. 91722
  misc_feature (392)..(392): n is a, c, t, g, unknown, or other
  misc_feature (394)..(394): n is a, c, t, g, unknown, or other
ctccccgcggtggcggccgctctagaactagtggatcccccgggctgcaggaattcgtctcacccctagaaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacnancctggtctcgatgatgttgtgaagcagtgcaggggcaggaacctcttcttcagcactgatgttgagaagcacgtcgctgaggctgacattatctttgtctcggtgaacacccccaccaagacccgtgggcttggagctggcaaggctgccgacctcacctactgggagagcgctgcccgcatgattgcggatgtctcccagtctggacagattgttgttgagaagttcactgtccctgtcaagaccgctgaggctattgagaagatcttgaccaaaacagcaagggcatcacttacagaatcttttcgaaccagaatttcttgcggaggggcattgcctttgagacctgtttaagcctgaaaaaaggtttattggggggccggggaaacccctgaggggagggaaggccctccagggccttccaggaatggatcccctcccggggttctccggggaagggatccccccccccaccaccggggggcggggtgagacttcccaagcc

SEQ ID NO: 91722 - protein, 168 aa, Zea mays
  misc_feature: Ceres CLONE 1580209
  misc_feature (2)..(158): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
  misc_feature (51)..(51): Xaa is any aa, unknown, or other
MVKICCIGAGYVGGPTMAVIALKCPDIEVVVVDISKPRIEAWNSDTLPIYXPGLDDVVKQCRGRNLFFSTDVEKHVAEADIIFVSVNTPTKTRGLGAGKAADLTYWESAARMIADVSQSGQIVVEKFTVPVKTAEAIEKILTKTARASLTESFRTRISCGGALPLRPV

SEQ ID NO: 91723 - DNA, 985 bp, Zea mays
  misc_feature: Ceres CLONE 1580213
  misc_feature: Encodes the peptide sequence at SEQ ID NO. 91724
  misc_feature (664)..(664): n is a, c, t, g, unknown, or other
ctggagctccccgcggtggcggccgctctagaactagtggatcccccgggctgcaggaattcgtctcacccctagaaaaagactcacacaaatcgaatctggaaattcttcccccaaaccgtcccaaactcgcctcctcacggccgccgccgccgccgccgctgctcggtaatccctcatcctccccacctgtccgctcgtcagcgtcatgtccggcaccaccccgacccctacacctacaccgacgccgctaccgccgccgccgccgccgccgccagccgctcgccccgcacggtacgacttcctcaactccaagccaccgcccaactacgtcgcggggctcggccgtggcgccaccggcttcaccacccgctcggatatcggaacggcccgcgccgcgcccgagctgaccgaccgctccgcctccggcgccgccgccggtcccgccgtcgggcggggccgcgggaagcctcccggcgaggatgacggcgacgactacggcggcgacgaggagaagggctacgacgaaaaccagaagttcgacgagttcgagggcaacgacgccggcctcttctccaacgccgactacgacgacgacgaccgctaggcggatgcggagtgggagagcatcgaccacaggatggactcacgccgcaaggaccgncgcgaggcgcgcctcaagcaggagattgagaagtaccgcgcgtcgaaccctaagatcaccgagcagtttgctgatctcaagaggaagctggccgatctgtccgcgcagaatgggagagcataccggagattggtgactaccccctgcacaacaagaaaaacagattgagaacctcctgccccggtccggaaccctggctgaaaaggccccgcaagaacctggacattgtcccacaccttgaccctaaaaaccctgcggtgggtggccaaaatacgccagtggcccaaattccggtttattaatattcaaacattgggccag

SEQ ID NO: 91724 - protein, 132 aa, Zea mays
  misc_feature: Ceres CLONE 1580213
  misc_feature (37)..(132): Pfam Name: PRP1_N Pfam Description: PRP1 splicing factor, N-terminal
MSGTTPTPTPTPTPLPPPPPPPPAARPARYDFLNSKPPPNYVAGLGRGATGFTTRSDIGTARAAPELTDRSASGAAAGPAVGRGRGKPPGEDDGDDYGGDEEKGYDENQKFDEFEGNDAGLFSNADYDDDDR

SEQ ID NO: 91725 - DNA, 957 bp, Zea mays
  misc_feature: Ceres CLONE 1580216
  misc_feature: Encodes the peptide sequence at SEQ ID NO. 91726
ctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctcccccaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtccatgccaagatccagggacaagtaagggcattcccccagaccagccgcgggctcattctttgctggaaaacaactttgagggagggccgcacgctgggccgaatacaacatcccagaagggaaaccaccctccaccttggtgctggcgccccagggggagggaatgccaaatctttcctgggaaaaccctgaaactggcaaaacatattccaccctctcaagtgtggagatcctttagaaaaccctttctaaaaaacgttctagaggccaa

SEQ ID NO: 91726 - protein, 241 aa, Zea mays
  misc_feature: Ceres CLONE 1580216
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQISPKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVHAKIQGQVRAFPQTSRGLILCWKTTLREGRTLGRIQHPRRETTLHLGAGAPGGGNAKSFLGKP

SEQ ID NO: 91727 - DNA, 934 bp, Zea mays
  misc_feature: Ceres CLONE 1580217
  misc_feature: Encodes the peptide sequence at SEQ ID NO. 91728
tggagctccccgcggtggcggccgctctagaactagtggatcccccgggctgcaggaattcgtctcacccctagaaaaaatgcatcccgattactatctgccgagccgaccagcggcaccagaacccacaaggttcactcatggcgcccacgtccatgctcccgttcgcgccctccaatacgtcgctgccctattcctcccgcgccacaactgccgccgcgttcgctcctcgtgggctccaccacgccgcggccggaagggagcggcggcggccaacggctcgcgtgcgctgcgcctcggcgccgccgcggagggggtcttgtggtcagggcgtcggccgactactacgcgacgctgggcgtgccgcgcgccgccagtaacagagacatcaaggccgcgtaccggaagctcgcgcgccagtatcatcctgatgtcaataaggagcctggagcgactgaaaagtttaaagagataagtgcagcatatgaggtgctgtcagatgaaaagaagagggcgttgtatgaccaatatggtgaagctggtgttaagagtgcagttggaggctccggtggagcttacacaaccaatccatttgatctggttgagacattttttggagcaagcatgggtggtttttctggcatggaccagagcgcgtttaggacaagcaggcgaagcactgctatacagggtgaagacatcagatatgatgtgattccggggttcacagaggcgatattttggaacagagaaagaaattatattatctcatttggaaacatgtgatacatgggggggttcttgaatcaaaggctggctccaagaagaaaaatagttccacatgttggggggggaggggaagtaatggaaactgagcaacaccttttggccttggtccccaaggtttcttttgcccccatgtgggaaggaaaat

SEQ ID NO: 91728 - protein, 53 aa, Zea mays
  misc_feature: Ceres CLONE 1580217
MGGFSGMDQSAFRTSRRSTAIQGEDIRYDVIPGFTEAIFWNRERNYIISFGNM

SEQ ID NO: 91729 - DNA, 1333 bp, Zea mays
  misc_feature: Ceres CLONE 1580218
  misc_feature (881)..(881): n is a, c, t, g, unknown, or other
  misc_feature (1309)..(1309): n is a, c, t, g, unknown, or other
  misc_feature (1310)..(1310): n is a, c, t, g, unknown, or other
  misc_feature (1319)..(1319): n is a, c, t, g, unknown, or other
  misc_feature (1323)..(1323): n is a, c, t, g, unknown, or other
ctccgttttttctctcctttctcttctccccccttatttgtttgtcgtcggtttttccatcaaactggagctccccgcggtggcggccgctctacaatagtggatcccccgggctgcatgaattcgtctcacccctataaaaatgcatcccgattactatctgccgagccgaccagcggcaccagaacccacaaggttcactcatggtgcccacgtccatgctcccgttctcgccctccaatacgtcgcttccctattcctcccgcgccacaactgccgccgcgtttcgctcctcgtgggctccaccacgtccgcggtcggatacgagcggctgttcaaccctctttttatatacttctacttatttttcaagattcacttccatattcctcttcactattttccttttccctttcttcccctattctctatttttccccattcttattgtaccctcttatctcgtgtccttatttccccctttacttttcatccatctcttctcctactcttacttatccttttcgttttttcataacatcacccatccatctatacctcccttttttattcccttttcccacctttttcatttgttactctgtatgcctcttacccctttgtacaaattgacctcactgcttatcacttttccccctacctcccttatctccctctcgtccactatttcactataattagcaccaatattctcttccttcccacttcttatttttattgtaccccactccccctcatttttttatccctttcctcgtagcaactataagtgttctataatgaaaggcactctatatataatcctcgcctaataaattaacctattccctctacctctcttactagtcacccgctttgtncttcctaccaccttctatgatcctgcttattattttcccgatcgcatattcctcgctgctactattctatctctgttcacactcatatacgctctcatcactcattgatattgctcatatgacaccgcatgttccacccataatactctacttgataacattatttatattacccctttacacccatataatcgctctgagactgcttgtgtcacactcctcattatcactctctcctttacacatactacttctgctctgatatccactatatgtctagtaacttacctccgttctctcatgctatagtatacacacaaccacacttaaacacgtgtttaattcgttccaccacgcgcgtcttctgtctgatcccatcatcatacgcgtcttgtctgttctatattccgcatgtctcggtctcctcnnttttcaccnttanttgtctatct

SEQ ID NO: 91730 - DNA, 1015 bp, Zea mays
  misc_feature: Ceres CLONE 1580219
  misc_feature: Encodes the peptide sequence at SEQ ID NO. 91731
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (471)..(471): n is a, c, t, g, unknown, or other
  misc_feature (472)..(472): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (611)..(611): n is a, c, t, g, unknown, or other
  misc_feature (615)..(615): n is a, c, t, g, unknown, or other
  misc_feature (617)..(617): n is a, c, t, g, unknown, or other
  misc_feature (618)..(618): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (691)..(691): n is a, c, t, g, unknown, or other
  misc_feature (916)..(916): n is a, c, t, g, unknown, or other
ctccccgcggtggcggccgctctagaactagtggatcccccgggctgcaggaattcgtctcacccctagaaaaatcctcccttccctcccgtaccgtatcagtctcccggattctctccggttcgtgggagggccaaagcttcgagttaggaaaaccctaccgctgtgggagtagcctccggcgatggctgcggcggcgatccagccggatctggcgactcacgtgctcatcccggtcacggcggacgtgggcatcgcgttcgcggaggtgcagcgggtgctggtctccaaggagcgggtcacccacgagcgccccccggacggcggggccgtgcagagcgagaccaccgactacctcattcaggaggaggagggactcatgaaccactcccccccccccagggcgccgagattctgacccctagctcttctgcatgnnnnnnnnnngagagtgaagaaaatagggaagannggaaatagagggggggcccctttggaaaacccaaagggttcttttccttggggnnncccccgggggtcgagtctctcagannnnnnnnntnnnnnnnnannnnnnnnnnacaaaaacttcccagactctggcctttttnattnanngagacgcattgtgggccatccgtgcnnnnnnnnnnnnnnnnnnnnnnnagtgatatgatattattatcaaacnccctctagaaaaaataccccctaaatgcccagaatcgccgctccctcctttttaagagggcgatagaagcgcgctgcacgaaccatctcttgtcagcgtttcttctcaaacacaaagctggaggggtctctttttgtttaaataatagccacaggaacctcccatatgtgggagataatccctctccctctgcggccctgcatctaatttctatatggcatgcancttggccgggcgcaatctcctcagtgttgtgtcactcgccttcctccgtggttgtggtggcacgctcctgtgcgccgctcgtgcgacaggagtcggagt

SEQ ID NO: 91731 - protein, 77 aa, Zea mays
  misc_feature: Ceres CLONE 1580219
  misc_feature: SWISSPROT Homolog: EC 3.6.1.1 Inorganic diphosphatase
MAAAAIQPDLATHVLIPVTADVGIAFAEVQRVLVSKERVTHERPPDGGAVQSETTDYLIQEEEGLMNHSPPPRAPRF

SEQ ID NO: 91732 - DNA, 980 bp, Zea mays
  misc_feature: Ceres CLONE 1580222
  misc_feature: Encodes the peptide sequence at SEQ ID NO. 91733
ctggagctccccgcggtggcggccgctctagaactagtggatcccccgggctgcaggaattcgtctcacccctagaaaaagttccccaatctcctctccatcgaaaccctagcacgacgcaattcccgtcttcccacgccgtgtcgccgttgctatgggcaagaagcggaagctcgagcccaaatcggcggcagggttcacgccggttaaggcctccccgaccaccaggtctgccaccgctaaggccgctggtctatccgaggtcctcgcccccgtcgaggctacgatggagaagctgccgcagggggcaggcggcgaggatgtagaggaaatcgaggaggtggaggtcgaggaggaagtggaagtggaagaggaagaagaaggcgagagcgaccaggcttcgatccaggcgctgctggattcgttccccaaggaccagctcgtcgagctgttacgcgacgctgccatcgctcacggcgacgtgctaaccaccatccggcgcgtggccgacgccgacccggctcagcggaagatcttcgtacacggcctcggctgggacaccacaaacgacaccctcaccgaggccttcggcccatacggcgagatagaggatctcaaggtcgtcaccgaccgcaacacgggcaagtgcaaggggtacgggttcatcctcctccgtcaccgcttcggcgcccgagctgcactacgcgagcccatgaagaagatgggtaaccgcagcaccgcctgccagctcgcctctgttggccctgtcccctgttgggcgcccaacatgcgctcaccaggccccgggtcaattgcagttgccacccaggtcctgagttaaccaccgtaagatattttgtcacaaggttggtggcaatattcgctccgcaaaattgcctcagtttcttctgcaaggtttgtgtgaatctcagaaatcgcccccttggtcttggaaagggccacgggaaaaccataggaat

SEQ ID NO: 91733 - protein, 228 aa, Zea mays
  misc_feature: Ceres CLONE 1580222
  misc_feature (127)..(197): Pfam Name: RRM_1 Pfam Description: RNA recognition motif. (a.k.a. RRM, RBD, or RNP domain)
MGKKRKLEPKSAAGFTPVKASPTTRSATAKAAGLSEVLAPVEATMEKLPQGAGGEDVEEIEEVEVEEEVEVEEEEEGESDQASIQALLDSFPKDQLVELLRDAAIAHGDVLTTIRRVADADPAQRKIFVHGLGWDTTNDTLTEAFGPYGEIEDLKVVTDRNTGKCKGYGFILLRHRFGARAALREPMKKMGNRSTACQLASVGPVPCWAPNMRSPGPGSIAVATQVLS

SEQ ID NO: 91734 - DNA, 1154 bp, Zea mays
  misc_feature: Ceres CLONE 1580223
  misc_feature (14)..(14): n is a, c, t, g, unknown, or other
ttggttttgggttnccttttagcaatcactatatcctcccaaccctaagctactacaatccaaaacacatttgtctaaactggaactccccgcggtggcggccgctctagaactagtggatcccccgggctgcaggaattcgtctcacccctagaaaaaacccactgctccgcctcgcctcacgccaccacggggggagcgggagcccgcgttctgtgccctccgcgccgctgcagcccctccccctgtccaggcggagagatcaggttgccagagcggaggggggattggaattggagcgccagcaccaccacagatggggggtctgctcaaggaacagggcccggcggtggatgtctccgcggagggtaccctggtctggctgcgccgccccaacagctcctggtggcccagcatcgtcatctcgccacaagatgtcctcgaaggctgcgccccgccgccgcgctgccccgccgaccccatcatgcttctcaggccgtcacccactactgatcaatcctccttccgacctggtgcaacccagggccagggagccagggggcgtcaaagacccttcccgcctgacggggggagcttcctaactttccaagcaagccgcaataaaccaaacggccccttcaacacttcggccacgaccagacgggtctaaaaaaggggcacaaaccttggaaagccttaaccaaatatagagggccttggggttttcccccccccccccccttgtgtaaaggagggacgtgccccatattttctttctccaaagggagcccctttcctaaatccctttccgcaatataaggggggaataggcccggggtttcttttgggggacccccggagcataaaacaacaagagggcgctctgaacgcttccccaaggtgcgcccccaccaggatgatgcgcgtcaaacccttaaatttccccaaaacaggttttgtggaaaattggcgcccagagccccaatcataagatgcggacaaaaacgacctgaaccacccaaaaagtggaatatccgttttttcagaaccaagtctccagactggcccttttagtcggggcgggaccaccagggtccaagaaaggaaatctccaccaaaagcccccttataacccccccaagggacaaaacccc

SEQ ID NO: 91735 - DNA, 1026 bp, Zea mays
  misc_feature: Ceres CLONE 1580224
  misc_feature: Translation starting site: 233
  misc_feature: SWISSPROT Homolog: EC 1.1.1.22 UDP-glucose 6-dehydrogenase
ctccccgcggtggcggccgctctagaactagtggatcccccgggctgcaggaattcgtctcacccctagaaaaaacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatgggcgtcattgccctcaagtgcccagacattgaggtcgtcgtcgttgacatctccgagcccctcattgaggcctggaacagtgacaccctgccaatctacgagcctgccctcgatgatgttgcgaagcagtgcaggggcaggaacctcttcttcagcactgatgtttgagaagcacgtcgctgaggctgacattatctttgtctcggtgaacacccccaccaagacccgtgtggctggagccggcaaggtctgcctacctcacctactggggagagcgctgtcccgcatgattgccggatgtttctccacgtctgacaagattggttggttgagaagtcctcttgttccctgttctagaccgcctaaggcttttgtaggaagaattttggaccacacaaccagcaggggcgattaacttacaggacccttttccaacccaaaaggtttcctttgcgaagggcacctgtcccattgggaggaacctcggtccaaccttggacagagtggttttattgctgggccgggagacccccttagaggcaggaaaggcccgtccagagcctctcagggtagtgtcatccctctctgtgtctcccgcaagtaacggatttctcccccacaaactttgtggtctggctgagcttttacaaggctccctgcctaacccgtttccgtgcgaagtatgtatttcttcttggtaagaccatcttcggccctcttgacgaggccacccggtccctagt

SEQ ID NO: 91736 - DNA, 855 bp, Zea mays
  misc_feature: Ceres CLONE 1580226
  misc_feature: Encodes the peptide sequence at SEQ ID NO. 91737
ctccgcggtggcggccgctctagaactagtggatcccccgggctgcaggaattcgtctcacccctagaaaaaacacagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctgtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctgccaatctacgagcctggcctccatgatgttgtgaagcagtgcaggggcaagaacctcttcttcagcactgatgttgagaagcacgtcgctgaggctgacattatcttttgtctcggtgaacacccccaccaagaacccgggggcttggaactggcaaaggcttgcccaactcaccctactggggagaacgcttgcccgcagtgattgcgggaatgcctcccagttctaaacaaaaattgttgttggaaaaagtcccctggtcccgggtcaagaccccctgaggggtttttggaaaaaattttgaaccccccaacagcaagggggcttcaatcttcccgaaaccctttttcaaacccacaaaattcccttgggggagggggccggcccctatttggggaacccgtttcaaaacccctgaaaaaagaggctttttcgggtggggcgcggggaaaacccccttgagaggggggggggagg

SEQ ID NO: 91737 - protein, 114 aa, Zea mays
  misc_feature: Ceres CLONE 1580226
  misc_feature (2)..(114): Pfam Name: UDPG_MGDP_dh_N Pfam Description: UDP-glucose/GDP-mannose dehydrogenase family, NAD binding domain
  misc_feature: SWISSPROT Homolog: EC 1.1.1.22 UDP-glucose 6-dehydrogenase
MVKICCIGAGYVGGPTMAVIALKCPDIEVVVVDISKPRIEAWNSDTLPIYEPGLHDVVKQCRGKNLFFSTDVEKHVAEADIIFCLGEHPHQEPGGLELAKACPTHPTGENACPQ

SEQ ID NO: 91738 - DNA, 814 bp, Zea mays
  misc_feature: Ceres CLONE 1580228
  misc_feature: Encodes the peptide sequence at SEQ ID NO. 91739
ctccccgcggtggcggccgctctagaactagtggatcccccgggctgcaggaattcgtctcacccctagaaaactcatccgatgggcaagtcaagcaagaaggcggccgccgtggctgcggcgccagcggcggtgcccaaggggaagaagcgggaggcggaggacgagatcgagatggccgtgagcgcgaagaagcagaaggcggcgccaccggcgaaggccgtgccgacgtccaagaaggacgccaaggaggacgccaagtccaagaagcagccgccccccaagaaggctgagaacagcagcagtgactctgaagaggaccccgagtccgaagaggagaatttttataatttgattgagtcggggagggtagacggagatgaggagtttgacgaggacgaggaggacgggttcgagttcggtgacgctgacgaggcgatgcaatgcgtggtgatggcggatagcagcaccaccgccgcggcgctgcgtgctcacacgcaggactacgaggcgctagctgcgcacaagcgcaaggcccttgccgagagcaaccccagagggaggagggtcccaaaagggcaagaccggaccaactttcagaagcagaagcagcaaccatgttcgaccaactgatggaaagctttggtctttagcgtaaagaaagtcaaaagatggcaagagaaggggaagaaagataggacaagaattagggcagtgctgaagttattaaaaaggtgggtgatgctactctacttttcgctgaagaaaaatttacgaggcaatactatacctactgaggatgggcgatttgcct

SEQ ID NO: 91739 - protein, 183 aa, Zea mays
  misc_feature: Ceres CLONE 1580228
MGKSSKKAAAVAAAPAAVPKGKKREAEDEIEMAVSAKKQKAAPPAKAVPTSKKDAKEDAKSKKQPPPKKAENSSSDSEEDPESEEENFYNLIESGRVDGDEEFDEDEEDGFEFGDADEAMQCVVMADSSTTAAALRAHTQDYEALAAHKRKALAESNPRGRRVPKGQDRTNFQKQKQQPCSTN

SEQ ID NO: 91740 - DNA, 809 bp, Zea mays
  misc_feature: Ceres CLONE 1580229
  misc_feature: Encodes the peptide sequence at SEQ ID NO. 91741
  misc_feature (609)..(609): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (693)..(693): n is a, c, t, g, unknown, or other
  misc_feature (694)..(694): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (776)..(776): n is a, c, t, g, unknown, or other
  misc_feature (800)..(800): n is a, c, t, g, unknown, or other
  misc_feature (801)..(801): n is a, c, t, g, unknown, or other
ctccccgcggtggcggccgctctagaactagtggatcccccgggctgcaggaattcgtctcacccctagaaaaacccacactcctatccttctcgccttcgactgcccagagcgccccagcgcccgcgaagcttctagaacacgcgacgcgggcgagcgagctggcgggtgggcgaggcaaaactaaggaggcgggaggggcggcgatgcggggcaggtgacgctgcggcgcggcgtgggggatggtggcggcggagggtgggcccggcggggccgtccaggagggcgtcggggagagctcgtccccgccgcgcgaggacgccgtcccagcgcccgccggctccggcgggagcgggggcagcggaggcgcccgcgaaatctgtgcccaggtgctcgaccgcctcgtcgccgacggctacgcggaggcgtccgacctcgagttccgcgacaggctcggcgcccatttcggccggctcccgcacagctatcagctggatattcatgttgacacagcatccgatgtcttggtccaccagaacgtcttagcggaagcaaagatcctgataggcgccctgcatttctatgtgccgtttctgaagattgaagaanattggatccgcatacgatccgatgatctgaagaagggatgannnnnnggggggggaatttctccgtaaggggggagaccacatnnatttactccctcnnnccatgaaaaagtgtcnnnnnncccatcgataagccaaggccctctttcaggcatttggcttggcttnttgcgaaatgggtttgaacccccnnaaaaagaa

SEQ ID NO: 91741 - protein, 135 aa, Zea mays
  misc_feature: Ceres CLONE 1580229
  misc_feature (123)..(123): Xaa is any aa, unknown, or other
MVAAEGGPGGAVQEGVGESSSPPREDAVPAPAGSGGSGGSGGAREICAQVLDRLVADGYAEASDLEFRDRLGAHFGRLPHSYQLDIHVDTASDVLVHQNVLAEAKILIGALHFYVPFLKIEEXWIRIRSDDLKKG

SEQ ID NO: 91742 - DNA, 805 bp, Zea mays
  misc_feature: Ceres CLONE 1580237
  misc_feature: Encodes the peptide sequence at SEQ ID NO. 91743
ccgcggtggcggccgctctagaactagtggatcccccgggctgcaggaattcgtctcacccctagaaaaaccccgctcgagcttgataaaacacgcaaggctgtctgcctgtctctgctcccatctagaaatccacttcgattcgccctggacgctcctgcctcctgctagtcgacgcgcaatccttggcaatctggcagacaggtgaggcgctgagcctgctactactaactaggagccgcggcgggaaatgagggatgcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcaccctctgccgcgcgctcgtccaggccgcctgctacccgctcgccgcctacgcctccgcgcgccacgatcgggcccgtgtcgtcgccgtgggagccttcctctgggccgccgccaccttcctcgtcgccgtctccggcagcttcctccaggtccgtccgtctcccccgattcctcccaactctttcccctctcctcctgtcgctgacgtggcggaaccactgctccacgtttctcccgcagcacgtggttggcattgcactggcaccttactaccaccaaacgtagcggttattcggattattcctatttcattttcgcaacacaaaataaaaagatgttcgggtgatattttggtgcatcctctgaaacgggggcccatccactggacttggcaaccg

SEQ ID NO: 91743 - protein, 185 aa, Zea mays
  misc_feature: Ceres CLONE 1580237
MRDAEAASRRRWTLVLVNMASVLEKADEVLLPAVYKEVGTALGASPTALGSLTLCRALVQAACYPLAAYASARHDRARVVAVGAFLWAAATFLVAVSGSFLQVRPSPPIPPNSFPSPPVADVAEPLLHVSPAARGWHCTGTLLPPNVAVIRIIPISFSQHKIKRCSGDILVHPLKRGPIHWTWQP

SEQ ID NO: 91744 - DNA, 1163 bp, Zea mays
  misc_feature: Ceres CLONE 1580238
  misc_feature: Encodes the peptide sequence at SEQ ID NO. 91745
tttaagtgaatacatcgccgggtgagagtcaacggaggccagcacgccaccccccgcaccgaagagtttcaaactggagctccccgcggtggcggccgctctatactagtggatcccccaggctgcaggatttcgtctcacccctagaaaaaagaggcgcgctgttgcggaaatgccgctcccggcgttcctggcggcggcggcgaggctcgcggtcctgctggccgccgccgtgactgcggccaacgcggcctccttcgcgcgataccggcgccgccacctccgccgcatccccaaccccatcgacgagtccgccgaccccgtcgccgacttccacgccctccgccccgcctccgccgaggacgccgcagcagaagatgacagcttcttctttgggctagcgaccgcgccggcacatgtggaggacaggttggaagacgcttggcttcagtttgcggtggagcactcatgtgacgacaacgaggccatgcagcgaccctacgacatcagcattctgtgatgagcatccactgcacggagtacagaaggtgctcagcatggcattctcagtaaggacggacagacggggattgatggatagggaatggcccatgcaacaattttaaagtaaaccatatttaacgaatcacccaccagaataaccacataattcaagcgggctaactgctcactgcataatacggtataatgaatcagtccacgatacacacacccctgtctacatacggattgctctaagttattactatttctaatgagtatgatatcggacgaaggacccggaggcgggtggaacaccacaaatgttacctctctcgtgttcacaattctaaagaaataacccctcctaatctccacagttggtcactactatattcgcaatccttattatgatacaattccccaacgctcttaggggggtagctcagtcgggcgcacgggtatctctgagtagctcgcgcaccggacgcgccgctgtcgtgcggatagcggaattggcaagtgtgcaatcgttcagacgctcgtgcccccgctagatctcctagtcatagaacaccacagtcgcctcttcttttgtgtgtgatgataccagacgtcaacacctggttgtggagttaacaaagtacaaaatcaagaccaaa

SEQ ID NO: 91745 - protein, 115 aa, Zea mays
  misc_feature: Ceres CLONE 1580238
MPLPAFLAAAARLAVLLAAAVTAANAASFARYRRRHLRRIPNPIDESADPVADFHALRPASAEDAAAEDDSFFFGLATAPAHVEDRLEDAWLQFAVEHSCDDNEAMQRPYDISIL

SEQ ID NO: 91746 - DNA, 815 bp, Zea mays
  misc_feature: Ceres CLONE 1580239
  misc_feature: Encodes the peptide sequence at SEQ ID NO. 91747
ccccgcggtggcggccgctctagaactagtggatcccccgggctgcaggaattcgtctcacccctagaaaaagtgagaggctccatgaagatcctggtcgcggtgaagcgggtggtggactacgctgtcaaagtgcgcgtgaggccggacgggaggggcgtggagacggccaacgtgaagatgtccatgaatccattctgcgagatcgccgttgaggaggcgctgcggctccgggaggccggcgtcgccgctgaggtcgtcgccgccaccgtaggccctgcccagtccgccgacacgctccgcaccgcactcgccatgggcgccgatcgcgccgtccacgtgctccacgacccggaccctgcgcggcccctcctccctctcgccgttgccaagatccttcgcgccgtcgcgctccaggagaagcccggcctcgtcatcctcggcaagcaggcaattgatgatgattgcaaccaaactggacaaatgttagctggattgctcaagtggccacaaggaacctttgcctccaaggttacattggacacagaaaaacaaaaagctactgttgagcgagaagttgatggtggaattgaaaccatctgccttgatctgccagcagtgattcacacggatttaagacttaaccagccaagatatgcaactttgccccacataatgaaggcaaaatccaaagttattaaagaaagtcgccgctgaaagaccttgggcgtagattttagatcagaaccgggaaggtgattgaggtcaatgaaccacccaaaccaaaaagcaggggtggattcttttcacgttgt

SEQ ID NO: 91747 - protein, 210 aa, Zea mays
  misc_feature: Ceres CLONE 1580239
  misc_feature (23)..(210): Pfam Name: ETF Pfam Description: Electron transfer flavoprotein domain
MKILVAVKRVVDYAVKVRVRPDGRGVETANVKMSMNPFCEIAVEEALRLREAGVAAEVVAATVGPAQSADTLRTALAMGADRAVHVLHDPDPARPLLPLAVAKILRAVALQEKPGLVILGKQAIDDDCNQTGQMLAGLLKWPQGTFASKVTLDTEKQKATVEREVDGGIETICLDLPAVIHTDLRLNQPRYATLPHIMKAKSKVIKESRR

SEQ ID NO: 91748 - DNA, 895 bp, Zea mays
  misc_feature: Ceres CLONE 1580241
  misc_feature: Encodes the peptide sequence at SEQ ID NO. 91749
ctggagctcaccgcggtggcggccgctctagaactagtggatcccccgggctgcaggaattcgtctcacccctagaaaaaaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatcaagtactacacggaatgctttgggatgaaactgctgaggaaaagggatgttcctgatgagaagtacaccaatgccttccttggctttgggccagagaacaccaactttgcagttgaattgacatacaactatggcgttgacaagtatgacattggaacgggctttgggcatttcgcaattgctaatgatgatgtgtacaagttagctgagaatatcaaatccaacggtggtaagatcacccgcgaacctggtcctgtcaaaggaggatccactgttattgccttcgcacaggatcctgatggctacatgttttgagcttatcccgagggggtgacacacctgagccctctttgcccaggtcattgcttcggtgttggtgagactttgaagcgtttccatccggttttttattaacaaaagccctaaggagatcaaaaacccccttaaaggaaaaaaagaaacgtgcccctgaattttaccacacctttcaccctttgcccacatttactgggggcccctgtcctttgatttgtgggaaacaaaagatacaaaccctgag

SEQ ID NO: 91749 - protein, 143 aa, Zea mays
  misc_feature: Ceres CLONE 1580241
  misc_feature (24)..(143): Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
MATGSEASKAAEAVVDWHKHDSKRMLHAVYRVGDLDRTIKYYTECFGMKLLRKRDVPDEKYTNAFLGFGPENTNFAVELTYNYGVDKYDIGTGFGHFAIANDDVYKLAENIKSNGGKITREPGPVKGGSTVIAFAQDPDGYMF

SEQ ID NO: 91750 - DNA, 844 bp, Zea mays
  misc_feature: Ceres CLONE 1580243
  misc_feature: Encodes the peptide sequence at SEQ ID NO. 91751
ctccccgcggtggcggccgctctagaactagtggatcccccgggctgcaggaattcgtctcaccccctagaaaaaaactgattatcgctccaatattttgtgggatgagtatattaagtatgaagagtcactggaggcatggagtcacctcgctgttatatatacaagagtattggaaaatcccatccagcagcttgatcgctattttaattgcctcaaggaattggcttcaaagcacagtttttccgaaatacttactgcggaagaagcctcggtgtatgttgtcacgtctgagaccagtgctcaagcgcctgatggtgacacacatcctgatgatgttgataagcctggtcaaccagaactttcatctctggcagatgcagaaaaccttgcaaagtatgtctccatgagagaagagatgtacaagaaggctaaagagtacgaatctgagatcattggttttgagctagctattagaaggccatattttcatgtcaagcctcttgacaatccagagcttgaaaattggcatagctaccttgactttatcgagaaggaagaagacattaataaggttatcaaattgtatgaaaggtgtgtgattgcatgtgctagttactcagaattctggatccgctatgtgcaatgtatggaggataaagggagtctagacctagcatacaatgccctggctcgtgctactcatgtgtgtgtcaagaagcagccggagatccatctgtttagtgctcgctttcaggagctcaggggaaatttttcctgggaagcacctgcagagtatcagcatctttactcagatttatgtcctggctttctagaaggcatc

SEQ ID NO: 91751 - protein, 146 aa, Zea mays
  misc_feature: Ceres CLONE 1580243
MREEMYKKAKEYESEIIGFELAIRRPYFHVKPLDNPELENWHSYLDFIEKEEDINKVIKLYERCVIACASYSEFWIRYVQCMEDKGSLDLAYNALARATHVCVKKQPEIHLFSARFQELRGNFSWEAPAEYQHLYSDLCPGFLEGI

SEQ ID NO: 91752 - DNA, 826 bp, Zea mays
  misc_feature: Ceres CLONE 1580246
  misc_feature: Encodes the peptide sequence at SEQ ID NO. 91753
ctccccgcggtggcggccgctctagaactagtggatcccccgggctgcaggaattcgtctcacccctagaaaaaagagccatcctctgggatagtactggcattccgaagagaagcggggggaggcgaaggcaacaggttcgccgttccgagtcgtccgtcgcctgcccgctgcccgttccgggcgcctccgccccgtttcgtcgaccacctctccggcgccgccgtcctgagccgtcgcacgcgccacgggggcgcctcccgcgcgcgctccctacgccggctccgccccgccccgccgccatgggctccagagtccttcacttagacgttcctgcaaattctgaggcctatcttatgagaaatgtaccagggagtgtaagtagccctcccatgaatggtgaaaagggtctctttcgaaatcagaatgcggggttcactgcacttgcaagtcctgtgaggagagaaatcggaaacagatcgtcgacaaggtccttctgtgttgatgacaatgacttggaagatggtaaggcctcaaaagaaagggagagttctgcacagtcactcaggctccccaagattcagaatcaagctctcttatctggtctggcttactgcatatcatcatgcagcatgatcttagtcaacaaattgttctatctagctatggtttcagtgctccagtatttttgatgctttaccagaaccatgtatcagtgaccattggttctacactatcccttgtccggtgctgttcccaactgaaccattgacatggaaatttaatccaaagtttgggtggcctggtaataatcactctttggtga

SEQ ID NO: 91753 - protein, 129 aa, Zea mays
  misc_feature: Ceres CLONE 1580246
MGSRVLHLDVPANSEAYLMRNVPGSVSSPPMNGEKGLFRNQNAGFTALASPVRREIGNRSSTRSFCVDDNDLEDGKASKERESSAQSLRLPKIQNQALLSGLAYCISSCSMILVNKLFYLAMVSVLQYF

SEQ ID NO: 91754 - DNA, 889 bp, Zea mays
  misc_feature: Ceres CLONE 1580249
  misc_feature: Encodes the peptide sequence at SEQ ID NO. 91755
tccccgcggtggcggccgctctagaactagtggatcccccgggctgctggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagcccgcggctggtatggatcccaatggcctcaaaactggaggccttttgctcccgatcatcgagatgcggtgcacgtcgcctccatccgtcattgtcatcggcggtgggcatctcgggcgttgtcagctgcccgtgcccctctccaaattcttcattttaagggtgactgtttttggaaatccgagagaatcgtatttggccgggccgcaatcatacctgaattaacccgttttgggatgtcccaaattgattttgggaaggcctcatgggcctacccgcggcttgtggcaaagtaggaatcccacttgggcacccattggattaagcctaatctttgtgggcctggaaggtttatttccggccacaaagccgaagtgaattaacctccaggtttccggtgattgatctccatgaatcttctagaa

SEQ ID NO: 91755 - protein, 70 aa, Zea mays
  misc_feature: Ceres CLONE 1580249
MDPNGLKTGGLLLPIIEMRCTSPPSVIVIGGGHLGRCQLPVPLSKFFILRVTVFGNPRESYLAGPQSYLN

SEQ ID NO: 91756 - DNA, 805 bp, Zea mays
  misc_feature: Ceres CLONE 1580252
  misc_feature: Encodes the peptide sequence at SEQ ID NO. 91757
agctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccagggcacctacgacagcttcgactacgaccgcttctccccctactgcggcagctgcaaagacccggcgaagactttctttcacgacgtcgggcctcgcgggatcggctacgaggttacccgctaccttttacgccacctgcaaaggactccaagttcccaaaatttcggaaataagaagggcgccaacccccaaaaatttggagcgaatcccgggccttttt

SEQ ID NO: 91757 - protein, 185 aa, Zea mays
  misc_feature: Ceres CLONE 1580252
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQGTYDSFDYDRFSPYCGSCKDPAKTFFHDVGPRGIGYEVTRYLLRHLQRTPSSQNFGNKKGANPQKFGANPGPF

SEQ ID NO: 91758 - DNA, 1186 bp, Zea mays
  misc_feature: Ceres CLONE 1580253
  misc_feature: Encodes the peptide sequence at SEQ ID NO. 91759
  misc_feature (57)..(57): n is a, c, t, g, unknown, or other
  misc_feature (58)..(58): n is a, c, t, g, unknown, or other
agagaatttaggcttttataacaaaacacaaaccacaacaaaaaaaaaaaatgttgnngtggtttttgtttttttttcaaactggagctcacctcggtggcggccgctctagaactagtggatcccccgggctgcatgaattcgtctcacccctagaaaaaaccccacgccttgtctctgaactctgatcagagatcaaagaggtagccgttaagttaacgatggcttccgccgacctcgcagaggccatggagcccgggaagaagagcaacgtcaagtatgcttccgtctgtgccatcatggcctccatggcctgcgtcatccttggctacgacattggtgtgatgagtggggcggcgatttacatcaagaaggacctgaagatcacggacgtgcagctggagatcctgataggcatcatcagtctctactcgctcttcggatccttcgctggcgcgcggacgtccgacaagatcggccgccgcttgaccgtcgtcttctccgcggtcatctgtttcgtgggcgccgttgctcatagggattctccgttctactacctgcatgcttcatgggtggggcccgcattcctgggcccggaagttcggccgttggggcctaactggggggcatggaattctccgtccccgtggataatcacccggcacgggagaaaatattcggacacctggcggggccgttatcccgcgggcaggtgctttatccacgtccatctcagttaccctcttttcatccctctggaaaaaagagatctccttccctatttcccgaatgaatccacttctggaggagcttatattcccattgtggcctttttcgggtggcctttatccctcctgggatttctgaataaacctctaatactacatctatgttatgtgttgcgggaggagccctttattcctccgagcttttatatctaaccacgtttgtcatgatctatggggactattatgtcttttatatggtcatttcccgaggtccatatttcggggtcggctcaatgggtatatcccagaattcacagatctcacatgtgaggtttttctaaactccaatcgcatagggagatggtttttcgataggcgttgaatcactccataatatacagcgccctcccgacgtcggaacactattaatcctatctcagaagagggacgccccacca

SEQ ID NO: 91759 - protein, 230 aa, Zea mays
  misc_feature: Ceres CLONE 1580253
MEPGKKSNVKYASVCAIMASMACVILGYDIGVMSGAAIYIKKDLKITDVQLEILIGIISLYSLFGSFAGARTSDKIGRRLTVVFSAVICFVGAVAHRDSPFYYLHASWVGPAFLGPEVRPLGPNWGAWNSPSPWIITRHGRKYSDTWRGRYPAGRCFIHVHLSYPLFIPLEKRDLLPYFPNESTSGGAYIPIVAFFGWPLSLLGFLNKPLILHLCYVLREEPFIPPSFYI

SEQ ID NO: 91760 - DNA, 830 bp, Zea mays
  misc_feature: Ceres CLONE 1580254
  misc_feature: Translation starting site: 174
  misc_feature: SWISSPROT Homolog: EC 6.2.1.3 Long-chain-fatty-acid--CoA ligase
ccccgcggtggcggccgctctagaactagtggatcccccgggctgcaggaattcgtctcacccctagaaaaaatcgccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccggggtggggatctacggagcgaactgtcctcagtggatagtggcaatgcaggcttgcaatggctatagtctagtctgtgtcccactgtacgatactttaggtgcgggaactgtcgactacatcatcgatcatgccgagatcgatggttgtctcattccgggccaggaaaataaaagagatactggtccccaaactgcaaatctggcccaaaagactgaaaagcattggtggggggttcaccttcgggggacaaactggaaccgaaaaaaagaaaaccggaattcaaaattgggggatccaaaaatgtttttgcctcggggaaaccaattttcttt

SEQ ID NO: 91761 - DNA, 895 bp, Zea mays
  misc_feature: Ceres CLONE 1580256
  misc_feature (437)..(437): n is a, c, t, g, unknown, or other
ctccccgcggtggcggccgctctagaactagtggatcccccgggctgcaggaattcgtctcacccctagaaaaaagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggtaaggaaccctaatttggtcagatgggatttccaacttcgacaaagcccgcgaggtcgatcgatctcagttgacgcgagggattggaaaactaagttgcgggtgtagttaattttctaagaagattggggtttcagctcaaacttccatgctcgacgctgaagacgaaccctggccggagatgaccaggatcctcntgcaacgcgggaaccgccggttcctcgtcagcttcggccggtttggaacaccaacccgtgaaaccgggaacaactgcccgggagggaggatttccccttaaaccttaaaccaagtttgcgggaatttttgggccaaggagaaacccccgggaaatttaaaaggggggggcggggaaatttccccaaaaacccttttggggggggggtaacccctttttaaaaagctctcgcccccccaaaaaaaaaggggttccccgggaaaaacccttttaagggggccttttttgggttaccccccccctttttttaaaagaaaaaccccggggggggcccccccccccctccaaaagggggggaaaaaaatttttgggggggcaccccgggttttcccaaaagagggggggggggggtttcccccccccccggtgggggtcttcctcaaaaaaaaccgggggggg

SEQ ID NO: 91762 - DNA, 895 bp, Zea mays
  misc_feature: Ceres CLONE 1580257
  misc_feature: Encodes the peptide sequence at SEQ ID NO. 91763
tccccgcggtggcggccgctctataatagtggatcccccgggctgcaggaattcgtctcacccctagaaaaaattttctgctactggcaatgttgcccaggctgatgctaagaacactttccagcctccatctcaagtgaaacatggttggggcggtgttccaggtcgcccttccatggctgaaatagtgaagatgggccggcctcaagctaaagttgggagcagatctgttgcaagtagcattgtcatgccagctattggtgattcagccattctcaatacaccaaatcttgcgcccaatgaatacaaccaaactgtatttgcatcagaagtaggccatggtgcagcagataaattgccaaatgttgccgatgaggtgcactctgtatctaaacacccctcctcacttgatatgttaccttcagcagagggaacagatgttgaagccccttccatgagtgctaacatgcaaggttcatcaacgccagatgccaatgaagatgacgttgaaaaagacacaaatttggaagagggcaatacagaaaagcttggcgactcctggacaagtttctgcttctggtaaaggtattacttcagaatatactgaacttggtcagccatcctggatgaaaggctcgaagggagaaaaacagatgaacttttcagcctcgaatgctcctttcaatttaaacaccaatcctaaattctgaaatgggaaaaatgtggtctaaccaaccaacaaacccaatttgtggaatccattttgaaaccccttgcctctgaatgtggaacaaacaatgtggtctcggaatgaaagaaaatccggggctggtgtaaaataagatccccccgtggggcacaatttctttcaaggggtttttctaaaaacgcccag

SEQ ID NO: 91763 - protein, 135 aa, Zea mays
  misc_feature: Ceres CLONE 1580257
MAEIVKMGRPQAKVGSRSVASSIVMPAIGDSAILNTPNLAPNEYNQTVFASEVGHGAADKLPNVADEVHSVSKHPSSLDMLPSAEGTDVEAPSMSANMQGSSTPDANEDDVEKDTNLEEGNTEKLGDSWTSFCFW

SEQ ID NO: 91764 - DNA, 973 bp, Zea mays
  misc_feature: Ceres CLONE 1580258
  misc_feature: Encodes the peptide sequence at SEQ ID NO. 91765
  misc_feature (973)..(973): n is a, c, t, g, unknown, or other
ggagctccccgcggtggcggccgctctagaactagtggatcccccgggctgcaggaattcgtctcacccctagaaaaaacgcgcgcgcgatccctcgcctacctccggtccctgcccgcctgttgctgtatttatttccgcctcgtctcttccccatctcgacagcatcactgccgtgtagtgtagctagagcccgtgcactggtccggattcgcagagcaaaacggaaatgatcacggtggcagcaccggaggcgcagccgcaggtggcggcggcggcggcggttgcggcgccggaggagaccgtgttccggtcgaagctgccggacatcgacatccccacccacctgccgctccacgactactgcttctcgagggcggcggaggcggcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatggtcctgctccagaactccgtcgagttcgtgctcgccttcttcggcgcgtccttcctcggcgccgtcaccacggccgccaacccgttctgcacgccgcaggagatccacaagcaattcagcgcctccggcgcgaaggtcgtcgtcacccactccgcctacgtcgccaagctccggcacgacgcctttccgaggatcggcgtggacggcaatgccctcaccgtcctcaccatcgacggcgacgcggccgacaccccggaaagctgcctggcgttctgggagctgctcacgtccggcgacagcgaccccctcccggagtgtccatcttccccggacgaccccgtggcgcttccgtttctcgtcgggggacaagaggctggccaaagtcgttcgtgctgaaccccggtggcacaggcacgaactgtgggccatccaggtgtacggagcggaaccccatcn

SEQ ID NO: 91765 - protein, 227 aa, Zea mays
  misc_feature: Ceres CLONE 1580258
  misc_feature: SWISSPROT Homolog: EC 6.2.1.12 4-coumarate--CoA ligase
MITVAAPEAQPQVAAAAAVAAPEETVFRSKLPDIDIPTHLPLHDYCFSRAAEAAGAPCLIAAATGRTYTYAETRLLCRKAAACLHGLGVAQGDRVMVLLQNSVEFVLAFFGASFLGAVTTAANPFCTPQEIHKQFSASGAKVVVTHSAYVAKLRHDAFPRIGVDGNALTVLTIDGDAADTPESCLAFWELLTSGDSDPLPECPSSPDDPVALPFLVGGQEAGQSRSC

SEQ ID NO: 91766 - DNA, 1280 bp, Zea mays
  misc_feature: Ceres CLONE 1580262
  misc_feature: Encodes the peptide sequence at SEQ ID NO. 91767
  misc_feature (17)..(17): n is a, c, t, g, unknown, or other
  misc_feature (717)..(717): n is a, c, t, g, unknown, or other
ttttgtgttcttttttntttgcgaattaaaaaaccacccacaaaatccaaactgccaaaaaaaaccctagatttttcaaaactggaactccccgcggtggcggccgctctctaatcgtggatcacggggttgctgtaatgtgtctcttccctaaataaatgacggacaacggcatccacaacgacctgaactcgctcggcaaagctaactacccgccctacggcatcgacttctccggcggccccaccggccgcttctccaacggctacaccatggtcgacgagatcgctcagctgctgggcctgcctctgctgccatcgcacacggacacggcgtctagcggcggcggcgacgcggcgctgcaccgcgtgaactacgcgtcggcggcggcggggatcctggacaacacggggcagaacttcgtggggcgcatcccgttcaaccaccagatcatgaacttcgagcagacgctggagcacctgcggcgccggacgacaacgaataaggcccggggcgcggggcgccggtcgggctgggagccggagcaatcctccttccgtggagccatgtggccagccaagcgtacctacccgtctggcaaaattagccatctagggccccaaagttaatcagacatctccccgccaaccgaaagtatacaaaaccgggccgcgacaccagtgtaaccctctcctaccaatcttgttcttgtggggnggttcgtccccaattacttaaacaacacctcagagggggacaagagctctctgcggaatcgccccgcgcctcatttattattagacgagaggcccctctcttgggggggggcctcatgagcccctcccacgccccaaagaggtatttattccctctttttctaaatttactcaccccccctaatgtggagaacatggggagggcctttttctacagatcgtggggacacctcgggtggagaattttacccgctccccaacaccacattatgttgggcacggcgccatcgagtagaaataaccccctcgcgagggaagaaaaatatggtggtgggcctatccgtcccccccgggaggtgcttcgcgaacatgaaacctttcccaaagtcaaatacgtgccttttggtctccacaccaccctcaagggagtgtataagagggacgccgagtgtgtggtataccataggccttgttcaactgtccctaaaacccgcgctccgggagaacagtgttagagtttctatttgtctagacttgtcaaaaaagactcacgcgcaaatagga

SEQ ID NO: 91767 - protein, 156 aa, Zea mays
  misc_feature: Ceres CLONE 1580262
  misc_feature: SWISSPROT Homolog: EC 3.2.1.51 Alpha-L-fucosidase
MTDNGIHNDLNSLGKANYPPYGIDFSGGPTGRFSNGYTMVDEIAQLLGLPLLPSHTDTASSGGGDAALHRVNYASAAAGILDNTGQNFVGRIPFNHQIMNFEQTLEHLRRRTTTNKARGAGRRSGWEPEQSSFRGAMWPAKRTYPSGKISHLGPQS

SEQ ID NO: 91768 - DNA, 947 bp, Zea mays
  misc_feature: Ceres CLONE 1580265
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
nnnnnnnnnccccnnttccccttccttgaactttttactttttttatttttttaatatctattttttgaggcaaggtgggggaggttgggagctcccgcggtggcggccgctctagaatagtggatcccccgggctgcaggaattcgtctcacccctagaaaaaaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaagataagtgggagcctccgggcgcaagtgaaataccactacttttaacgttattttacttattccgtgggtcggaagcggggcaccgcccctccttttggctccaaggcccggcctcgccgggccgatccgggcggaagacattgtcaggtggggagtttggctggggcggcacatctgttaaaagataacgcacgtgtcctaagatgagctcaacgagaacagaaatctcgtgtggaacaaaagggtaaaagctcgtttgattctgatttccagtacgaatacgaaaccgtgaaagcgtgggcctatcctatcttttaaaccattcgggagttttgaagctagaaggtgtcaagaaaagttaccacaggggataaactgggcttggtgggcagccaagccgttcattagcgaacgttgccttttttgaatcccttccgatgtccggctccttcccttatcattggggaaagcagaaattccccccaagttgtttgcgaattgtttccaccccacccaaattagggaaaacctggaggcctggggtttttagaaaacttcccaaaaaccagtctccccccgcgggcgtttgaacaaccttgaagggggccgcccatttcct

SEQ ID NO: 91769 - DNA, 820 bp, Zea mays
  misc_feature: Ceres CLONE 1580266
  misc_feature: Encodes the peptide sequence at SEQ ID NO. 91770
  misc_feature (687)..(687): n is a, c, t, g, unknown, or other
  misc_feature (721)..(721): n is a, c, t, g, unknown, or other
  misc_feature (722)..(722): n is a, c, t, g, unknown, or other
  misc_feature (772)..(772): n is a, c, t, g, unknown, or other
  misc_feature (814)..(814): n is a, c, t, g, unknown, or other
tccccgcggtggcggccgctctagaatagtggatcccccgggctgcaggaattcgtctcacccctagaaaaaacctctcgccatttcttctcactagctgacgaagtgacgtcgattacgactgatgcacctcctactatggctgctgtgcttaacagctcgaacacccctctggtggttgccgtgctggtggctgcggcgcttctggcctcgctccacttcatgcaagagatcccctgcgggcaggagggatcgtcactagctcccttcctactacacccgacaggcaggggcagctctctcctcgcgtcctgatgccgcgcccttctgagtctcatcggcacggcacgtaccagcccgcaccgccctgtcgcgtgaccctgtctcaagacccttcctaacaggggtgagaccgtcaacatggggaccgtcgcctctatccccggcaagtgccgggtctccgtcagattccccatctctatgtccactgactgcaacaatatcacctaagttataccaccacccatctaataagactacttaacgtacacgtacttcccgcgcgctgctacgcgtgatgaagccagctgaacatataaaataaagctagctgtattgccagaagccggatacagtatcgatcaatatatatactgtactgtagtactctactacatatgtatgtgngggggcctgcatgtgcgaactcgcttctgtcccnnactctacgtgccgtgcgacccaccgcgggtgcccgcctgccttcaacgtngcgctgccaaactgccagtcttaggtctcctatgctgactgngtcccg

SEQ ID NO: 91770 - protein, 58 aa, Zea mays
  misc_feature: Ceres CLONE 1580266
MAAVLNSSNTPLVVAVLVAAALLASLHFMQEIPCGQEGSSLAPFLLHPTGRGSSLLAS

SEQ ID NO: 91771 - DNA, 933 bp, Zea mays
  misc_feature: Ceres CLONE 1580267
  misc_feature: Encodes the peptide sequence at SEQ ID NO. 91772
  misc_feature (876)..(876): n is a, c, t, g, unknown, or other
  misc_feature (897)..(897): n is a, c, t, g, unknown, or other
ggagctccccgcggtggcggccgctctagaactagtggatcccccgggctgcaggaattcgtctcacccctagaaaaaaaccaccaactcgcgatccatcgatttgcagaacaccacccaacagccaaaccatcactcgatcggtagacatggataaggcctacatcgccgccctctccgccgccgccctcttcttgctccactacctcctgggccggcgggccggcggcgagggcaaggccaaggccaagggctcgcggcggcggctcccgccgagccctccggcgatcccgttcctgggccacctccacctcgtcaaggccccgttccacggggcgctggcccgcctcgcggcgcgccacggcccggtgttctccatgcgcctggggacccggcgcgccgtggtcgtgtcgtcgccggactgcgccagggagtgcttcacggagcacgacgtgaacttcgcgaaccggccgctgttcccgtcgatgcggctggcgtccttcgacggcgccatgctctccgtgtccagctacggcccgtactggcgcaacctgcgccgcgtcgccgccgtgcagctcctctccgcgcatcgcgtcgggtgcatggcccccgccatcgaagcgcaagtgcgcgccatggtgcggaggatggaccgcgccgccgcggccggcggcggctgcgtcgcgcgcgtccagctcaagcggcggctgttcgagctctccctcagcgtgctcatggagaacatcgcgcacaccaagaacgtccgcgccgaagccgacgccgactcggacatgtcgaccgaagcccacgagttcaagcagatcgtcgacgagctcgtgccgtacatcggcacggccaaacgctgggactacctgncggtgctgcgctgggtcaacntgttcgcgtggagaaaaagatcctcgacgcgtggga

SEQ ID NO: 91772 - protein, 261 aa, Zea mays
  misc_feature: Ceres CLONE 1580267
  misc_feature: SWISSPROT Homolog: EC 1.14.13.89 Isoflavone 2'-hydroxylase
  misc_feature (243)..(243): Xaa is any aa, unknown, or other
  misc_feature (250)..(250): Xaa is any aa, unknown, or other
MDKAYIAALSAAALFLLHYLLGRRAGGEGKAKAKGSRRRLPPSPPAIPFLGHLHLVKAPFHGALARLAARHGPVFSMRLGTRRAVVVSSPDCARECFTEHDVNFANRPLFPSMRLASFDGAMLSVSSYGPYWRNLRRVAAVQLLSAHRVGCMAPAIEAQVRAMVRRMDRAAAAGGGCVARVQLKRRLFELSLSVLMENIAHTKNVRAEADADSDMSTEAHEFKQIVDELVPYIGTAKRWDYLXVLRWVNXFAWRKRSSTRG

SEQ ID NO: 91773 - DNA, 851 bp, Zea mays
  misc_feature: Ceres CLONE 1580270
  misc_feature: Encodes the peptide sequence at SEQ ID NO. 91774
ggagctccccgcggtggcggccgctctagaactagtggatcccccgggctgcaggaattcgtctcacccctagaaaaactcccctgccacttcccaaatccgcccgccattcatgcactcttctgtgcactgtcagcgccaccattagctcgcagctcaagctcgccactaccattttcgtcggttcttgaggaaatcgatcgaaccgttggagtgccaccactggcagaggctgttgcattcttgagttgagcaggaagaggagaggaagcaatggctctgtcgacgttctctgtcccaagggggttcctcggcgtgccggctcaggactcccatttcgcttcggcggtcgagctccatgttcacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcattcctctgggacgtccggcaccagtcgtacccgcacaagatccttgacggggcgggcccgacaagatgcccaacgatgcgggagaccaaacggccttggcggggcttcaccaagcggcgcccaaaagcgaagttacgacagctttcggaacggggccacaggttccaccaccatt

SEQ ID NO: 91774 - protein, 149 aa, Zea mays
  misc_feature: Ceres CLONE 1580270
  misc_feature: SWISSPROT Homolog: EC 2.2.1.7 1-deoxy-D-xylulose-5-phosphate synthase
MALSTFSVPRGFLGVPAQDSHFASAVELHVHKLLQARPINLKPRRRPACVSASLSSEREAEYYSQRPPTPLLDTINYPVHMKNLSVKELRQLADELRSDVIFHVSKTGGHLGSSLGVVELTVALHYVFNAPQDRIPLGRPAPVVPAQDP

SEQ ID NO: 91775 - DNA, 979 bp, Zea mays
  misc_feature: Ceres CLONE 1580273
  misc_feature: Encodes the peptide sequence at SEQ ID NO. 91776
  misc_feature (744)..(744): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (866)..(866): n is a, c, t, g, unknown, or other
acccgcggtggcggccgctctagaactagtggatcccccgggctgcaggaattcgtctcacccctagaaaaaattcgagtgaaagcggcccccaatttctactgtaagcagcaatggcgctctcctgttgcttgctcgccggcgcccgggggggagcctccccttccttctcatcctccgctgccatccgccggcgggaccaccgtctgctgaccttgtccgtggttccgctttcgctctctcagcgatgtcgccacggcctccgcgtgtgctgcgcctcctccacctcttcctcatctccgccgccggcaactcccgaggagcccgacgactacgagttattggacacagctgggaattgtgaccctctatgctcggctgatgaagttagctcacaatactttgaagctaactacaaaccaaaaaatgaccttctaaaagctttaactatcattggcacagccttgactggtgcagccgcaataaatcattcctgggttgctgctaatcaggacattgcaatggtgttggtttttgctattggctatgcaggtatcgtttttgaggaatcactagcatttaacaaaagtggagttgcgttattgatggctgtctgcctatgggttatcagaggcattggggctccctcgactgatgtagctgttcaagagttgagccagtcaacttctgaagttagtgaaattgtgtttttcttgcttggtgcaatgactattgtggaaattngtgatgcacatcaaggttttaagctgggtgactgatatatatctactcgaaaccaaaactcnnntctgtgggtgattgggtatgtaaactttctcctgagtcgatcctcgacacctgacttncactattgtgatggtatccctgctcgaaactagtactccatccgaatatagaaagtgctgttgttgtaatacaacgaatgctggcgtgcatggtaaaccattgtgatgtgaat

SEQ ID NO: 91776 - protein, 221 aa, Zea mays
  misc_feature: Ceres CLONE 1580273
  misc_feature (211)..(211): Xaa is any aa, unknown, or other
MALSCCLLAGARGGASPSFSSSAAIRRRDHRLLTLSVVPLSLSQRCRHGLRVCCASSTSSSSPPPATPEEPDDYELLDTAGNCDPLCSADEVSSQYFEANYKPKNDLLKALTIIGTALTGAAAINHSWVAANQDIAMVLVFAIGYAGIVFEESLAFNKSGVALLMAVCLWVIRGIGAPSTDVAVQELSQSTSEVSEIVFFLLGAMTIVEIXDAHQGFKLGD

SEQ ID NO: 91777 - DNA, 1073 bp, Zea mays
  misc_feature: Ceres CLONE 1580274
  misc_feature: Encodes the peptide sequence at SEQ ID NO. 91778
tttatgagtttgtttgtataagtttatggaggtatagtatttttaataatatagaaaaaatctccacttttttttttaaaactgtagctccccgcggtggcggccgctctagaactagtggatcccccgggctgcaggaattcgtctcacccctagaaaaacattcgcatctctgcttctttctgcttgggtgccctctgccctgaccacagggcccaaccatatcttcttcctcacacagagacactgagcgagcgagcttgagatcgatctcaggaggcggccggcggcggcagcagcagcagagcttgttggcgccgccatggcgataggtggcttcgtggaagcccctgccggcgccgactacggtggccgcgtgacgtccttcgtggtgctctcctgcatcgtagccggtagcggcggcatcctcttcggctacgacctcagcatctcaagtggggttacctccatggagtcgttccttagaaagttcttccccgacgtgttcccccagaatgaaaggagacaaggacctgaagcaactactgcccgctttcaaacacgaagctttctcaccggtctttcaccttccttcccttctaacattgaccggagcctccgtcggccaacggcttctttcggcccttcccttccggttcaacccagggaaaaggtttccgggaccggccacgacaaccccttcccaattacactttaatcccggagaagagaggccaaacccggttcctttttccataccaatttcggagactttccccggttcccttctcagatgcggaggagggcaaaaccaccatttacacaaaccatttatattccattgggcctcccctcaaccccccacaaacaagggaaaataaccttccctcttgtaggaaagaaaagggcccctcccctgtaattttcatcctatagccccaaggtcccaattaccccgcctgtaaacacctctcatttttaaacgaaaagaaaagagggggcccccccctcccgacacatgttatccgctagaggcagccccaatgaaaaacaaaagcagggtttatcctaag

SEQ ID NO: 91778 - protein, 131 aa, Zea mays
  misc_feature: Ceres CLONE 1580274
MAIGGFVEAPAGADYGGRVTSFVVLSCIVAGSGGILFGYDLSISSGVTSMESFLRKFFPDVFPQNERRQGPEATTARFQTRSFLTGLSPSFPSNIDRSLRRPTASFGPSLPVQPREKVSGTGHDNPFPITL

SEQ ID NO: 91779 - DNA, 1110 bp, Zea mays
  misc_feature: Ceres CLONE 1580275
  misc_feature: Encodes the peptide sequence at SEQ ID NO. 91780
  misc_feature (16)..(16): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (71)..(71): n is a, c, t, g, unknown, or other
  misc_feature (75)..(75): n is a, c, t, g, unknown, or other
  misc_feature (1110)..(1110): n is a, c, t, g, unknown, or other
gggggaaaaggactantccttaccgtgtcccccctcacccccacacgggtggttaataatntnnncctctntttncacaaactggagctccccgcggtggcggccgctctagaatagtggatcccccgggctgcaggaattcgtctcacccctagaaaaatccaatccaatccaaaccgtcccttgtccctctcttcctcgaaacgcagctatggggactcggccgcggggggtcgtcctcgcgccatgggcggtggtgctggtgctggtgctcgcgcttcgtctggcaggcgcgtcgcatgtgatccaccgcagcctggaggccgaggcggcgccgtcggtcccggcctccattgtcagccccctgctcaggacggggtaccatttccagccgccaatgaactggatcaacgaccctaacgctccgctgtactacaaaggatggtatcacctgttctaccagtacaaccccaagggcgcggtatggggcaacatcgtgtgggcgcactcggtgtcgcgcgacctggatcaactggggtggcgctgggaggccgcccatcttaccccagccatcccgtcccgacaaggtacgggctgcctgggtcggggcttcaggccgaccaatccctggaagggacgggcaacggccgggcgaattcctgattacacgggggggaaacgaacccgggcccgggaaacattcaaacctaacccaagggtggtcaagggtggcccttgggccgccctccccccccaaagggaacagtccgtttcccgaaacaccccggcatgggcttccccgtcagaagatggggagaaaaaaaatccctctgtaagtggaaagtaacccaacccccccggggtggggccaaaacaacccgcggcttggctccggggcggggcatattaataaggcgaaaccccccaaaattttccgctccaaacccctgaaacaaaacggggcgttgtgccggcacacaccccgggagggtccggggggccaacttggctggggaaagctctgggtgggagcatacacagtgcacctggcccccccccccgtgaaaattgccccatggggtgttaccccgagaccccgggaattctctn

SEQ ID NO: 91780 - protein, 211 aa, Zea mays
  misc_feature: Ceres CLONE 1580275
  misc_feature (58)..(209): Pfam Name: Glyco_hydro_32N Pfam Description: Glycosyl hydrolases family 32 N terminal
  misc_feature: SWISSPROT Homolog: EC 3.2.1.26 Beta-fructofuranosidase
MGTRPRGVVLAPWAVVLVLVLALRLAGASHVIHRSLEAEAAPSVPASIVSPLLRTGYHFQPPMNWINDPNAPLYYKGWYHLFYQYNPKGAVWGNIVWAHSVSRDLDQLGWRWEAAHLTPAIPSRQGTGCLGRGFRPTNPWKGRATAGRIPDYTGGKRTRARETFKPNPRVVKGGPWAALPPQREQSVSRNTPAWASPSEDGEKKNPSVSGK

SEQ ID NO: 91781 - DNA, 1333 bp, Zea mays
  misc_feature: Ceres CLONE 1580278
  misc_feature: Encodes the peptide sequence at SEQ ID NO. 91782
  misc_feature (55)..(55): n is a, c, t, g, unknown, or other
  misc_feature (917)..(917): n is a, c, t, g, unknown, or other
  misc_feature (1181)..(1181): n is a, c, t, g, unknown, or other
tcttaatatttttagataaatcaacctccctttctccctagtcatatcttttttntgttctcttcaaaactggagctccccgcggtggcggccgctctagaactagtggatcccccgggctgctaggaattcgtctcacccctagaaaaagtcactccccaagcgtcacaccgaatcaccacagtcgagctcgagcaggaacaagccgtgagcgcctgcccccggtgctcaatatctattccacacctcatggcgccggcgctgagcatgaccctggggccgtcgtcggtggccgcgctgcgcccgagcccgtcgtgccggggtctgttacgggccgcgctcgcgccgcagggcaggggcgcctccgcgaggtgcgcggtaggggtgagatgggaggcagccaggcggaggatgatggccagggtgaggtgcgaagccgccgtccccgaaaagcctgccggtcaccaagatacggccggctataaaccaagtaccaagtctaaggttcccgcctgatggatttaactgtacccggtttatcaccccccttgtaaagactctctaccgcaaccttttttgcaaaccccagaggatgcctttcgtttagcctgaatatcccccttctgtaaaggagacctatttgggtcttggccgaagttcgaggcccaattttgaaaaattagggttttaaccccccctctctatttgggcggggggaaaaaaccatctttgaccagaactatcggcgcgcgtgggtaattcggacctcaagaatgtgctgaccctcccaattttacgcctttgtctgaatatctcttgacaccaattattgagctgacctctcccaaccaaagcgctctgtttgagaggcagccccctcctctgctagagagcctaaaacccaactctggatgcgnttgggtgtgtcgaatgtaatctacgagactatcatcttctgcgagcacactactatcgcgcatatttattgtgcgagggcatctctagtctcgcgccagtcattcctatgatttgaccaaactaagtgcgcttacaggttgcgtacctctctcgtaaattctgcagcagtatcaggattaatatataatcatcgattctgagtgtctgggagaaaactaacgtgggactgtgcgttttgcatcaatactatcttgtttttattngaatggatgaagaaacacacggtgtatacaatgatgtgtgatatccgcgtctctttcacactatccgctttttatccccatctcgtattgaaaccccacaactattcataatatattccgcccacccactctcactaatagatacagcacgc

SEQ ID NO: 91782 - protein, 88 aa, Zea mays
  misc_feature: Ceres CLONE 1580278
MAPALSMTLGPSSVAALRPSPSCRGLLRAALAPQGRGASARCAVGVRWEAARRRMMARVRCEAAVPEKPAGHQDTAGYKPSTKSKVPA

SEQ ID NO: 91783 - DNA, 952 bp, Zea mays
  misc_feature: Ceres CLONE 1580279
  misc_feature: Encodes the peptide sequence at SEQ ID NO. 91784
  misc_feature (952)..(952): n is a, c, t, g, unknown, or other
ctccccgcggtggcggccgctctagaactagtggatcccccgggctgcaggaattcgtctcacccctagaaaaatcaagctctcctcccctcttcctaccattagcagtagctacagccagaacaccagcagacagcagcatcagcagggaggaacacgatgagcggcgccggtccggatctgcagctgccaccggggttccggttccacccgacggacgaggagctggtgatgcactacctctgccgccgctgcgccggcctgcccatcgccgtccccatcatcgccgagatcgacctctacaagttcgacccatggcagctcccaaggatggcgctgtacggcgagaaggagtggtacttcttctccccgcgggaccgcaagtacccgaacggggccaggcccaaccgcgccgccggggctgggtactggaaagcccccgggcgctgacaagccccgtgggcacgcccaagaccgctggcccatcaaaaaagggggttcgtctttctaacgccgggcaagggccccccaaagggccgattatgacccaacctgggaatcattgcaaggaagttacagtccttttcccaaacagtcaaaccggattcaggtggcgccaaaaaaaaaaaaaaagcccctctaagggggaaagaaaacaaaggggtttcccggcccgccctttcccggtcccctcccccttttgggcgctcgttgcccccggtcccaaaattctaaacccataaaagggactttggggcggattatagaggggtcaccctttcaagataaggaaaacgcggcggtgattagagcgaggcgggcccatggggattttggggggcccccccgaaaatttattttctacaaagaggaccactgccataggtagacgtatggggggagtctttacaacgtggacccgatagaatttttgaaaccccttttttatatn

SEQ ID NO: 91784 - protein, 96 aa, Zea mays
  misc_feature: Ceres CLONE 1580279
  misc_feature (10)..(97): Pfam Name: NAM Pfam Description: No apical meristem (NAM) protein
MSGAGPDLQLPPGFRFHPTDEELVMHYLCRRCAGLPIAVPIIAEIDLYKFDPWQLPRMALYGEKEWYFFSPRDRKYPNGARPNRAAGAGYWKAPGR

SEQ ID NO: 91785 - DNA, 1215 bp, Zea mays
  misc_feature: Ceres CLONE 1580281
  misc_feature: Encodes the peptide sequence at SEQ ID NO. 91786
  misc_feature (63)..(63): n is a, c, t, g, unknown, or other
  misc_feature (73)..(73): n is a, c, t, g, unknown, or other
gggggggcgtgttccttttcgggcggtgcttttttacattctgatgatatgtgagaatttttnggtgggggtnttaaagctggagctcaccgcggtggcggccgctctagaactagtggatcccccgggctgcttgaattcgtctcacccctagaaaaagttcttctctctccttcttcctcggtcctctcctctccgcatttcgggcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcacctgcttcgtgctctccgccgcgggactcgccggcatctgcggcgcggcaacgatgggcgagggcctccgcctgtcctcgcgctaaccgagcgtctgggccgaacctcgcgtttcaactcccccccgggtggtcgccaccggccggcggggttcctgggttcccgcgttttggcaacccttccgccggcgttcggccggaagcggggattctttctgggccccctggatttaaacccccttctttcggggctttcgaaccacccaatattttggtccgggccggaggctttttcccaaatagtgggatggatttccgtggggggggggccctttcggaggcgttccaattcccgattttatgtgggtaaaaaataccccctcccccgcgggggaggtgtgacccccaccccccgccggacgcccaatgggtgggtaggtcgcgccacccccgtggggctcttccctcaaaataaaaaacacataagcgcttgtccggcactctttagggtagctgtgttttcgactgagagagccccgaagtggcccttcaaataagcgctcccccgggtacaaaaataaacccccatcttgtgtgggagcttgaatataaggcttacaaatagggtctctacattccttttcccacataagtgtcgcgtggcgcaagaataacaaactgggggtccgcccggtatgaatgaataaaacccccctttgcccttggaggggcaacacttcccggacggagaaaattctcctccatctacagagggggcaacatctctggaaagttggggagcagagggaagagaggaccccaacgagatttcctgtggtggagacaaatacccccgg

SEQ ID NO: 91786 - protein, 64 aa, Zea mays
  misc_feature: Ceres CLONE 1580281
MVMEGRTGSLYGRLNKSSTRGFLAYTAAGAACAAVLTCFVLSAAGLAGICGAATMGEGLRLSSR

SEQ ID NO: 91787 - DNA, 799 bp, Zea mays
  misc_feature: Ceres CLONE 1580286
  misc_feature: Translation starting site: 162
  misc_feature: SWISSPROT Homolog: EC 3.5.1.14 Aminoacylase
ctccccgcggtggcggccgctctagaactagtggatcccccgggctgcaggaattcgtctcacccctagaaaaatttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgatgcgcggggccggcgaggtagggcgcctcgaccgcgaacgcgagcgggaggcaccagcaccggcgccagcgctacggcgtgggggcgccgtggagggaggagatccggaggcgtagcggggcggcccgagctggcggcgtggctgcgctcggtgcggcgccggatccacgagcgccccgagctggcgtacgaggaggtggagaccagccgcctggtccgcgactagctgggcgcgctggggcgtcgggttccgccaccccgtcgcgcgcaccggcgtcgtcgccacgctcggcaccggccgcccgcccgtcgtcgcgctccgggccgacatggacgcgctgcccatccaggaagccgtggagtgggagcacaagagccgggtccccgggaagtgcacgcctgcggccaccacgcgcatgtggccatgctgctcggcgcgccagcatcctcaagctcgcgagcacaactcaaggcacggtgaagctctgttcagccggcggaggatcgg

SEQ ID NO: 91788 - DNA, 924 bp, Zea mays
  misc_feature: Ceres CLONE 1580295
agctaaccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgtgcttgcacgtcgaagagctactttgtgagggacttggcaggaaagcacgccatactcttcattctctgccacctcttgatgacttcgaagctcaagagtacacgtatctccacctcgtgctttcgcacaatggggttcgacgtggcggctcaaccgtcttcttagatcaccatctcggtggagacggttgaagtcttcacaccctctcgacctctttgctgtctcattttttttaactgtcaaggataagcaagtgacctctgtgtgcataccaccaccaccatacgtagcatacacaggcacagatggcagagcataaagggaacgttctcttgcacaagtatgagatggggaaaaatgctggccaggcaccttttgcaagggttacatgctcgtaacaggcgaactcggaatgtcgcgatcaaagtgattgataagagaaagttatgaaggtgggtctcatgatcaaatcagcgagaaattctgtgatgaagctgtttagcatccaacatcgtacagtctatgagtcatggcaaccaaaacaaaatatacttg

SEQ ID NO: 91789 - DNA, 885 bp, Zea mays
  misc_feature: Ceres CLONE 1580302
  misc_feature: Encodes the peptide sequence at SEQ ID NO. 91790
tggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcaccgtgctggtgtgcggcgccgagctgggcagcctcagccgcgacgagctgtggcgcaaggtgtggggggagggccaccttacgacctcgccaccgagctcggccttcctcgccgttcctcccccttcaccattttccgtctaacatcatgttccaggcccaaggcccgtggtaccccatccaacttcccattggttcaaagccgggccgaacaaacctcaagggggtccaaaggggggaagttcaatcaaacctgggcggcgcaaatttccggcaaagttttaagcaaagaaaaagcctggggggtttcccaatttccgaatttgcctgggccaaaaacctgggaatcgggggcaaaaagaaccaaaaatgttcccccccttcccttgttttaaagccccaaaaggcgcccgtttgtgcccaccattttaaagaaggggggccctccccccaagaggggtctctccaccggcaccatttttatacgcgtggcc

SEQ ID NO: 91790 - protein, 116 aa, Zea mays
  misc_feature: Ceres CLONE 1580302
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVTVLVCGAELGSLSRDELWRKVWGEGHLTTSPPSSAFLAVPPPSPFSV

SEQ ID NO: 91791 - DNA, 798 bp, Zea mays
  misc_feature: Ceres CLONE 1580303
  misc_feature: SWISSPROT Homolog: EC 2.1.1.43 Histone-lysine N-methyltransferase
ctcaccgcggtggcggccgctctagaactagtggatcccccgggctgcaggaattcgtctcacccctagaaaaataaattataaaggatgggatggttacctgggaaggtattgtttgcaattgctgcaaaaaaaacttatccgtatctgatttcatggctcatgctggtcgtagtcacccacagtcctcattgggcctctttctagagtctggcaagtcatacactttgtgcctggttgaggcttggtctgctgaatctatgagcaggagaagcaatgcatggggtagaaaagttgaggcaatagatgaaagtgatgacacctgtggtttctgtggagatggtggtgaattactttgctgtgacaattgcccatcgacatatcatcaagcttgcttgtctgctaaggagcttccagaaggtagttggtactgccataattgcacttgtcaggtttgtggggggccatttagtgaaaaggaggtttcaacattctcggcgattttcaaatgtttccaatgcggagatgcataccatgacacttgcattgaacaagagaagctacctcttgaggatcaaatatctcagacatggttttgtgggaaatactgtaaagagatattcatagggctgcgtagtcatgtcgggacagataatattcttgacagtgacctttcatggtccatactgagatgcaacaatgacgggcagaagctacattctgttcagaagatgcctgtttggcagaatgtaatatgaaattagcagtggctcttactctattggaggaaatgttcat

SEQ ID NO: 91792 - DNA, 858 bp, Zea mays
  misc_feature: Ceres CLONE 1580305
  misc_feature: Encodes the peptide sequence at SEQ ID NO. 91793
  misc_feature (486)..(486): n is a, c, t, g, unknown, or other
  misc_feature (577)..(577): n is a, c, t, g, unknown, or other
  misc_feature (693)..(693): n is a, c, t, g, unknown, or other
  misc_feature (735)..(735): n is a, c, t, g, unknown, or other
  misc_feature (758)..(758): n is a, c, t, g, unknown, or other
  misc_feature (801)..(801): n is a, c, t, g, unknown, or other
tggagctccccgcggtggcggccgctctagaactagtggatcccccgggctgcaggaattcgtctcacccctagaaaaaagccctcacacaagagacgcagctgcgagtccgccagccttatcctcctccccgtctccggctccaacccgcaagcgcggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcangcaagcagcagctaagaccaatgatctagctggagatgggacaaccacctctgtggtccttgctcaggggctgatcgctgaagggtgtaanggttgtgcagctggtgctaatccctgtcagaatactcgtggtatcgagaaaacagcgaaacactagttgaagacctacggaaagtgtcctaaggagtcgaagaatatgagcttgcnaatgttcctgcctgtagtgcgggcaacaactacgaaaattgntaatttgatagccaaggcatgancaaagtcgtcctgaaaggtttggtttaccttcaaaaaggggangagttttaaaacttttctctaagttttggaaggggaaggcaatttaaattctggttt

SEQ ID NO: 91793 - protein, 160 aa, Zea mays
  misc_feature: Ceres CLONE 1580305
  misc_feature (109)..(109): Xaa is any aa, unknown, or other
  misc_feature (139)..(139): Xaa is any aa, unknown, or other
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVXQAAAKTNDLAGDGTTTSVVLAQGLIAEGCXGCAAGANPCQNTRGIEKTAKH

SEQ ID NO: 91794 - DNA, 1181 bp, Zea mays
  misc_feature: Ceres CLONE 1580306
  misc_feature: Encodes the peptide sequence at SEQ ID NO. 91795
  misc_feature (733)..(733): n is a, c, t, g, unknown, or other
  misc_feature (808)..(808): n is a, c, t, g, unknown, or other
  misc_feature (899)..(899): n is a, c, t, g, unknown, or other
acccgcggtggcggccgctctagaactagtggatcccccgggctgcaggaattcgtctcacccctagaaaaaggccgccgccagacctccatcttcgtgaccttcgtaggcggcgagcacccaccaggagaaggcatggcttcacgcatgacaccttccaagaggccttttcagagaagatcttcagactacgatggccggggcaagtggcagaagacgaagcacccttctccacataaatctcagttcaaaatcgagcctggtgttcccatttttccgtattctctgcccggcttcaaaatctggtaatgtgattggcaaaggaggtgccattattgcaaagatacgtcaagaaaccaggatgagaatcagggttgataggggcagccccccgctgggacgagagagtcatctttcataaccgctggccaccaagggataaataagcctggcctcgtacaaaggccggaaaaaaatgccggaaggtgccgcctgcttccttccgggggggggacccattgaaaaagggttaaaggataaccacccgcgcgtgggggccaaaacgttttgttctcaaaaggaaaaaaccaattgcgcccctgagccgaaaatgtgtttatttccaaaaaaaagggaaaagggggaaaaggaacaaaaaataataagggggtttccccaagataaaaacaccccgggggttcttcggaaaacaaaaaaaaaatattgttttccnaaaaaaaaaagacaacacccctctttggggtggggaaacaaaagaggggtgtctccccctctcggtgtgtcgcgncaaatattctctcacacttttgtccgaacccccgagagagggggtggatatcacccccgtgtggcgctcacaagaggcgcccctcttcttnctccttttatttctctataagagagttttttttttcccccccgccggtgttctaataattgtgaagccggggaaagatcctactcttgtgtgaatgagcgctcctccgcttttttatgctaataatatatggcgcggtccataccccaccacaagattggtgttccccccttgggaagagcggcgggttgtgtgtgttttcacactattgggcacctaccaaccgtggggttaattcgcctgtttattataaaaacacctcccctctgcgcgttcttgttat

SEQ ID NO: 91795 - protein, 102 aa, Zea mays
  misc_feature: Ceres CLONE 1580306
TRGGGRSRTSGSPGLQEFVSPLEKGRRQTSIFVTFVGGEHPPGEGMASRMTPSKRPFQRRSSDYDGRGKWQKTKHPSPHKSQFKIEPGVPIFPYSLPGFKIW

SEQ ID NO: 91796 - DNA, 865 bp, Zea mays
  misc_feature: Ceres CLONE 1580310
  misc_feature: Encodes the peptide sequence at SEQ ID NO. 91797
aagctggagctccccgcggtggcggccgctctagaactagtggatcccccgggctgcaggaattcgtctcacccctagaaaaaactcgcagtcgcactagtgctaggcgcatccggcatccccatcccttgcctccgaatcggatcgccgccgccgctgccgctaccgccgagcggaagcagccatcaccccaaaccctagccagccatccaactatggagccgcccgccgccgactcctcgcccgatccgacgccgcaggaccagtttcctgccccgtccccttctccctccgcctccccggtcaagcgctccgcctggaagcacccctcccccaacggccccgccgtcatggatgccaaccactggcccgcgctctccgacgccgccaagggcatcaagctcccagactcctcgtcttcctcgcctgcgcccgtcgccgccccatcggccgttgccaattcctccagttcgcaaaagcacggcgcccatcacgtccgccacaagtccgccaggcgtggcggcggcggggagcactctccacgagaccatcctgaccggaccacagccacgggttgggaccacgccggcggcggtggggcgtaggggtgcccagagggaccataataacggaggcggcaggaggggcaacgccgccgctgcctctgccgccggaacttctcacaatggtgcccgtagcatccgcggaagtgggaggctttggctgccaggcgaaagggggcttccagccgccccgtctatcgtggaccctccacaaccagtggggaaggggccactaacatgtgaaagtggccgcaacaactatcttcctccaactgtcggcccaagagacgatcgcttccaac

SEQ ID NO: 91797 - protein, 129 aa, Zea mays
  misc_feature: Ceres CLONE 1580310
MEPPAADSSPDPTPQDQFPAPSPSPSASPVKRSAWKHPSPNGPAVMDANHWPALSDAAKGIKLPDSSSSSPAPVAAPSAVANSSSSQKHGAHHVRHKSARRGGGGEHSPRDHPDRTTATGWDHAGGGGA

SEQ ID NO: 91798 - DNA, 769 bp, Zea mays
  misc_feature: Ceres CLONE 1580311
  misc_feature: Encodes the peptide sequence at SEQ ID NO. 91799
tccccgcggtggcggccgctctagaactagtggatcccccgggctgcaggaattcgtctcacccctagaaaaaaagtcccacacagacacagcctcccaccacaaaccctcctccagtgctcttttcttctagccgccgccgcaaccgcttgctagcgctctgcgctctcatcctcgcgtccgtggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggctgctggtgccgacgtgtccatgattggtcagtttggtgtcggtttctactcggcataccttgttgctgagaggggtgtcgtgaccacaagcacaacgatgatgagcagtatgtatgggagtctcaggccggtggctccctcactgtcacacctgataactctggggagcaccttggcaggggtacaaagaatgaccctttacctcaaggatgatccagtagaggatcctgaggagct

SEQ ID NO: 91799 - protein, 189 aa, Zea mays
  misc_feature: Ceres CLONE 1580311
  misc_feature (28)..(182): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHIVPDKANNTLTIIDSGIGMTKSDLVNNLGTIARSGTKEFMEALAAGADVSMIGQFGVGFYSAYLVAERGVVTTSTTMMSSMYGSLRPVAPSLSHLITLGSTLAGVQRMTLYLKDDPVEDPEE

SEQ ID NO: 91800 - DNA, 805 bp, Zea mays
  misc_feature: Ceres CLONE 1580312
  misc_feature: Encodes the peptide sequence at SEQ ID NO. 91801
  misc_feature (805)..(805): n is a, c, t, g, unknown, or other
ctggagctccccgcggtggcggccgctctagaactagtggatcccccgggctgcaggaattcgtctcacccctagaaaaaaccgcctgctcgcctcgcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaggccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaaggggcgcatcctttgcataaggtggtn

SEQ ID NO: 91801 - protein, 142 aa, Zea mays
  misc_feature: Ceres CLONE 1580312
  misc_feature (28)..(142): Pfam Name: SBP56 Pfam Description: 56kDa selenium binding protein (SBP56)
MAGAAAVETAAAAAAAAAAANGKACCHAAKGPGYATPLEAMEKGPREKLVYVTCVYNGTGINRPDYLATVDLDPSSPTYSQVIHRLPVTHIGDELHHSGWNSCSSCHGDPSAKRRFLILPSLLSGRVYVVDTATDPRGASFA

SEQ ID NO: 91802 - DNA, 970 bp, Zea mays
  misc_feature: Ceres CLONE 1580314
  misc_feature: Encodes the peptide sequence at SEQ ID NO. 91803
  misc_feature (728)..(728): n is a, c, t, g, unknown, or other
  misc_feature (751)..(751): n is a, c, t, g, unknown, or other
  misc_feature (810)..(810): n is a, c, t, g, unknown, or other
  misc_feature (844)..(844): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
agctccccgcggtggcggccgctctagaactagtggatcccccgggctgcaggaattcgtctcacccctagaaaaaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtggtattgagaaacagctaaagcactagttgaagaactacggaaagtgtctaaggaggntgaagatagtgagcttgcagatngtgctgcagttagtgctgggcacaactatgaaatgggtacatgatagcagaggcatgancaaggtcggtcggaaagggcgtgtcaccctgaangaggggagagtctgagactttctctatggtgtggagggaatgctaagnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 91803 - protein, 160 aa, Zea mays; identical to SEQ ID NO: 85623
  misc_feature: Ceres CLONE 1580314

SEQ ID NO: 91804 - DNA, 819 bp, Zea mays
  misc_feature: Ceres CLONE 1580316
  misc_feature: Translation starting site: 177
  misc_feature: SWISSPROT Homolog: EC 1.6.2.4 NADPH--hemoprotein reductase
  misc_feature (732)..(732): n is a, c, t, g, unknown, or other
ctccccgcggtggcggccgctctagaactagtggatcccccgggctgcaggaattcgtctcacccctagaaaaaagtagcagcagcaacgaaccaacgaagcactggttggtaggtgcacgcaccccatccccccacccaatccctcgcggcgggcgggcgagagagcgagcggcgatggcggcactggaggcggtgaggtcgtgggcggtgtccgtcatcccgccggagctcgccgccgccgcggggggagacccgctcgccgcgctggcagccaccgccgcggcccttgtcgcggggctgcttatcctcgccgtctggttccgatccggaggcggggcgccgtccaagccggtcgccacgccattacggccgccgccggtgaaggtggacgccgacgccgacgtggacgacgggcggaagcgcgtcaccatcttcttcggcacgcagaccggcaccgccgagggattcgccaagtcgatggcggacgatgcgagggtgcggtacgagaaggccgtgtttaaagtggtggatctggatgactatgctcaggaggaccaggtatacgaggagaagctgaagaaggaaactgtggcgctgttcttcttagcaacatatgggggatggagagccaactgataacgcagcaagattctacaaatggtttactgagggaaaagagaaaggagtttgggctgaaagatcttaaataatggtattttttggccttggnaaacacggtagtatgtaccattttaataagggttgcaaaggtgggtagatgtagcctactagaaggagccagggtggggaaaacttc

SEQ ID NO: 91805 - DNA, 923 bp, Zea mays
  misc_feature: Ceres CLONE 1580317
  misc_feature: Encodes the peptide sequence at SEQ ID NO. 91806
ctccccgcggtggcggccgctctagaactagtggatcccccgggctgcaggaattcgtctcacccctagaaaaagtgccagcttgagcattccactttgctagccagcatatacttacacgtagctagcttaataatcagcagctggtgcagtaagagtaacagctagcgacgacgaccatatggcggcgaagcagccagtcgtcgctgctgctgcctccggccaccccaagatgggggaggagaagctgatcatccggccggagaaggtgcggttcatagacgtgctgtcgatgctgctcctgaggcgccccatcaccagctacgcattcgtggaggccggcgaccggaccgccgccgacctgggcagcacgcccggcgactggctcgtccccctcacgcaggtcatccagaaggcgctcgccggcgcctactacccggctctcgtggtcggcgccgtcgtcgagttcctcctcaacttcgtcgcgctcaacaatggcatactcggcatctttctcaacctcttcagatgtaagctggtgatcccactgaaccgggaggcgcccaaccttccggtcatgatcgggatgatcaacggggagaacgagctgaagccgcttccaaccaagcgcgggccaaaaggaacggccgcctggcagtgggggggcgtcctccccggcccccggaaccgggcgggaaataatactaatttgaactttaaaaacggcaagccccggcgggtccccctggtgcaaccaacattaactttaaaggggggggtttttccccccctcccaaccttttcccgcgtttcaggggggaacaataatggccccccaaaaaccccctcacaaaaacacccccccctaatataggaaaaaacttcttcaaaaaacgtggggagagaagcccccctctcttggg

SEQ ID NO: 91806 - protein, 230 aa, Zea mays
  misc_feature: Ceres CLONE 1580317
MAAKQPVVAAAASGHPKMGEEKLIIRPEKVRFIDVLSMLLLRRPITSYAFVEAGDRTAADLGSTPGDWLVPLTQVIQKALAGAYYPALVVGAVVEFLLNFVALNNGILGIFLNLFRCKLVIPLNREAPNLPVMIGMINGENELKPLPTKRGPKGTAAWQWGGVLPGPRNRAGNNTNLNFKNGKPRRVPLVQPTLTLKGGVFPPLPTFSRVSGGNNNGPPKTPSQKHPPLI

SEQ ID NO: 91807 - DNA, 803 bp, Zea mays
  misc_feature: Ceres CLONE 1580318
  misc_feature: Encodes the peptide sequence at SEQ ID NO. 91808
  misc_feature (799)..(799): n is a, c, t, g, unknown, or other
ctccccgcggtggcggccgctctagaactagtggatcccccgggctgcaggaattcgtctcacccctagaaaaaatcttcctcgcaacgccgacgctgcaacttccgctccctccccgactcgcgctcggcacgcaggcaggcgactgcggtggcgctcaggctcgggctctcagcaacggcggggttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatgggcattggcaagggtggggtattgccatggaagcttcttggtgatcttaaattcttcaaagaacttacactaactacaactgatcctgccaaaaagaatgcagttataatgggaaggaaaacatgggagagcattcctgttaagtcaaggccactgcctggtcgtttgaatgtcatacttactcgatctggtagttttgattttgcaacagtagagaatgttgttatatgtggaagtatgaaatctgccttagagctgctagcatcaactccatactgcttatcaattgagaaagtttttgtcataggaggtgggcaggtactgagagattatttgaatggacctgcatgtgaagctatccatctgactgatattcagtcaagcattgagtgtgatactttcatcccctcagntgac

SEQ ID NO: 91808 - protein, 169 aa, Zea mays
  misc_feature: Ceres CLONE 1580318
  misc_feature (19)..(169): Pfam Name: DHFR_1 Pfam Description: Dihydrofolate reductase
  misc_feature: SWISSPROT Homolog: EC 1.5.1.3 Dihydrofolate reductase
  misc_feature (168)..(168): Xaa is any aa, unknown, or other
MALTAAPASGDSQSGPQRNYQVVVAATCDMGIGKGGVLPWKLLGDLKFFKELTLTTTDPAKKNAVIMGRKTWESIPVKSRPLPGRLNVILTRSGSFDFATVENVVICGSMKSALELLASTPYCLSIEKVFVIGGGQVLRDYLNGPACEAIHLTDIQSSIECDTFIPSXD

SEQ ID NO: 91809 - DNA, 692 bp, Zea mays
  misc_feature: Ceres CLONE 1580323
  misc_feature: Encodes the peptide sequence at SEQ ID NO. 91810
  misc_feature (509)..(509): n is a, c, t, g, unknown, or other
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaacccgcacacgccctcgtacgtcgccttcaccgactccgagcgcctcatcggagatgcggcccagaacccaggtcgccttgaaccccattcaaccccgtcttttgatggcaaaccgttttatcgggcagggaggttccatggatccccccggcccaaagggaattccaagttgtgggccccttcaaggggcattttcctggggccctggggaaaaaaccccccacgggggtttgggggnggntgnnnnnnnnnnnnnnnnnncccccccnnanngggggggggggggggggaaaaaaaaaaaaaattttttctctccccaaaaaaaaaaaaaaacccccccccccccggggggggggggttttttnnnnaaataaaaaaaaccggcgggggagggagaaattttttttcggccggcgccccc

SEQ ID NO: 91810 - protein, 178 aa, Zea mays
  misc_feature: Ceres CLONE 1580323
  misc_feature (119)..(119): Xaa is any aa, unknown, or other
  misc_feature (120)..(120): Xaa is any aa, unknown, or other
  misc_feature (121)..(121): Xaa is any aa, unknown, or other
  misc_feature (122)..(122): Xaa is any aa, unknown, or other
  misc_feature (123)..(123): Xaa is any aa, unknown, or other
  misc_feature (124)..(124): Xaa is any aa, unknown, or other
  misc_feature (125)..(125): Xaa is any aa, unknown, or other
  misc_feature (128)..(128): Xaa is any aa, unknown, or other
  misc_feature (129)..(129): Xaa is any aa, unknown, or other
  misc_feature (160)..(160): Xaa is any aa, unknown, or other
  misc_feature (161)..(161): Xaa is any aa, unknown, or other
MAGKGDGPAIGIDLGTTYSCVGVWQHDRVEIIANDQGNPHTPSYVAFTDSERLIGDAAQNPGRLEPHSTPSFDGKPFYRAGRFHGSPRPKGNSKLWAPSRGIFLGPWGKNPPRGFGGGXXXXXXXPPXXGGGGGEKKKKFFLSPKKKKNPPPPGGGGFFXXIKKTGGGGRNFFSAGAP

SEQ ID NO: 91811 - DNA, 1192 bp, Zea mays
  misc_feature: Ceres CLONE 1580327
  misc_feature: Encodes the peptide sequence at SEQ ID NO. 91812
  misc_feature (1)..(1): n is a, c, t, g, unknown, or other
  misc_feature (71)..(71): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (91)..(91): n is a, c, t, g, unknown, or other
  misc_feature (979)..(979): n is a, c, t, g, unknown, or other
  misc_feature (1081)..(1081): n is a, c, t, g, unknown, or other
  misc_feature (1133)..(1133): n is a, c, t, g, unknown, or other
  misc_feature (1145)..(1145): n is a, c, t, g, unknown, or other
  misc_feature (1146)..(1146): n is a, c, t, g, unknown, or other
  misc_feature (1147)..(1147): n is a, c, t, g, unknown, or other
ntgggtgggtatctaccaaagaaaacacaagccctaatagccctcctcgcgggccttaaaaaggggttttnttgtnnnnaaaggggaaaanacaaactggagctccacgcggtggcggccgctcttcaactagtggatcccccgggctgcatgtattcgtctcacccctagaaaaacctcaccttctcattccttcaagcgtcagcagcaaaaccagagcttcccttcaacccagcaagaaaaccaagcgacctagttagcgcagcggcagttatttgtgcagaccccgatctgactgagagaggcaggcggcagctcgatcggcagtgaccgcgcgcgagccatgggactggcctggatggtggcggcggccgtcgcggccgtgctggcgtcgtgggcgttcaacgcgctggttcacctcgtgtggcgtccttacgccattatccggaggctccaccccccagggggggggcgggccagggctacacggtctttaaaccccccccccccggccaaaaaaaaagacgggttccgacggcccaaggggagaccagaccctcccccagtggggagggccaaaaagaaccaagggaaactttgacccccgccggtggggggggggccccaccccggggagggtgcgcgcccccaaatcgcgcattccagggaggtggtgtgtgaggcggggccccgccgaacgggtatgcccggtgggtggaacataggtgaaaaagcgcgggacgggccccaaacaaggctcagcaaagaggcgtgggtggggggtggacccagatctgaaccccaagaaaagaaggggctatatataacaacaaaatcagtccccccccccaggccaggagaggagggtaagctaatggttttaaaaaataaacaccaagaatccccccgcccgcgacagcctctaaaacaactcatgcggtaaaaatagacactctgccctatggaatacacacccgcnggggggtagatataaaaagtgacaagaagaacacacccaccaccaggcagagaaagagagggggagcgccccacctcaccccatagtgtggtgtgtgggtantgtgtggcccccccacacagcaggtgggtggccccatgtcccgagaggaccnaacagacccacnnnaaaaaaagaaaaaaaagaacttgaaagagtgagggtgtggggtgg

SEQ ID NO: 91812 - protein, 85 aa, Zea mays
  misc_feature: Ceres CLONE 1580327
MGLAWMVAAAVAAVLASWAFNALVHLVWRPYAIIRRLHPPGGGRARATRSLNPPPPAKKKDGFRRPKGRPDPPPVGRAKKNQGKL

SEQ ID NO: 91813 - DNA, 843 bp, Zea mays
  misc_feature: Ceres CLONE 1580328
  misc_feature: Encodes the peptide sequence at SEQ ID NO. 91814
aggccgctttcgaactagtggatcccccgggctgcttttattcgtctcacccctagaaaaaacctctccttccctccacccgcgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaagtaccaagaaattgtaaacatccgacttggagatggcaccaatcgccgtggtcaagtcctggaagttgatggcgaaaaagctgttgtgcaggtctttgaaggaacttctggaatagacaacaaatacacaaccgtgcagtttacaggcgaggttttgaaaactcctgtctcacttgatatgcttgggcgcatttttaatggttctggaaaacctattgacaatggccccccgatattgcccgaagcctacttggatatctctggaagttctattaaccccagtgagagaacctatccagaggagatgatccaaactgggatatccaccattgatgtcatgaattccattgctcgttggacaaaaaattccactgtttttctgctgctgggggtccctcacaaatgaaatggctgctccagattttggcgtccaggctgggtctttgtggaagacatttggagaaaggaaaagcatgcctgagggtgggggcaaagatgaccacctttgcctattggggttttgcctgcct

SEQ ID NO: 91814 - protein, 175 aa, Zea mays
  misc_feature: Ceres CLONE 1580328
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGIDMEEGTLEIGMEYRTVSGVAGPLVILDKVKGPKYQEIVNIRLGDGTNRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARWTKNSTVFLLLGVPHK

SEQ ID NO: 91815 - DNA, 832 bp, Zea mays
  misc_feature: Ceres CLONE 1580329
  misc_feature: Encodes the peptide sequence at SEQ ID NO. 91816
ctggagctccccgcggtggcggccgctctagaactagtggatcccccgggctgcaggaattcgtctcacccctagaaaaaaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccgcatggggcagcgcaacctggtggtggtctcgtcgccgccgctggcgcgggaggtgctccacacgcagggcgtggagttcggctcccgcacccgcaacgtggtcttcgacatcttcacggacaaggggcaggacatggtgttcaccgtgtacggcgaccactggcgcaagatgcgccgcatcatgaccgtgcccttcttcaccaacaaggtcgtgcagcagtaccgccacggctgggaggccgaggccgccgccgtcgtcgacgacgtgcgcctcgaccccgaggcggccaccgacggaatcgtgctccgtcgacgcctgcagctcatgatgtacaacaacgtataccggatcatgtttcgacggcgcttcgagagcatggacgacccgctcttcctcccggctaagggggctcaacggcgagcgcagccgcctcgcgc

SEQ ID NO: 91816 - protein, 217 aa, Zea mays
  misc_feature: Ceres CLONE 1580329
  misc_feature: SWISSPROT Homolog: EC 1.14.13.11 Trans-cinnamate 4-monooxygenase
MVLLFVEKLLVGLLASVMVAIAVSKIRGRKLRLPPGPVPVPVFGNWLQVGDDLNHRNLAALSRKFGDVFLLRMGQRNLVVVSSPPLAREVLHTQGVEFGSRTRNVVFDIFTDKGQDMVFTVYGDHWRKMRRIMTVPFFTNKVVQQYRHGWEAEAAAVVDDVRLDPEAATDGIVLRRRLQLMMYNNVYRIMFRRRFESMDDPLFLPAKGAQRRAQPPR

SEQ ID NO: 91817 - DNA, 1173 bp, Zea mays
  misc_feature: Ceres CLONE 1580331
  misc_feature: Encodes the peptide sequence at SEQ ID NO. 91818
  misc_feature (35)..(35): n is a, c, t, g, unknown, or other
  misc_feature (59)..(59): n is a, c, t, g, unknown, or other
  misc_feature (77)..(77): n is a, c, t, g, unknown, or other
aactggaaaaaaaacgtattggtgaaacccaaccnactttaataatacacgcggcgggntggtgtcggcaaactggnactccccgcggtggcggccgctctataatagtggatcccccgggctgcatgaattcgtctcacccctagaaaaaacgcctacctccaccaccagtccatctcctccgcagcgtctaaagccctatccggatatccccactcgccgaagcccggacacatggccagcttcggcgtcgacacccgcccggccgccgcggcctccggcggcggcgtgggcgtggcggggacgagggagggcgcgctctcgtttctctcccgcgggctgcgggaggaccttcgtctcatccgcgcgcgggccggggagctcgagaccttcctcaacgcgccggtgccggaacccgagctgttcgcgagcctccgtcgcgcctactcctcctcggcgtcctcttcgcggacccagctcgacctgtccgccatcgggaaagcgttcgaggccaacgcctggaggggcgcccaggactgccatgggggaagtggggagggcggaaaactgaaggcggaaggagtggggagcccagtcaaggaatggtcaaaggcaccacccttcagcgaagcttccaagcgggaaggagggctgggccccaggttcgcccccaagcgaaacattggctgtctaccaaaggcttcaaaggcctccaggcctttggagaaaagcaaccttggaacccttttttggcagcccccctggaaaagcccgtatccctggaaaagggaaatggattttctttggcccccaacctgggggaattttgttagggggggggaaaaaccctttccctttggacctttagaatcttgttgggagaaaaagaggaaaaatccagtgggaacaccaacgctttattttccgcaacccaaaacacttgtgggttatgttaataaaaaaaaaaaaaatgtttaattgtgtgacaacacaaggattgggggtgggggaaagacccctcctgggtgggccaggcaaaagcccgccaaaggggaacccaaaccccccggggactataataaatgtttttttttgagacaaaacacaaccaccgaaattcactggcttttcgccttcgcaataaaattatgaccaataggtattggggacaaa

SEQ ID NO: 91818 - protein, 247 aa, Zea mays
  misc_feature: Ceres CLONE 1580331
MASFGVDTRPAAAASGGGVGVAGTREGALSFLSRGLREDLRLIRARAGELETFLNAPVPEPELFASLRRAYSSSASSSRTQLDLSAIGKAFEANAWRGAQDCHGGSGEGGKLKAEGVGSPVKEWSKAPPFSEASKREGGLGPRFAPKRNIGCLPKASKASRPLEKSNLGTLFWQPPWKSPYPWKREMDFLWPPTWGNFVRGGEKPFPFGPLESCWEKKRKNPVGTPTLYFPQPKTLVGYVNKKKKNV

SEQ ID NO: 91819 - DNA, 1244 bp, Zea mays
  misc_feature: Ceres CLONE 1580332
  misc_feature: Encodes the peptide sequence at SEQ ID NO. 91820
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (58)..(58): n is a, c, t, g, unknown, or other
  misc_feature (59)..(59): n is a, c, t, g, unknown, or other
  misc_feature (68)..(68): n is a, c, t, g, unknown, or other
  misc_feature (69)..(69): n is a, c, t, g, unknown, or other
  misc_feature (1244)..(1244): n is a, c, t, g, unknown, or other
cccccctccctnccnngtcggcgcgtttgtgtggatttccgcgccgccgcgggggggnnacttaattnnttaaaactggggctccccgcggtggcggccgctctagaactagtggatcccccgggctgcaggaattcgtctcacccctagaaaaaactttcccctcccccggatccgcatggcgcctctgcagcccgcgccgctcggcctcccgtagccgacgcccggccccgtcccaggctcatctttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcagatctcacggtgctgtccatgagctgtgtgatccagccccagtgatccagagcagttgctgggctaatttcccccctgaattgcttctagatgtgattgtaaggttggaggcccagtgaagcccactggcctaaacaggaagaggggtaagtctcttgtggcagccgttttgtcgggaccctggagagaaaatttggcaaaggaagatccgttaaggaattccagaggtttctcttggggaaaaaatccaactttttttcccgggtggtcccctttaaagagcaagccctggggggtccctccgcagggaaattgttaaagcccaatttcccaagcggcctttatctagcccgaaaaaaggggcgaatgtaaaaagtccatagccccccacaaaaccccctataagctagatccttgtggggtaatatctgtaggatgggcccccttttataactcctaagcacgcctctggggtggggcccatagtcttgtggaataaaaggaagtggggataaaaagggttcttcccactcgccctacagagttagggatccagagacaaaccgtggaaaccctctccccgcccgccccccgcaaaatcgcgtggcgtccaccccggaaaatatgatctaccgccgcaacttgtgtgtaagtagggaaaaatatttcgtcaagaaataatattttcacctctctttaggggtctcccacagccgctaagaatatcgtgaacctccctctggcgcaaaaaagattgtgagaaggggcctcacaaaattctcccccctcgcggcggcctccatataggttgattgggcccctaatcttgacgagcgcacaccn

SEQ ID NO: 91820 - protein, 71 aa, Zea mays
  misc_feature: Ceres CLONE 1580332
MSFRSIVRDVRDGFGSLSRRGFEVKFLGHRRGRSHGAVHELCDPAPVIQSSCWANFPPELLLDVIVRLEAQ

SEQ ID NO: 91821 - DNA, 822 bp, Zea mays
  misc_feature: Ceres CLONE 1580334
ccccgcggtggcggccgctctagaactagtggatcccccgggctgcaggaattcgtctcacccctagaaaaaactttcccctcccccggatccgcatggcgcctctgcagcccgcgccgctcggcctcccgtagccgacgcccggccccgtcccaggctcatctttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcagatctcacggtgctgtccatgagctgtgtgatccagccccagtgatccagagcagttgctgggctaatttgccccctgaattgcttcgagatgtgattgagaggttggaggccagtgaagccacatggcctaacaggaagagtgtagtctcttgtgcagctgtttgtcggagctggagagaaatctgcaaagagatcgttaagaatccagagttctctggaaaaatcacttttcctgtgtccttaaagcagcctgggcctcgagatgtaaccatccaatgcttcatcaaaagggataaatctactcaaacctactacttgtatctgtgccttagcacagctgtgctttgttgaaagtggcaagttcctcctatgtggcgaaacggaacctcccgccccaccctggtacagaataattcaacttttctttggaaattctggaaaaattttatctgaaggtccagggcaaaatgggaccatttggggaaaggctggaaggtctaaa

SEQ ID NO: 91822 - DNA, 1053 bp, Zea mays
  misc_feature: Ceres CLONE 1580336
  misc_feature: Encodes the peptide sequence at SEQ ID NO. 91823
  misc_feature (6)..(6): n is a, c, t, g, unknown, or other
tttttnccaccttcccctacccaactacctcccccccaactaactccaatcaaccatgaaaatggtaataaatttaaaaaactggaactccccgcggtggcggccgctctagaactagtggatcccccgggctgcaggaattcgtctcacccctagaaaaagaggcacatatatatacacgcggcggcggcgggcagatccatcttggtatacacgtaatatatacacacacacacgatgggcagcgccggcggcggcggcgagagcaagctggagagcccgctgctgggcgcgtcgtcgacgggccacggcgaggcggtggtgagcgggcagctggagagcatcctgggcgacgcgtccgtgccgtgggggacgcggatggcgtcggcgtccgcggtggagatgcggctgctggtgcgcctggccgagcccgccgtgctcgtgtacatgatcaactacctcatgtccatgtccacgcagatcttctcgggacacctcggcacgctcgagcttgccgccgcctcgctcggcaacaccggcatccaggtcttcgcctaacgcctcatgctggggcatggggagcgccggtggagacgctgtgccgggcagggcgtacggggccgcacaaataccaacatgctggggcattctacctgccaacggctccacccgtccctgcctgaatggcccacgggggggtgccccccctggcccggccacctgttaaccgccctttcttccccggcccccccggtccctggcctccctggcctggggggggaagatcccccccaaaaaaatctgcgtttctggcccggcccggaccgcttcctttcttggtaaacggtccctgggttcccccgaacaaaatttttcgtgccttaacccccggcccaaattttccccacatctcacgaaaagtttcatgtgcagggcccctaaaaaccaactattggggggcccaaggcccctataaaattttccgcccccccgacggtttcaaaaaccccaacttttgcccttatagataacctaggaggcatttaaccgcct

SEQ ID NO: 91823 - protein, 106 aa, Zea mays
  misc_feature: Ceres CLONE 1580336
MGSAGGGGESKLESPLLGASSTGHGEAVVSGQLESILGDASVPWGTRMASASAVEMRLLVRLAEPAVLVYMINYLMSMSTQIFSGHLGTLELAAASLGNTGIQVFA

SEQ ID NO: 91824 - DNA, 1204 bp, Zea mays
  misc_feature: Ceres CLONE 1580344
tttatttcttttttttaacacaacaaaaaaaataaacactcccttttactccccgccggtgtataaccagcccacaaaaactggaactccccgcggtggcggccgctctagaactagtggatcccccgggctgcatgaattcgtctcacccctagaaaaaacatttccgtcccccatcccctccgcaccgcagctgtctcttcctctcctggtcttcgtcctgccactcctccaccccaacttgctctgctcttctcggattacggctcggggttggtcattggcggacagggcctttcaagaaagggcggcggcgcttttcctgacgcaagttgccccggtgtcctggcttgctgcgcgcttgggggttgggctcaggaatggggggagagcaggcgctgcgtctactggtcctgttcccatctctctgaaacttagatggatgcctctgtgaacgccaaaaaaaggttagtttctgtgggaacaatggccacagccgcctgcggggaaaatcattttaactgcgggtgtgctcccggtcctattccaaaaaaaaccccctttcttaactttaggggttgggtttgcaaatttaccggtacaaacaaaaaaggggagacaatatttttgccagtgcccatttgaaaagggcggccggaaacacacaaaaaaaacgctggtttcccccccagcaaaattaaccttccacatgggggggggggtgccccctatcctcgatgaaacaaacccaggtgggggaggacggacaaaaatataagtgcgctttttttcggggagagaaacccgtgaggagacatctcagctaaataatatcgaatctcctctatccatgaggaacaaaaaatatctaccctcttttttttataaaataattctcgtgtgccaaatgtactttacgatataatagtgtaattttgataaaaaaatacaagagagagtgttgtctacaccccacacacgacaggactatatcattggtagggaaaacatagcactctactcgcgaaaaagataaattatatttctagtagatgggcaagaaacactatttattaaagatcgacaaaaaagcgagactgggggaggcgtccgcaaggagatgagggtatggtggatctctctctccatgtcgtgctaatgtataccatgtccgtcctcgttttctagtggaaatatataataa

SEQ ID NO: 91825 - DNA, 844 bp, Zea mays
  misc_feature: Ceres CLONE 1580346
  misc_feature: Encodes the peptide sequence at SEQ ID NO. 91826
  misc_feature (690)..(690): n is a, c, t, g, unknown, or other
agctccccgcggtggcggccgctctagaactagtggatcccccgggctgcaggaattcgtctcacccctagaaaaactcgcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccggcggcggcggcggcgacgacgacgacgaggggcagggccgacgacggcgacgccggcgggccatcgagggccgtcaccggcgcggtggaggatccggaggccgtggccaacgacgtgcacgtgtccatcaggaacagcacggcccggcgaaacctcgggtacctgtcgtgcgggacaggcaacccgatcgacgactgctggcgctgcgactcggactggcacagcaaccggcagcggctggccgactgcngcatcgggttcggccgcaacgccatcggcgggcgcgacgggcaggtgtacgtggtgacggacccgagcgacgacgaccccgtgaaaccgcgcgaaggcacccttcggcacgccgtcatccaggagaagcggctgtggatcatcttcaagcggga

SEQ ID NO: 91826 - protein, 205 aa, Zea mays
  misc_feature: Ceres CLONE 1580346
  misc_feature: SWISSPROT Homolog: EC 4.2.2.2 Pectate lyase
  misc_feature (155)..(155): Xaa is any aa, unknown, or other
MAEAGCSAVRTRTAGLAAAAAAAAALLVLVVVAGSAALPGARVRVLDGLRHRSTAVAAGGARRWLRYSSWPAAAAATTTTRGRADDGDAGGPSRAVTGAVEDPEAVANDVHVSIRNSTARRNLGYLSCGTGNPIDDCWRCDSDWHSNRQRLADCXIGFGRNAIGGRDGQVYVVTDPSDDDPVKPREGTLRHAVIQEKRLWIIFKR

SEQ ID NO: 91827 - DNA, 823 bp, Zea mays
  misc_feature: Ceres CLONE 1580347
  misc_feature: Translation starting site: 197
  misc_feature: SWISSPROT Homolog: EC 1.4.1.2 Glutamate dehydrogenase
ggagctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatcaagatgaaggagattgctgaagcctaccttgggtccaccatccagaacgcagtggtgacagtgccggcctaatttcacgactcgcagaggcaggccaccaaggacgccggtgtcattggcgggcctcaaggtgatgcgtatcatcaacgaagcccactgctgctgctattggctacggtcttgacaagaagggcaccagcctccggcgaggaagacgtgctcctcttccgacttggggggggg

SEQ ID NO: 91828 - DNA, 832 bp, Zea mays
  misc_feature: Ceres CLONE 1580349
  misc_feature: Encodes the peptide sequence at SEQ ID NO. 91829
ccccgcggtggcggccgctctagaactagtggatcccccgggctgcaggaattcgtctcacccctagaaaaactctctcctctacctccttttcctctaacctttagctttcctccctccctctcctctctcccccctcctctaacaagaactactcccagccattcagatcctaagttgctgaccttgctgctgcttgttggagatagatttgttggttctaagttccaagtaccatgagtccaccgagtgtgatggggcagtttggggacacaacctacaccaaggtttttgttgggggactcgcgtgggaaacccagaaggagacgatgaggaagtacttcgagcagtttggggagatcctggaggctgttgtcatcactgacaagaacactggcagatccaagggctacggatttgttaccttccgggatccggacgcggcgatgagagcttgcgttgatcccgcaccggtgattgatgggaggagggctaactgtaatcttgcttcccttggggttcaaagatctaggcctcctactccccagcatggaggagctagaaactttagagtaatgaaatccttcaaccagcaggcaggaatccaaggtggactcggcgcagcttttccttctcatgccaccttccctcaatatgccatcccacaaggcctttcccttccaagttctaagggggacctctcccaaatacccccgaactaggggttatcccaacaaaccttctacaaaaatatttggggagggagcttcaattaccccggttttttagggggagggaaccacaaagccttggggaatgggtggaaacaggg

SEQ ID NO: 91829 - protein, 161 aa, Zea mays
  misc_feature: Ceres CLONE 1580349
  misc_feature (18)..(88): Pfam Name: RRM_1 Pfam Description: RNA recognition motif. (a.k.a. RRM, RBD, or RNP domain)
MSPPSVMGQFGDTTYTKVFVGGLAWETQKETMRKYFEQFGEILEAVVITDKNTGRSKGYGFVTFRDPDAAMRACVDPAPVIDGRRANCNLASLGVQRSRPPTPQHGGARNFRVMKSFNQQAGIQGGLGAAFPSHATFPQYAIPQGLSLPSSKGDLSQIPPN

SEQ ID NO: 91830 - DNA, 948 bp, Zea mays
  misc_feature: Ceres CLONE 1580350
  misc_feature: Encodes the peptide sequence at SEQ ID NO. 91831
ggagctccccgcggtggcggccgctctagaactagtggatcccccgggctgcaggaattcgtctcacccctagaaaaagtctagcattttcctacacccaatctgatctgaccaagccctctgaacacccccgcccatcctcctcctcctcctccgccgccgccgcccaagatgggcttcgacgtgggcctcgtcccctacaaccccgacgggtggggtccacctgaagttgccgccgcgccgccttccctcggtggtggcttctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccagcagcggccccaactcccgcagcgccgcgacgaagaggtcgaggctcggcgtcgcgaggccgagaaggagcgcgcccgccgcgaccgccactggcagcagaaccgccgcacgcaccaccagttcaaccgcggcggtccctcctcgtcgtctgccaaaccgtccgttgacatccagcccgagtggtcggtgaaggagcagatccctttctcatccttctccaagctctccttcgccgtcgccgaccagcccgaagaatctctcgtctgtggcgcagtcgagtactacgaacgggactacgatcgccgcacccccagggccgaacgtccccctcgagcgcttcaagtcgcggaacttctttcaggtcaccatatacgacgaccccgtcttccgccgtctgtgcttaaaatgacacgggccacggtcttcgccatggaaacattcctgggccgg

SEQ ID NO: 91831 - protein, 259 aa, Zea mays
  misc_feature: Ceres CLONE 1580350
  misc_feature (2)..(258): Pfam Name: eIF-3_zeta Pfam Description: Eukaryotic translation initiation factor 3 subunit 7 (eIF-3)
MGFDVGLVPYNPDGWGPPEVAAAPPSLGGGFSSVPFAPFSRSDKLGRIADWTRNPPGPGAFAAARDAVFDFAGLEDSIGLASADDSSFRLVDGKPPPRHPRFGPRWRFQQRPQLPQRRDEEVEARRREAEKERARRDRHWQQNRRTHHQFNRGGPSSSSAKPSVDIQPEWSVKEQIPFSSFSKLSFAVADQPEESLVCGAVEYYERDYDRRTPRAERPPRALQVAELLSGHHIRRPRLPPSVLKMTRATVFAMETFLGR

SEQ ID NO: 91832 - DNA, 802 bp, Zea mays
  misc_feature: Ceres CLONE 1580352
ctccccgcggtggcggccgctctagaactagtggatcccccgggctgcaggaattcgtctcacccctagaaaaacctcgtcgagagggcagacccagaaggagagggagacggaggagaggagcagcgtggctacgcccaagatcgagagacttgatcgagtcacctcgccgcgactcgctgaatcacaatccgagcccgacgattgggtgccccgcccacgactagagagagggaagaaaactgttggcgcgctgacgagtctcgatgtgtttttcttggactacggatgcaacgagctctgaaggcgtatgtgcgagagatgactgatgagggatgctactgacattgatgaacttgttatggggtgctggagaccgtcatcgagccggcctgcacgatcagctcatacgtttacgtgcagcaggatggacttctatgttacaacgatgcctgtcagcatgcaacgggcagtttccatgggtgctgttcacgcaatacctttctgaggactgtgtaccattgatccggcccttgactttttaaatacggaccaatgggaattttggtgcattaacaaaggacatctggcccaaaacgggcggcttaaaaaaggaagacttcttcccaaacctgaaaggggttccttggaagaaaaatcaaaaacttttcctaaggccccggagaaagggggaaccaaccttcccccaaagagggggttgtttttctttgtttttaccaaaatatgtgtgttttttaaagggcccacaaaaagaccccctttgtgcgggcctctcgtgggg

SEQ ID NO: 91833 - DNA, 883 bp, Zea mays
  misc_feature: Ceres CLONE 1580355
  misc_feature: Encodes the peptide sequence at SEQ ID NO. 91834
  misc_feature (790)..(790): n is a, c, t, g, unknown, or other
  misc_feature (821)..(821): n is a, c, t, g, unknown, or other
  misc_feature (822)..(822): n is a, c, t, g, unknown, or other
  misc_feature (839)..(839): n is a, c, t, g, unknown, or other
ctccccgcggtggcggccgctctagaactagtggatcccccgggctgcaggaattcgtctcacccctagaaaaagccgttcctgtttcttcgaattcttctcccgttcaggcgtccatccctcttttctctcgtggcgacgaagacgaccgacgccgacgctgacgccctacgccaggtgccaggttccgtcgggtccttcgccggcgaagagcatccaccaggcgacccagtgctgttctggtgcggtttcattgcggaagttttgttgtgggattttccggtggcgaagatgatccgactacccatgtacgcggcgttcagcctgctggcgacggcttcggcggcgtactacgcgttcagcagccgggagcagttctacccggcgatggtgtacctctccacctccaagatctgcttcgtgctgctcctcaacacgggcctggttgccatgtgcgtcgcctggcagctcgccaggcgtctcttcctcggctccctccgggaggccgaggtcgagcgcctcaacgagcagtcctggcgggaggtcatcgagattctcttcgccgtcaccatcttccggcaggacttctcggtgtccttccttgccatggtcgctgcactgcttcttgttaaggcactgcactggctcgcgcagaagagggtcgagtacatcgagaccacaccctccgtgcccttgctctcgcacatcaggattgtatccttcatggttttcctgctcacggtcgattgcctcttcctgtcaaactcactcaggtcactcatacagaagncgggaggcgtctgttgccatcttcttctccnnttgatatacgatactangcacatccactttatcaacatttgtgaagtacatattctatgtc

SEQ ID NO: 91834 - protein, 192 aa, Zea mays
  misc_feature: Ceres CLONE 1580355
  misc_feature (162)..(162): Xaa is any aa, unknown, or other
  misc_feature (172)..(172): Xaa is any aa, unknown, or other
  misc_feature (178)..(178): Xaa is any aa, unknown, or other
MYAAFSLLATASAAYYAFSSREQFYPAMVYLSTSKICFVLLLNTGLVAMCVAWQLARRLFLGSLREAEVERLNEQSWREVIEILFAVTIFRQDFSVSFLAMVAALLLVKALHWLAQKRVEYIETTPSVPLLSHIRIVSFMVFLLTVDCLFLSNSLRSLIQKXGGVCCHLLLXLIYDTXHIHFINICEVHILC

SEQ ID NO: 91835 - DNA, 762 bp, Zea mays
  misc_feature: Ceres CLONE 1580357
  misc_feature: Encodes the peptide sequence at SEQ ID NO. 91836
  misc_feature (761)..(761): n is a, c, t, g, unknown, or other
ctcaccgcggtggcggccgctctagaactagtggatcccccgggctgcaggaattcgtctcacccctagaaaaaccctctcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacacaagcctattcgggtgatgtattcaaaacgtgatcaagcagccgcaggagtggatctgctaacattttcataaaaatcttgacaagacaatagacaataaaacccttctgagaaccttttcttcatttgggaccattctctccgtaaagtaggcggggaatgaacaggccaatccaaggcctttgggtttgnt

SEQ ID NO: 91836 - protein, 106 aa, Zea mays
  misc_feature: Ceres CLONE 1580357
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNTSLFG

SEQ ID NO: 91837 - DNA, 907 bp, Zea mays
  misc_feature: Ceres CLONE 1580358
  misc_feature: Encodes the peptide sequence at SEQ ID NO. 91838
  misc_feature (494)..(494): n is a, c, t, g, unknown, or other
aaaagctggagctccccgcggtggcggccgctctagaactagtggatcccccgggctgcaggaattcgtctcacccctagaaaaaagaccccgacccaacaaagtggcaaccagaaaactcgcagagctagagcatctcgcttgcgaaacagagaggacggcgcgcgagaggaggaaaggaaaacaaccacgagtccacgatcccccatccattccattccacttccacccgagcaccgatcacggcggcgatggggaaggtgccatcgtcgcgggcgggttcgcggcaccagcagttccgcgcccgcgccatgacccgcgtcgacgacctccaggaggtcttctcgggcctgcagtccgcgcgcaaggactcacgccccaccgacgccgccatcctcgaggcgcagctccaacagatgctgcgcgagtggcgctccgagctcagcgctccgtccccgggctcctcgctccaggggcacgccagggaactgtcngatccaccttcggatacctctcgtatgctgcattggcggcggccgaagaagaggacgaccccccagcaaaatgggcaagcagaaacagaagcctccgccccccggtaaccgaaaccaggggcacccaagttctcccgggacttaaaacgggacccacccaagggaaccttttactccctttgggaaaaacccccccccctaaaaaagggaaccctcctaaaggggcctcaaccccctccgggggtccccaaaaaaagaaatatgggggggaaaattttttttagaaggaaaaaaaaaaaaaaaactcttcggggggaatagggggggccttaaaaaccgggggggggggctccccggggaaaacccccaaaattttccgcccgagggggccccccccgtggttttttaagaaa

SEQ ID NO: 91838 - protein, 116 aa, Zea mays
  misc_feature: Ceres CLONE 1580358
MGKVPSSRAGSRHQQFRARAMTRVDDLQEVFSGLQSARKDSRPTDAAILEAQLQQMLREWRSELSAPSPGSSLQGHARELSDPPSDTSRMLHWRRPKKRTTPQQNGQAETEASAPR

SEQ ID NO: 91839 - DNA, 797 bp, Zea mays
  misc_feature: Ceres CLONE 1580359
  misc_feature: Translation starting site: 186
  misc_feature: SWISSPROT Homolog: EC 1.4.1.2 Glutamate dehydrogenase
  misc_feature (750)..(750): n is a, c, t, g, unknown, or other
  misc_feature (751)..(751): n is a, c, t, g, unknown, or other
ccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaaggatgctggggtgattgctggcctcaatgtgctgcgtatcatcaatgagccaaccgctgctgctattgcctatggtnnctgacagaaagcaaccagcgtcggtgaagagaatgtcctcatcttt

SEQ ID NO: 91840 - DNA, 803 bp, Zea mays
  misc_feature: Ceres CLONE 1580362
  misc_feature: Translation starting site: 132
ctccccgcggtggcggccgctctagaactagtggatcccccgggctgcaggaattcgtctcacccctagaaaaaaacgggctgatctcccagccggcgcttccgcctcgcgtcccacaggtcttcatgtacatgcagccgcgctctccactgccgtcggaggcgcctgctgcctacaacgacatcatgatgcccggcatgggcagcgtgcagccagccgtctcgttgggccaagtgcctctctgtgagcgacccctatcagcgcatcttcctcgcctcctcgtccgaagaggcgtccgcggaggacgacagatccggcacgacctctgcgtctggcttcatctctttctccgacacgctcacggtagacgacggcgccgtcaggggtggacacgccgggtgagcctcacgctttccctgcgaccaggagatcaactctaggatctatctctggcgtggacaggcctggaacctcgaggtctactcggtcgtcaattctaccaacgatagctgttacgaagcacgcagtagcacaaggttgcatgctgctgcagagtcagtgctcgcctaggagtgcgacaccttgatactgttcacggcaccttgcggcacaatcatgaaggaagtttgtctcaccgcggtcatcgttgacgtctaacatcagctggtctctgacgatacattttgcagtgatggtccccaactgctatggccaatatgacaactgactactgattgcctggcaggaaaggcatccatacagggagccccaaatatgctagaaaaatatccccatccttgaat

SEQ ID NO: 91841 - DNA, 825 bp, Zea mays
  misc_feature: Ceres CLONE 1580365
  misc_feature: Encodes the peptide sequence at SEQ ID NO. 91842
gcggtggcggccgctctagaactagtggatcccccgggctgcaggaattcgtctcacccctagaaaaaaatcccagcccagacctcctcactcctcactcgcgcacaggaccaccaggcagtcgagttcccgcagtgcactgctctacgctacgccacagtacagcagcggccagcggctgcctaatctctccagccctgttttgcataacctagccacgccgcccaccgctgccgcgtcatccggccgtcgtcgcctgccccgcggcttctgcccccattcgccggcgaagcaagacgagccccgtcccagatcgccgcggcgcttactgccgccgccggcgaagcgcagggctggaaatctgtttgacggaccactcagggagtggcttcatgttaaatccatttctggtttcaagatgattcaccaatgacatctggaaactgtaatagtatgtgctgatcttctatgcttcaccacctgatcatcaatgggatgttacctgaggaaacagcctagctacctcagcattttgataattctgcaccttgttgctcatgacgcaagaacactgagttcagatggcgaagcactgcttgccgtctaaaaggcagttacaaatgcacatggagtcttcctaaaatggcgtgagcaagatgcagacaactgcaattggaacggtgttagatgtgatagtcatagcaagagagtgatttagcggattcttgcataccacagattagttgggcgcgtacatccagaagtggcaggattaatcagttgcgacccttgtcattgcaggaggacagtttgtatgcttcacta

SEQ ID NO: 91842 - protein, 38 aa, Zea mays
  misc_feature: Ceres CLONE 1580365
MGCYLRKQPSYLSILIILHLVAHDARTLSSDGEALLAV

SEQ ID NO: 91843 - DNA, 990 bp, Zea mays
  misc_feature: Ceres CLONE 1580368
  misc_feature: Encodes the peptide sequence at SEQ ID NO. 91844
  misc_feature (10)..(10): n is a, c, t, g, unknown, or other
  misc_feature (11)..(11): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (65)..(65): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (746)..(746): n is a, c, t, g, unknown, or other
  misc_feature (763)..(763): n is a, c, t, g, unknown, or other
gttttttgtnncttggtgggggttggtgttgggtggttggtgggggggggggtggtttnnnnnanggcaaannnnnnaaaaactggagctccccgcggtggcggccgctctagaatagtggatcccccgggctgctggaattcgtctcacccctagaaaaaaagaagagcacgcccactcctccggctcttcttctccaccggcaccagtccaccacctcctgccaccgcgcggccccaaccaaccacaccgcagcgcagcaatggcgggcaacggcgccatcgtggagagcgacccgctgaactggggcgcggcggcggcggagctggccgggagccacctggacgaggtgaagcgcatggtggcgcaggcccggcagcccgtggtgaagatcgagggctccaccctccgcgtcggccaggtggccgccgtcgcctccgccaaggacgcgtccggcgtcgccgtcgagctcgacgaggaggcccgcccccgcgtcaaaggccagcagcgagtggatcctcgactgcatcgcccacgggcggcgaacatctacgggcgtcacccaccgggcttctggcggaaacactcccaaccgacggcaccaaagtacggggccccgcgcctcccagggtccgaagcttgctcaaggccatgcctcaaacggccggggaattctttccggcaaccccggccaggcgaaccgggggcaacaaccccttgccccgttcggggagggttcacccccnccggccgggcggaatgncttgggggcggccattcaaaaaaccccctcccttcccaggaggcctaaacccccggggcattcccgccctttcgaaaaaaccccctcggaggggccattcccccgaaagactgcctctcaaaaacccgggggggtttaaagcccccctgtgcccgggcccgtcttcccggggggaaacccatttcaaccggcgggtcggggggggaacccctgggttcccccccttt

SEQ ID NO: 91844 - protein, 182 aa, Zea mays
  misc_feature: Ceres CLONE 1580368
  misc_feature: SWISSPROT Homolog: EC 4.3.1.5 Phenylalanine ammonia-lyase
  misc_feature (162)..(162): Xaa is any aa, unknown, or other
  misc_feature (167)..(167): Xaa is any aa, unknown, or other
MAGNGAIVESDPLNWGAAAAELAGSHLDEVKRMVAQARQPVVKIEGSTLRVGQVAAVASAKDASGVAVELDEEARPRVKGQQRVDPRLHRPRAANIYGRHPPGFWRKHSQPTAPKYGAPRLPGSEACSRPCLKRPGNSFRQPRPGEPGATTPCPVRGGFTPXGRAEXLGGGHSKNPLPSQEA

SEQ ID NO: 91845 - DNA, 825 bp, Zea mays
  misc_feature: Ceres CLONE 1580369
  misc_feature: Encodes the peptide sequence at SEQ ID NO. 91846
ctggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatctggcggtaaactccgtccaaggctaaatacaggcgagagaccgatagcgaacaagtaccgcgagggaaagatgaaaaggactttgaaaagagagtcaaagagtgcttgaaattgccgggagggaagcggatgggggctggcgacgcgcaccaaaaaaaaaacggttcctcagcttcgtctctctcgccggcgcggcaggcaactatcatcacttcattagctcatccaatctattccgatgacgaccgtgcccacgccacagcaggtggcgcactcacgggcacggctcgcaccccgcgcgatcggcgccttgctggagtttgccccagcctcctcctccctccgcttcgccgtgcaccgctgccgcactgttcgcctagaggtgaaggcatctggaaacacgtttggaaactactttcaggttgcaacctacggtgatctcatggggtg

SEQ ID NO: 91846 - protein, 70 aa, Zea mays
  misc_feature: Ceres CLONE 1580369
  misc_feature: SWISSPROT Homolog: EC 4.2.3.5 Chorismate synthase
MTTVPTPQQVAHSRARLAPRAIGALLEFAPASSSLRFAVHRCRTVRLEVKASGNTFGNYFQVATYGDLMG

SEQ ID NO: 91847 - DNA, 825 bp, Zea mays
  misc_feature: Ceres CLONE 1580371
  misc_feature: Encodes the peptide sequence at SEQ ID NO. 91848
  misc_feature (383)..(383): n is a, c, t, g, unknown, or other
  misc_feature (491)..(491): n is a, c, t, g, unknown, or other
  misc_feature (494)..(494): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (789)..(789): n is a, c, t, g, unknown, or other
ctccccgcggtggcggccgctctagaactagtggatcccccgggctgcaggaattcgtctcacccctagaaaaaaggatgctgacgcaatgtgatttctgcccagtgctctgaatgtcaaagtgaagaaattcaaccaagcgcgggtaaacggcgggagtaactatgactctcttaaggtagccaaatgcctcgtcatctaattagtgacgcgcatgaatggattaacgagattcccactgtccctgtctactatccagcgaaaccacagccaagggaacgggcttggcggaatcagcggggaaagaagaccctgttgagcttgactctagtccgactttgtgaaatgacttgagaggtgtaggataaagtgggagccctccnggcgcaagtgaaataccactaccttttaacgttattttaacttattcccgtggggtcggaagcggggcaccgcccctccctttttgggctcccagggccgggcctcgnccnggccgatccgggcggaagacattgtccaagggtgggggaatttttggctgggggcggcacatctggtaaaaagaataaacgccagggggtccctagatgagctccacgaggaaccggaaatttcctgttgggaacaaaagggttaaaaaacccccgcttggattccccgatttccccaaccgaataacaaaaaacggcgggaaacgggggggcccacccaacctcctttaaaaaccactctcgagattatgggaannnaaaaaatagagcggtgtacgaaaattaatccccgggntaactgctggggcacacgtttcataagcgacgtttg

SEQ ID NO: 91848 - protein, 55 aa, Zea mays; identical to SEQ ID NO: 82409
  misc_feature: Ceres CLONE 1580371

SEQ ID NO: 91849 - DNA, 805 bp, Zea mays
  misc_feature: Ceres CLONE 1580374
gagctccccgcggtggcggccgctctagaactagtggatcccccgggctgcaggaattcgtctcacccctagaaaaataaacgatgccgaccagggatcagcgggtgttactaataggaccccgctggcaccttatgagaaatcaaagtctttgggttccggggggagtatggtcgcaaggctgaaacttaaaggaattgacggaagggcaccaccaggcgtggagcctgcggcttaatttgactcaacacggggaaacttaccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaaattcatcgtgatggggatacatcattgcaattgttggtcttcaacgaggaatgcctagtaagcgcgagtcatcatctcgcgttggctacgtccctgcactttgtacacatcgacccgtcgctcctaaccgatgaatggtccggtgaagtgttcgatgcggggcaaacacggggggcgggtaacctaaaggcggaacatccacataaaatttatctacaata

SEQ ID NO: 91850 - DNA, 842 bp, Zea mays
  misc_feature: Ceres CLONE 1580375
tggagctcaccgcggtggcggccgctctagaactagtggatcccccgggctgcaggaattcgtctcacccctagaaaaaatttaaccctggaccgccctgcctactaggctgtggactcctactcctactcctactcctactctctccccttcctcccgttgattgattgaggggattgctactaggcgagcgctagcactgcgaagcatctcgcctcatcgtctcctccgtgctccacttgcccattcttacgcgctaagcaacaggccagccggccgtagctccaaagcgggagccggagccggagccgggagctaaggggggccgtgatgtcgtcgtcgccgacggccgcgccggcgccgaccacgccatcggctccgccggccaacgcgacaaatccgccgcccgcgaccccgtccgcgccgccaccggcggcgcccacgcctcccacgcccaccccgcccacgccgtccccgccgtccccagccgcgccgccgccgtcacccccctccgtcccggcccccgcgccgtcctccaccccggcgactccctctgcgccctcgccctcctccccttcctccccgggcacgcccgccaccccgtcgcctccatcggacaccccgtcgccgccgtcgtccggtggagggggcaggtccccgccgtcgtctgggggtggggcgatcacgccgtcctcccactcgcctcccaagtcgcactcccccgggggggccggtggccgcaagctcccgggccgtctacgtttgctcattccggggcgtgggccctccggccggccctccttgctgactgctggctccaccacctttaagttggcctctga

SEQ ID NO: 91851 - DNA, 1075 bp, Zea mays
  misc_feature: Ceres CLONE 1580376
  misc_feature: Encodes the peptide sequence at SEQ ID NO. 91852
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (79)..(79): n is a, c, t, g, unknown, or other
  misc_feature (81)..(81): n is a, c, t, g, unknown, or other
  misc_feature (83)..(83): n is a, c, t, g, unknown, or other
aaaattttaagctttgcttacgcgagaaccagaaataacacaaaccgttctacgcgacacgcgtcctcctnnnnncctnananaaaaaaagctgggactccccgcggtggcggccgctctagactagtggatcccccgggctgcaggaattcgtctcacccctagaaaaaaagtcatagaacggggttgcgaggtagcccaattctacagcactagtctttttcgtctcggtcgccatgtccttcagcgatgacgaaccgatcatcccttctccaaactcagggccgaggccgacgccgatcgtgcccgggagggtgcagctggtgagcaagaacaacaacatggctccactggaggagaatacccagaaagtgctgcttgaactgacccgcggcgactccaccgcgaccggtcggggcttgacctggtgggcttgcttgagctaaacggcaacatgcaggggaaaaaaattgaaaaaaataaaaactgccctaaaaatttcctggtggaaaaaaatttaagtttccatgaacccgccccttcccaatggtaacccctttccggggaaaaccgccccaaaaagagaaattctccccccccttgccgccagaggggaaacccaaaaagaaatcccccaacccccccaaattttgtgttagaaaaatttttttgtgaaaagccgccctttcataaaaccctggggggggggggggaacacccccccaccaacttttttgtgggagagagggggggcctcccctcaaaaaaaagggggggggtccaaggagggggtttttcttctcgccaaaaaaatcgaagagtcttccttccttcccgccggggggtgcgcgggtcttttatggggggcccccacttcttccattttttccccccagagggccccccacaaaaaaaaacgggggggggggaaaaacacccccccccccaacaattaaaaaaaaaaatggaacaaaagaccccgcggggggaaacacccccaccgggtggggggggggggggggaggaaaaaataacaaccccccacgtgggttaaaaaaaaaggggggtgcaaaaa

SEQ ID NO: 91852 - protein, 69 aa, Zea mays
  misc_feature: Ceres CLONE 1580376
MSFSDDEPIIPSPNSGPRPTPIVPGRVQLVSKNNNMAPLEENTQKVLLELTRGDSTATGRGLTWWACLS

SEQ ID NO: 91853 - DNA, 862 bp, Zea mays
  misc_feature: Ceres CLONE 1580377
ctcaccgcggtggcggccgctctagaactagtggatcccccgggctgcaggaattcgtctcacccctagaaaaaactgcaaatggcatcccattccattcttagctgtggcgctcgactacggctagaatagcgtggcttgagcggtgccctgatttattgtaaggatgatattgccgagagggcgggcggcgccggcgcaaggtcctgggctgtgcctgtggcgctcgtcgtcgtagagctctgtaccttctccttctacctgggcggcatctacagctccggacggagcctgctggactccatccagccggcgccgagtgctctcctcgccctcggcgccgccgcgacgacccgccgtacctccgacgacggccaggctcggtctgtatccccccccccggccgcagtgtcgttccccgagtgccccgcggactaccaggactacaccccctgcaccgaccccaatcgctggcgtatgtacggcaactaccgcctcagcttcatggagtggcactgcccgccgcctccttgacggcagcaatgcctggtgccgcctcccaatgggtacattcctcccctcgagtggcccccgaactagggacctgtggttggttccccgaatgtacccccttttattggtattcaaggcgaaaagtccccaccaagtaacttggttctgtgttaggaagtgcgaaccggctttctgggttccccgcggttgcaaggaaacaattttttccccaaaggggccgttcgggcgcccttacccttggaaccttaaattcccgggggcccttgggttccctcgggggcattgtcaccggacaggggaatcggaatcttcatttaccggtatgttt

SEQ ID NO: 91854 - DNA, 924 bp, Zea mays
  misc_feature: Ceres CLONE 1580378
  misc_feature: Encodes the peptide sequence at SEQ ID NO. 91855
ggagctccccgcggtggcggccgctctagaactagtggatcccccgggctgcaggaattcgtctcacccctagaaaaatcctctcgccccgcctcgtcatgtcacgtctcccaaagtcccatctcgccttcgcttaaacataaaccacacccatcgcacccagccagccctcgccatccatggccaccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgccgccgcccccaaccatgtccaccaccctccccatcaccaccagtcggtgcctcccccaggaccccctccacagtggtccgcgcagggacatccgcctccgccgccccgtggctatgggcctccaccgccgcagcaccagcatgtgccgcctccgccaccacgcggctacggacctccaccaccgcctccacacggccacgtacctccgccgcctccgccgcgacacggccacgggcctccaccaccgggccagcacgtactgccgcccctgctaccacacggccacggacctccgccaccgggccagcacatgccaccgccacacggacacgggcctccaccaccgggccagcgcgtaacgccgcctccgccgccacacggtcacggtcctccgccaccggggcagcacttaccgccgcctccaccaacacacggtcacggtcctccaccccgaaccagcaggcaccgtcgccgcctgatcctgtggcggggcctggggagctgatgggactgttccgggaggggcggttaaagaatgcgtggagcttctctcaaggtgggcggcacgaccgggaaccttctagagctccggt

SEQ ID NO: 91855 - protein, 218 aa, Zea mays
  misc_feature: Ceres CLONE 1580378
MATTAAIHLRPLRSVAVSSARSRSLLHLLARPLSSSQSSYAYRPSPTAPAAAAPNHVHHPPHHHQSVPPPGPPPQWSAQGHPPPPPRGYGPPPPQHQHVPPPPPRGYGPPPPPPHGHVPPPPPPRHGHGPPPPGQHVLPPLLPHGHGPPPPGQHMPPPHGHGPPPPGQRVTPPPPPHGHGPPPPGQHLPPPPPTHGHGPPPRTSRHRRRLILWRGLGS

SEQ ID NO: 91856 - DNA, 1333 bp, Zea mays
  misc_feature: Ceres CLONE 1580379
  misc_feature: Encodes the peptide sequence at SEQ ID NO. 91857
  misc_feature (1206)..(1206): n is a, c, t, g, unknown, or other
  misc_feature (1300)..(1300): n is a, c, t, g, unknown, or other
  misc_feature (1308)..(1308): n is a, c, t, g, unknown, or other
cgccggtgtttttcgctcgttgcagtcccacgaccctaatgcgttacactccttttctttctacacaaaactggagctccccgcggtggcggccgctctagaactagtggatcccccgggctgcaggaattcgtctcacccctagaaaaagcaactccgcaagtccgcaacctcctccttcccaccccttctcacgcgattcaagcgtttcccattctgagccctaatcctctctttccatactcgcggaagccaccaccaccggcaggggaagcggaaggggagcacctcgggccaggcaagatggtgctcgcgcagctgggcaggagcatctcccgcgacctggcgcagatgagcaacgcctcggcgatcgatgagaaggtgctcaacgactgcctcaacgagatctcgcgcgctctcctacaggccgatgcccagttcaagatggtccgcgacatgcacgccaacatcaagcgcatcgtcaacctcgaggcgctcgccgcaggcaccaactagcgccgtatcatgcagcaagactgtcttcacgggaactctggcataggtttataccccggggaagccttctttcaccccccaatattgaggcagccccagccgcaggtcatggatggctgggcctgcaaagggtccgggtaaaaacccaccaccttgttgcaaaaaatacgccctgatttatccatccgggaaaagaagggaattccgaaacccagccgtcctggtggtatgtgggccgcattacacttcctaggaagcagtggggtggccttttttcgaatccaaggctgaaaaggcgcaataacctgccgtgaggaatcgagaggccacaagcaattatccccctctgtttttcacgcgggataatgatttttcacaatagggaggaagaataccggtgaaaatgcccgagtctcgagaaaaatatctcggccttttgcctctcgagaggcgagcatgttttggtgaatgcacgggtgttcccccctcgataaacgcaaatataccttgtggtgaaccgcgccacgtctacaggcttggcggcggtatagacaacaggcgtggcggatagggggtcgctaatctctggtagtactgcgccgcccctctcctcttctgtggaaaacacacggccgccgacaagagatgccccgtgtatagtgacagccaagagctctgcgagttcgtggngtgaaagatccccgggtgagagtgagaaacgtcacgatagaggtgtccacgacggccgtttttcgctcttcaaatctgccgcactctcccacantacggggnttctcaccgtgatagccggcgcaca

SEQ ID NO: 91857 - protein, 70 aa, Zea mays
  misc_feature: Ceres CLONE 1580379
MVLAQLGRSISRDLAQMSNASAIDEKVLNDCLNEISRALLQADAQFKMVRDMHANIKRIVNLEALAAGTN

SEQ ID NO: 91858 - DNA, 970 bp, Zea mays
  misc_feature: Ceres CLONE 1580382
  misc_feature: Encodes the peptide sequence at SEQ ID NO. 91859
ccgcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgctccagcagaagctcgatggcttgccggcgatggtgcaggccgtccactccaacgacccctccgtgcagcttgaggccaccacacagttcaggaagctgctttctatagagcgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtgggggttcgagagtggtgctgtgcccatcttttgtcaagctactccactccctcagggaggatgttctggaacacggctgtatgggctttaaggtaatgttgctggggaacccccaaaagtgcccggatctggaacttgggccagggtgtggcttaaccctttgctgcagaaccttaatgagcattgtaagcattccgatgcttaggaatgccacatggtatctttctcaatttccgtggtgggggaagccacacccaaactttgtgtcaggtcaaaacg

SEQ ID NO: 91859 - protein, 186 aa, Zea mays
  misc_feature: Ceres CLONE 1580382
  misc_feature (4)..(97): Pfam Name: IBB Pfam Description: Importin beta binding domain
  misc_feature (106)..(147): Pfam Name: Arm Pfam Description: Armadillo/beta-catenin-like repeat
MSLRPSEREQMRKGNYKQTVDAEESRRRREGQMVDIRKAKREESLQKKRRDGFPASAAGVPPMGHSTALQQKLDGLPAMVQAVHSNDPSVQLEATTQFRKLLSIERSPPIEEVISTGVVPRFIEFLTREDHPQLQFEAAWALTNIASGTSENTKVGVREWCCAHLLSSYSTPSGRMFWNTAVWALR

SEQ ID NO: 91860 - DNA, 889 bp, Zea mays
  misc_feature: Ceres CLONE 1580383
  misc_feature: Encodes the peptide sequence at SEQ ID NO. 91861
ctggagctccccgcggtggcggccgctctagaactagtggatcccccgggctgcaggaattcgtctcacccctagaaaaaaccccatcgcacgccataacaaagcagagcgccacgccaccaccaccccagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggcctctccgacagcaccgtccgccggagcctggtcggaggcttctacgacgcgggggacgcccatcagttcaactaccccatggcatggtccatgaccatgctcagctggagcgtcatcgagtacagggcccagtacgagggcatcggcgagctcgaccatata

SEQ ID NO: 91861 - protein, 200 aa, Zea mays
  misc_feature: Ceres CLONE 1580383
  misc_feature: SWISSPROT Homolog: EC 3.2.1.4 Cellulase
MFGRDPWGGPLEISNADSATDDDRSRDLDRAALMRQLDETQQSWLLAGPGDQAGKKKKRYVDLGCLVVDRKVFMWTVGTVLGLGVFIGFVIMIVKLVPHKRPPPPPPDQYTQALHKALMFFNAQRSGPLPKHNGVSWRGNSCMKDGLSDSTVRRSLVGGFYDAGDAHQFNYPMAWSMTMLSWSVIEYRAQYEGIGELDHI

SEQ ID NO: 91862 - DNA, 912 bp, Zea mays
  misc_feature: Ceres CLONE 1580384
  misc_feature: Encodes the peptide sequence at SEQ ID NO. 91863
  misc_feature (869)..(869): n is a, c, t, g, unknown, or other
  misc_feature (875)..(875): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (883)..(883): n is a, c, t, g, unknown, or other
ccccgcggtggcggccgctctagaactagtggatcccccgggctgcaggaattcgtctcacccctagaaaaagattggcgattccatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctgggcttatccggacgctcaagatgtgcggcacctacggggcccacttttcgcaccatcgggggcctctacatcggcgtcgaacagctcgtgcagagccagcgcaagagcgcgacttcttcaacggggcccgtcggcccgtttctttgccggaagcctctgtctggcggtacgaaggaaagaagtttccgtccgccctcatcggagggcccgggcggggttttcaaattggctgggggggaaattgggcgggaataccacccaagtttaaaaccggcaaaagaatcctttcccctccccacttaaaaaaaaacccgccaatttgtttcccaatttgccctttttgaaaaaaaattggggccccccacacccgggggtatttgaaccgaggggggctttttttttttttttggcggaagaaatatttttttaaaaaaaccgggggccactgttttttcccgcacccctggggggggggaaaacccccccaaaaaattctttttttttctcttcgggggggcgggccccccnaaaaancnnnaaantaattaaaacgaaagcgtttcaatcgtgg

SEQ ID NO: 91863 - protein, 158 aa, Zea mays
  misc_feature: Ceres CLONE 1580384
MEDDSPLTKTMKGAVTGLAAGTIWGTVVATWYDVPRVERHVALPGLIRTLKMCGTYGAHFSHHRGPLHRRRTARAEPAQERDFFNGARRPVSLPEASVWRYEGKKFPSALIGGPGRGFQIGWGGNWAGIPPKFKTGKRILSPPHLKKNPPICFPICPF

SEQ ID NO: 91864 - DNA, 905 bp, Zea mays
  misc_feature: Ceres CLONE 1580387
  misc_feature: Encodes the peptide sequence at SEQ ID NO. 91865
ctggagctccccgcggtggcggccgctctagaactagtggatcccccgggctgcaggaattcgtctcacccctagaaaaaaccgcgctctttctctttcctcacgacgccgccgttgggagccctgcttcgggagagccccaacccttatcaaaccctaaatcaaaaactacccaaaaaaatccgcaaaatccagaaaaaaatcccaaaaatcaccacttgattggagatggcgacgcaagggcaagcggcggctggatccgcgtccgagtccggcggctctccggctgccttagctgcagcagccgcggcggcggccgcgttcccggcgacttcgctctacgtgggtgatctgcacgagagcgtgcaggacgcgcagctcttcgacgttttcagccaagtcggcggcgtcgtctccgtgcgcgtctgcagggacatcaactcccgcaagtcgctcgggtacgcctacgtcaactacaacaccagggcgacgctgcacgagcacttgaaactgctaacttcaccctatcaatggaaggcctatcaggatcatgtatttctaaccgggaccctagctcgcccaaaagcggcaagggaaatatttttataaagaatctttggaaggccaaaaacaaacaaagctttaatgaaaccattcgggccttttggaaataacctttcgtgaaaaatgccaaaaaccccttccgaaaaaaaaagggggaaagggtttttttcactttaaaaaaggaaaaaccccccccctccccttttaaaaacacgggggggggcttttaaagacaaaaaaaggttttgtggaacctttttttcccccccggagggggaaaaaaactccccccaaaaaaaaatattttatttttttgggagaaaaattcccaaaaacttcca

SEQ ID NO: 91865 - protein, 126 aa, Zea mays
  misc_feature: Ceres CLONE 1580387
  misc_feature (37)..(109): Pfam Name: RRM_1 Pfam Description: RNA recognition motif. (a.k.a. RRM, RBD, or RNP domain)
MATQGQAAAGSASESGGSPAALAAAAAAAAAFPATSLYVGDLHESVQDAQLFDVFSQVGGVVSVRVCRDINSRKSLGYAYVNYNTRATLHEHLKLLTSPYQWKAYQDHVFLTGTLARPKAAREIFL

SEQ ID NO: 91866 - DNA, 979 bp, Zea mays
  misc_feature: Ceres CLONE 1580389
  misc_feature: Encodes the peptide sequence at SEQ ID NO. 91867
ggagctccccgcggtggcggccgctctagaactagtggatcccccgggctgcaggaattcgtctcacccctagaaaaaaaggtcgatggcgacgtgttctcgcccgctcttcgtctccgactcggcggcctccgcctcgccgtctcgggcgtcctttcgccgccttcgcacggtcgcagtcgtatcgatttgggaacccctgccccacccaccactgcgggctgcagcctgccgtttcgctcgaacgaagcaatgctccaggagatccaccgagtgtttggcgagtggaccgtccgtttccagattgacgcggccaataaggagaatgctgtcccgttactcttcactgatggtcactttgcacggcaacctcagccggtgctacaaggccatgagcgcgctgcggccagatggggtatccaggcacttcatgtccgctggtgttttcgaacgcgtcgtttttaggggtgggtgctcttcaggttccatctcgggaagctttcttatataggaacctttcgtaattcggggcccaaaaaaaggaaaacttgcttttttcccggaagctctggcccccccggtttgaatccaacctatctagtgacaaatctttttaaagggggcaaaatttgggtttaaaatccgcggaaaaagtcccttccccaatgaacccgataacccacggggaaagagaaattggcggggaacaaaaaaatggctttaaaactggggagaaccccttttaaccctttctttaaaacccgaaaaaatttaaaaacttgtggggtcggggcaccaagggccccccccaaggggggggttttaccgggggggcacccaacgggaatttagggggccccccaaggaggtgtgtggggaaaaaaaccccccccgggggtgcgccggaaaaaagggagttttcctgtgggaaaacacttttgtgtttgttccaacaacccctcataatagggtgttttat

SEQ ID NO: 91867 - protein, 141 aa, Zea mays
  misc_feature: Ceres CLONE 1580389
MATCSRPLFVSDSAASASPSRASFRRLRTVAVVSIWEPLPHPPLRAAACRFARTKQCSRRSTECLASGPSVSRLTRPIRRMLSRYSSLMVTLHGNLSRCYKAMSALRPDGVSRHFMSAGVFERVVFRGGCSSGSISGSFLI

SEQ ID NO: 91868 - DNA, 714 bp, Zea mays
  misc_feature: Ceres CLONE 1580390
ctggagctccccgcggtggcggccgctctagaactagtggatcccccgggctgcaggaattcgtctcacccctagaaaaagggccacgccgcaccactgagcacccttcctccctgctcttgcctctgtcctatactactactactacccatctttagccgccgcgtgcatgcaagaagagaaatagccgccgatcgatcagcgctcgaccgacccgtcatccttgacgaacgaccagctaggaaacaggaggcaccttctttgcacgtgtcagtgccagccaggcgaacccaagggctagctgtcaggacggctcagctccagctttgcggccctccagctctccccagttcaagttcaatattggcgaagcatgcgagtttgcccctcttcccgtcaatcgtcttggggatccccggggttcccggttcgggggaaccctcccgaaaaaaaaattggccccggctttccggaagctttggcaaatggaatggtttcccgttttggccccgagaaaaggaaaaaaaaaaacccccaaaatccccgggccccctagggggcgcggggaaaaaaaggcccccccaggggaaaaaccccgcaaaaaaaaaaaatattttttccccccccttttggggggggggggggctccaaaaaaaaaaattttccccccccaaaaaattttttgccccccccgggggagggacgcccccaaaa

SEQ ID NO: 91869 - DNA, 934 bp, Zea mays
  misc_feature: Ceres CLONE 1580391
  misc_feature: Encodes the peptide sequence at SEQ ID NO. 91870
ccccgcggtggcggccgctctagaactagtggatcccccgggctgcaggaattcgtctcacccctagaaaaagctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccggcttcatgggtccagccaacaatgaggccaccacgcttaaacgatcatcgtcggccgaccttcgccgccgccttatcgtccccagctccaccgctggcaccggacacgccgccagtgcttccacaggagtgctgcccgccattatcggggtggcgcatctgctcgtgtcgctgggcattctgctcgccatggacaagttcctcagcaagcattcgtcggcgcgtccctcaagttcccaagggcctttttcggatgtccggggcttcccggggcccgtagtctcgaaaaattcgggcccccctccggaaagggttcattggctcttttaacccccccccgtgtcacccaaaggggggtgcctgttccaacccccaaaactggggggggccccccccccgggggaattcccgccgcccaggaaaaaaacccgcgaaacctttggggggggtgtccccccccaggggggagaataaagggggcccccgggaaaactgtagaaaatattttgctcccccggaccacaaaaaacccgccctttccccccgaagaaaggggggggggttttt

SEQ ID NO: 91870 - protein, 183 aa, Zea mays
  misc_feature: Ceres CLONE 1580391
MAATAMIGITNLRCRHDPLSSLPRATSSAARSCTLLPPRCRRHSSCCSPSSSVSPCRARVRPTAALKRIPAADTGFMGPANNEATTLKRSSSADLRRRLIVPSSTAGTGHAASASTGVLPAIIGVAHLLVSLGILLAMDKFLSKHSSARPSSSQGPFSDVRGFPGPVVSKNSGPPPERVHWLF

SEQ ID NO: 91871 - DNA, 880 bp, Zea mays
  misc_feature: Ceres CLONE 1580392
  misc_feature: Encodes the peptide sequence at SEQ ID NO. 91872
ggagctccccgcggtggcggccgctctagaactagtggatcccccgggctgcaggaattcgtctcacccctagaaaaacctctcctctcttcctcttcctcgcaccacctccaccaccaccctcctctcttctcgcctccaccaccaaaaggggtgagaggcacggggaccgcccgcctcgctcgctggcctgcacactggattcggcgccgcggcggtagttgcagcggcggcctggcagggagatgtcttcacgctcggggtctacgagcggcgggagcaccggtggcggcagcagcgcatggggaggcgccgcggtgccgctggccttgctgctgaggcgggaggtggccagcgagcgcaccgcatcagagcgaccggagctgcactcgggcctcttcagccaggccaagaaaggcgaggacttcacattcctcaagctcgaatgcgagcgcgtccccggcgtcccgtcctcctccttctccgccttcggcctgtttgatgggcacaatgggaacggggccgcaatttacaccaaagagaatctcttgaacaacatcttgaacgcggtccctgctgatctcaacagggaagactggcttgctgcactcccaagagcgctggttgctgcattcgataaaacggataaagatttccagactaaagcacgttcttcacgaacaaccgtgacatttgtcatactagatggattgttcatcactgttgcatcagttggcgattcccgttgtgtactacacgctgaacgctcactgtacgatatatgctctgatcatcgatttgatgcagataagaggagggtgatcgtgtcacaaatgtggaggtgatgtcgacagctaaatgctaatcgtcgcgcttagat

SEQ ID NO: 91872 - protein, 199 aa, Zea mays
  misc_feature: Ceres CLONE 1580392
  misc_feature: SWISSPROT Homolog: EC 3.1.3.16 Phosphoprotein phosphatase
MSSRSGSTSGGSTGGGSSAWGGAAVPLALLLRREVASERTASERPELHSGLFSQAKKGEDFTFLKLECERVPGVPSSSFSAFGLFDGHNGNGAAIYTKENLLNNILNAVPADLNREDWLAALPRALVAAFDKTDKDFQTKARSSRTTVTFVILDGLFITVASVGDSRCVLHAERSLYDICSDHRFDADKRRVIVSQMWR

SEQ ID NO: 91873 - DNA, 1091 bp, Zea mays
  misc_feature: Ceres CLONE 1580394
  misc_feature: Encodes the peptide sequence at SEQ ID NO. 91874
  misc_feature (825)..(825): n is a, c, t, g, unknown, or other
acccgcggtggcggccgctctagaactagtggatcccccgggctgcaggaattcgtctcacccctagaaaaactcctcacctcacctcactcataccgagcgccagttgccagcacgaagagtatgagtagggatcgaagagtgagtgaaactgaaacactaggaggagtcatggcgaccccggatgaccgcggcagctggttgctgttcctgtccctagcctccaaatgcgccggcgaccagtcttaccgcctctcgggcttcctggccgtctgcgccgtgtgcttcgtcgtgacctgcctcctgcactggtgcttcccgggaggaccggcgtgggggatgtggtggtggactccccggctcagcgcctgtaggggtccagacaacagcggggggcggcagcccttgcagggtcctagggggctggaccttggccgggaccttttggttcctgagtgggcctggcgggcccccgaacttcccggccggggggttaataccttaggggctcccgcgccctttatggcgcttttcccctccggggcccctagggggggggggtgtcccctcccaccctggaaattgttcccctaaaaattccttttcgtcccccgggttctcctttaattgtccccaaataaggaatttccgggcataggggtgtcctgtttttccacgggggcgtcataatgtttttcgtgaccctttgagggggctctcttttttggtgcaaagtggtcccacgtgtggggtgttatgtagtcaccccctcattttttctctcatatggagagggggtgcgtttccttttactgattatctccncttattgtattttctatcataagtctctgcgttgtaggagaaaaaatttgtggtggcgcctgtatcaaaatatcggctgaccaacatatttgtgataggagttcgtctctctacttaggtgggtgatatcattttcttttttattctttttaaaacacgccggtgattatcttccttcccttttacgccccatataatccgtcatgttccccttctattgtgtgcgcggttatgttgttaatcttcgcagttccggtagcgattct

SEQ ID NO: 91874 - protein, 140 aa, Zea mays
  misc_feature: Ceres CLONE 1580394
MATPDDRGSWLLFLSLASKCAGDQSYRLSGFLAVCAVCFVVTCLLHWCFPGGPAWGMWWWTPRLSACRGPDNSGGRQPLQGPRGLDLGRDLLVPEWAWRAPELPGRGVNTLGAPAPFMALFPSGAPRGGGCPLPPWKLFP

SEQ ID NO: 91875 - DNA, 924 bp, Zea mays
  misc_feature: Ceres CLONE 1580395
tggagctccccgcggtggcggccgctctagaactagtggatcccccgggctgcaggaattcgtctcacccctagaaaaaatgcggtccgttctttgttaccacccaattccctcatatccggcgcctccgttcgccgccgccgctcatctcgccgagaggtgacgggacctaaggaactcgccgagattcttatatagagaatcgcttttcaccccctgcggtctgctgcgtcgggtggtctccaacgggagaatcttccgatgctgttgcactatcacgcatgtgctctcgctagtcacgcgcttcggccatgtcttcgacaccttttgcttgtgatcgtgctcctgccagtctcaggctttcatcaagatctcggcgacctacattccgttattgctcacaccccccttggctcctccattgcagaccctcgacctgccagaggcacaaatgtgttccttcctgctgcttactcccactgcattgacaacccctccggatctgcctaatggcttcgtcactctatgcttgtgggaatgcatggcgtacgctccgattctgacaactctcgctggcctgctgctttcctgactatcgagcagttccccggtctggatcactgcgaacctccctcctccatctccagcgatgtgttctgacactccctgccctatggctagcctttggctctgctggtgttcctccggtctctgctgtcgagtttgagggctctgcaaaagcccctgaggatcgcattcttccgagccaacctgtcttttgtggacccccagggggagcgggtttgcgtggccctatcccgttctcagattgacctttgtttcctggatcttgctctgtgggcaccaacgtggtccggagctttccaacaagggatttttacccccttatgggcactctcgaaa

SEQ ID NO: 91876 - DNA, 924 bp, Zea mays
  misc_feature: Ceres CLONE 1580400
  misc_feature: Encodes the peptide sequence at SEQ ID NO. 91877
  misc_feature (392)..(392): n is a, c, t, g, unknown, or other
  misc_feature (924)..(924): n is a, c, t, g, unknown, or other
ctccccgcggtggcggccgctctagaactagtggatcccccgggctgcaggaattcgtctcacccctagaaaaacaacctcatcttctctccttttgctcggaacgcagacagaggccggtccccgatctccgatcccctcgtcgatccaagatgcagatcttcgtcaagaccctcactggaaagactatcaccctccaggtggagtcttctgacaccattgacaacgtcaaggccaagatccaggacaaggagggcattcccccggaccagcagcggctcatcttcgctggcaagcagctcgaggacgggcgcacacttgccgactacaacatccagaatgagagcaccctccaccttgttctccgcctcacgggaggcatgcagatcttncacaagaccctcactggaaagactatcaccctcgaggtggagtcttctgacaccatcgaccacgtcaaggcccagatccacgacaaggagggcatccctccggacaagcagcaggtcattaatgctggcatgcatctcgaggacgggccgccgctggcccgactacgacattcagaaggagagccccctcaacttggagttgcgtctcaaggccgggatgccgatttttgttaagactctaatcgggaagaaaaaacaaccttgaagggcaagtttctggaacccatccaaaatgggcaaggccagaatcccggaaaaggagggggatccccccgggaacaacccggaggtcctttttgcccgaaagaaaatttccgggaagggggccacctttgggcaaaaattacaattttccaaggggggaccccccccccccattgggggcgcgccccacgggggggggggtttcccaaatttttgggaaaaaacatatttggggaaaaagacaacaccccttaggggaggggggccn

SEQ ID NO: 91877 - protein, 157 aa, Zea mays
  misc_feature: Ceres CLONE 1580400
  misc_feature (6)..(74): Pfam Name: ubiquitin Pfam Description: Ubiquitin family
  misc_feature (82)..(152): Pfam Name: ubiquitin Pfam Description: Ubiquitin family
  misc_feature (80)..(80): Xaa is any aa, unknown, or other
MQIFVKTLTGKTITLQVESSDTIDNVKAKIQDKEGIPPDQQRLIFAGKQLEDGRTLADYNIQNESTLHLVLRLTGGMQIXHKTLTGKTITLEVESSDTIDHVKAQIHDKEGIPPDKQQVINAGMHLEDGPPLARLRHSEGEPPQLGVASQGRDADFC

SEQ ID NO: 91878 - DNA, 812 bp, Zea mays
  misc_feature: Ceres CLONE 1580401
  misc_feature: Translation starting site: 280
  misc_feature: SWISSPROT Homolog: EC 2.3.1.119 Icosanoyl-CoA synthase
  misc_feature (43)..(43): n is a, c, t, g, unknown, or other
  misc_feature (58)..(58): n is a, c, t, g, unknown, or other
  misc_feature (69)..(69): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (812)..(812): n is a, c, t, g, unknown, or other
ctccccgcgggtggcggccgctctagaactagtggatcccccngggctgcaggaattncgtctcacccnctggnnnanannnaaaaaaaaaaaaaaaaaaaaaacaacacatcgaacacgcgcaccgcaacgtagcgcggctaggggaaagagctcctttccttcagctgtgcccgtgcacaacgcacggcacgcgtggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagttggcgcgcctcggccccggcgagctgctctcgctgtggcgctcgctggagctggacctggtccacatcctctgctcggcgttcctggtcgtcttcgtcggcaccgtgtacgtgatgtcgcggcccaggccggtgtacctggtggactacgcctgctaaagccccccgccagctgccgcgtgcccctcggcaccttcatggagcacacgcgcctcatcagcgacgacgacaagagcgtgcgcttccagaccaggatcctgtagcgctcggggctcggcaaaggacactggcctcccgcccgccaaacactacatcccggccaaaccccagcatggaaggctcgcgcgccaaggggcaactcgtcattcttctccgccatggaagaactcctccgccggcacggggcn

SEQ ID NO: 91879 - DNA, 1278 bp, Zea mays
  misc_feature: Ceres CLONE 1580403
  misc_feature: Encodes the peptide sequence at SEQ ID NO. 91880
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (712)..(712): n is a, c, t, g, unknown, or other
  misc_feature (901)..(901): n is a, c, t, g, unknown, or other
  misc_feature (1122)..(1122): n is a, c, t, g, unknown, or other
tgagatttttgttgtcgttgtttgttcccccgcttttttcttccccccccttacctttttttgggggnnnncaaaactggaactccccgcggtggcggccgctctaggactagtcatccagcacactgcaggaatggacgtcccccctaggagatgcccatcatgccctgtgccttctccgtcgcaagcggttacaccctcttgagggatccacatcacaacaagggtcttgctttcacggagaaggagagggatgcacaccacttgcgtgggctgcttcctcctgcagttgttcctcaagaactccaaattaagaagatcatgcacaacctgcggcagtaccaggtccctttgcagcgctatatggccatgatggaccttcatgagaggaacgagaggcttttctacgagcttttaattgataacgtggaggagctgcttcctgtggtttattcaccaactggaggtgacccccgccgaaaatataggtccatctttcaaccaccacagggtctgtatgtcagcttgaagggacaaagggaagggtcctttaaagttcttaaggaactgggctttcattaaggaaacatttaagtttaaactggtggttacctgaatggtgaagccgaaatcctttggggaaatttggaaaaaatttgtggcttccctcaggggaatttggggaaattttccttagttaagaaaaaaaaanttgggcagctccgaataacacctatgcccctcttgggagaagagggctgctgttcatacaccaactaccacacctatttatgtatgttagccgcgcacatctactacacaacagtatatgcgaatctattttgggactacaacgcgatgagtttttatttaccgtcgggaaaaacataccggcgcggtncctcttagcaacgggagtcagtgtctgcggtgttttctttacacacatgtttgtccacccatcccgcgcgtgatagaaaacgactcctctatgtgccacgaaactgagtgagtgttaagagaagatgagtctctatctgggtaccacctctcattcttgtataaagaaaaaaacttaatcggggtgcggcgacatgcattatctaagctctcaagaaactncgaggctgccgtgccgaaaaaagatgccactatcacatctaggatgagtaggaagacggacatcttccttgcgacgaatgtcatatgatgctgggataataaacaagaatcgaacatcctccagaaattaataaaatgcactatgatcttacctgt

SEQ ID NO: 91880 - protein, 142 aa, Zea mays
  misc_feature: Ceres CLONE 1580403
  misc_feature: SWISSPROT Homolog: EC 1.1.1.40 Malate dehydrogenase (oxaloacetate-decarboxylating) (NADP(+))
MPIMPCAFSVASGYTLLRDPHHNKGLAFTEKERDAHHLRGLLPPAVVPQELQIKKIMHNLRQYQVPLQRYMAMMDLHERNERLFYELLIDNVEELLPVVYSPTGGDPRRKYRSIFQPPQGLYVSLKGQREGSFKVLKELGFH

SEQ ID NO: 91881 - DNA, 2012 bp, Zea mays
  misc_feature: Ceres CLONE 1580405
  misc_feature: Encodes the peptide sequence at SEQ ID NO. 91882
aaatcttcttccagctctgtcgtcgtcgtccagtcatggggagagagagaaaagctagctagtagctagctaccctctgtctctgtgtccgccatgcccagcccaacagggtgttgctgctcagtgctcaggtctactgctgccctcccatcattaactcatcatccaccccccctccctccatagtaaactacgctttgcccatctctctctctctctagcttttaccttcttaccccttgtctttctctctctctacaccccccactctctagaaaaggacagcatccccccgtccatccctctagctagctgagctcaagccaccacaagtttcgttccacagacaaagaaacgggcgagagggaaaggagaaagacagcgctctttgtcactcgctcgtctgcaacaagctaagtgtagagtgtagttgcaaagggattgcaagagagagagagagagtgtgtgtgtgatcgacccatggagctcttcccctcccagccggacctctccctccagatcggcctccccgccagcgccacgccgcacgaccaccaccacggcgccgccctcagcgccaggttcctcgcggcagccgcaggcggcggtggcaacgggatccctggcaacccggcggtggccatggcgccgtcgctgcagctgcccatgccgatgccgctgccaatgccgatgccgatgccccccaacgccgccgccgccgcgggggccgccggcggcctttactaccaccccgacgccgccgccatgctgcggcccatacgcggggtgccgctgtaccagcacccgcacacgcacgcggtgccgccgacgttcccgccgcacgcggcgggggcggcgggcccgtgcttctgcgagccttgccacgtcgccgcgggcgcctggcgccgcgccgggtgcggcgtcgggacgcgcgtcgtcgccgggttccccacggcggccaagcgcgccgccagggcgccgcgcatgcgctggacgtccacgctccacgcgcgcttcgtgcacgccgtcgagctcctcggcggccacgaaagggcaacacccaagtcagttcttgagctcatggacgtgaaggatctcaccctggctcatgtcaagtctcacttgcagatgtacaggaccgtgaagaacaccgaaaggccggcagcttcgtcagatctagctgatgggttcgagaacgggtcggcaggcgagatctgcgacgacaactcgctcgatctgcacggcgccggcaggccagagtcgggggcggcgcggcatggaaggttagctgcctgtaacgatcatgggagcagcaccggtgctcatggtgccctctggaatagctcctcaagggaagactggaccggctttcccagcgagtccaacaccgggcgcatgagcatgcattctcgatctctcaaggatcagacgatgcagtccaagagcctggagatcctctcggacatgaactcctcctgcgtgtcggagacgacgtcgtgtgccagcgagttgaacctggagttcaccctaggcccacgcatcaggcactagcgtgcaaagcgaccagaggacgatataatcggaggaggattagctataggctactatataagacggggtgctttgcattgcgtgcgtgcgtgttcatgggatcgtgttaagacggaggatgcactcatggtcccagagagagagaggcagcatatatgcatctttcatcgttaaaagaagctaggccatggacagacaccagcagcagcagcagccaggaaaaaggattaaaggtgtagcatcagcagcagctagctctagggtagtggtagtagtagtggtagagtgaggtgatcgttcgaaagctagctaaacacagatgcaatgtgtgtaatggatggagttgttgtgttagatcgagcgcgtttgcgtttaggatcggaccatctgtttaaagggcttttttcgcagcaacaatgcatgcatatgagcttgcatttaaaaaaaaaaaaaaaaaaaaa

SEQ ID NO: 91882 - protein, 356 aa, Zea mays
  misc_feature: Ceres CLONE 1580405
  misc_feature (168)..(219): Pfam Name: Myb_DNA-binding Pfam Description: Myb-like DNA-binding domain
  misc_feature: The sequence is a functional homolog of SEQ ID NO 1339 in the 10/374,780 US patent application
MELFPSQPDLSLQIGLPASATPHDHHHGAALSARFLAAAAGGGGNGIPGNPAVAMAPSLQLPMPMPLPMPMPMPPNAAAAAGAAGGLYYHPDAAAMLRPIRGVPLYQHPHTHAVPPTFPPHAAGAAGPCFCEPCHVAAGAWRRAGCGVGTRVVAGFPTAAKRAARAPRMRWTSTLHARFVHAVELLGGHERATPKSVLELMDVKDLTLAHVKSHLQMYRTVKNTERPAASSDLADGFENGSAGEICDDNSLDLHGAGRPESGAARHGRLAACNDHGSSTGAHGALWNSSSREDWTGFPSESNTGRMSMHSRSLKDQTMQSKSLEILSDMNSSCVSETTSCASELNLEFTLGPRIRH

SEQ ID NO: 91883 - DNA, 924 bp, Zea mays
  misc_feature: Ceres CLONE 1580407
  misc_feature: Encodes the peptide sequence at SEQ ID NO. 91884
ctggagctccccgcggtggcggccgctctagaactagtggatcccccgggctgcaggaattcgtctcacccctagaaaaaaaaacaaaacaccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggccgtggacgggcacccggtcctgctggacgtgccggccaacatccgtctcaccccggcgtcgacgctcgtgcccgcccgcgacgtccccgcagcgggcggcggcagcttcctcggcttcaacccggcggcggccgagagccggcacttggtgcccgtcggaaaagctccgtgacattcgggtcatgaccatcttccgttttcagggggtggtggaacaacccttgggttgggggaaacccccccgggaactggaaaaaaaaaacccaaaataagggtgtttaaccctctcccccgggaaaccccttggggggggggcaaacccaaaaggggggtggtccccccaaataaaaggggtctttttcgggcccttccctaggggcggggaagggggaaaaaaccctgggcccctgtgttgggaaaaagaaggtttctcgcgggggggcgggcgcccccttttttgaaaatcttttttttccccgcgggggggaaaaacctcttttataatttttcgagaaaccccctcgggggggttgcccccccccctgggtgttctctccccgtggggggaaaaaaacccccccccccttttaatatatttttt

SEQ ID NO: 91884 - protein, 93 aa, Zea mays
  misc_feature: Ceres CLONE 1580407
MAPNLSKKTPAGLLGDEVAPVEGLKPSRFTLKGKDLAVDGHPVLLDVPANIRLTPASTLVPARDVPAAGGGSFLGFNPAAAESRHLVPVGKAP

SEQ ID NO: 91885 - DNA, 1215 bp, Zea mays
  misc_feature: Ceres CLONE 1580408
  misc_feature (55)..(55): n is a, c, t, g, unknown, or other
  misc_feature (659)..(659): n is a, c, t, g, unknown, or other
taaattatgggcaagaaaattgctgcgtccaccttatggcgcccccccacaaaantagccacgaaataataaactggactccccgcggtggcggccgctctagactagtggatcccccgggctgcatgattcgtctcacccctagaaaaatcgacaccttgaagcgtgctagggtttcccccgtcttatcgcttcctcgttcccgcagccgccgcccaaaccctagcaaacccgtcctccgccatggccgacgatcactactcgtccaagcggaagtaggacgactcctcgccgccgccgcggcgcacggggttctcttctggcccgacgcctgcctcgccgcccgctggcggcgccccgtcgtacaacagcgttgcgccgccccccgatgagatccagctcgcgaagcagcgcgcgcaggagatcgcggcgcggatctttaacgccgcagaagtctagcgtctttcccccccccccgtatcgcgacgatgacgtcgggcggcttccggtggaggaagttccccctgcggtgggaatcagttgattggtgggtggtgggcccccctctggggggccgcaaggactttgggatttcatcgatctcacttttcccgtgatggtagggggcaattggtgagccttcccaattctctggtggncttgaagtgatttaatatatgtgatcacgggtgccaatcgggtaatagaaaacatcctaattaaggggcgcgggggtaaagccctcctgaagggggcttcgccacaggcgtgatacgattaccaggagtttgtggatagaaaacttatctctctccgaattcgtgaagaaagggggggggtattgagcgtatgacagtaacaaataatccggggagtaaaataaatactctgtgggggagaaacaacagcttttatttcccggggtctatgttgacagagttcgattctcactaaccttggggaacctttctataaaaatcttgctagatgttagactgaggggattaccccttttagttaatcctcgaagaaacccgggggtggactcctatagacgagaggcgcaaccagttcgaagatcagcgccttggtgggtggttttgtcctgcggtcatattcatttcagtgctcgaaaactgttgtaagacgaaaagaatgtccttcatataaagacctcttataattaggactcactcctatggtcttttctgaccg

SEQ ID NO: 91886 - DNA, 1260 bp, Zea mays
  misc_feature: Ceres CLONE 1580410
  misc_feature (54)..(54): n is a, c, t, g, unknown, or other
  misc_feature (67)..(67): n is a, c, t, g, unknown, or other
  misc_feature (405)..(405): n is a, c, t, g, unknown, or other
  misc_feature (470)..(470): n is a, c, t, g, unknown, or other
  misc_feature (591)..(591): n is a, c, t, g, unknown, or other
  misc_feature (593)..(593): n is a, c, t, g, unknown, or other
  misc_feature (594)..(594): n is a, c, t, g, unknown, or other
  misc_feature (681)..(681): n is a, c, t, g, unknown, or other
  misc_feature (683)..(683): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (775)..(775): n is a, c, t, g, unknown, or other
  misc_feature (776)..(776): n is a, c, t, g, unknown, or other
  misc_feature (881)..(881): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (889)..(889): n is a, c, t, g, unknown, or other
  misc_feature (924)..(924): n is a, c, t, g, unknown, or other
  misc_feature (927)..(927): n is a, c, t, g, unknown, or other
  misc_feature (967)..(967): n is a, c, t, g, unknown, or other
  misc_feature (1079)..(1079): n is a, c, t, g, unknown, or other
  misc_feature (1081)..(1081): n is a, c, t, g, unknown, or other
  misc_feature (1082)..(1082): n is a, c, t, g, unknown, or other
  misc_feature (1219)..(1219): n is a, c, t, g, unknown, or other
  misc_feature (1257)..(1257): n is a, c, t, g, unknown, or other
  misc_feature (1260)..(1260): n is a, c, t, g, unknown, or other
agaaaggggaggaactggtgtgtagagtgaaggatgagacccggcgcggttgcnagccagaaaaaantgcaaagctggaactccccgcggtggcggccgctctatactagtggatcccccgggctgcatgaattcgtctcacccctagaaaaagagcatcccacgaccacgataggtgtcttgtgtccagattgcacgctggcccctggggttgccctccccctcgtcgtcgtttcttctctcccctaaaggatcccccaaaccctacctccgatccgggaccagatggaaatggccgaccccaacaacaacgagtcggccagcgaccgtggctaccggcccggctggtgagtatgacaatatccatccaggcgttggcgcagcacgcgcaaagacatatgaggnttttttccaacccctccgctcgccaccacaagttcggccgcaaacagagccctgacccccctttnttatttgccccccccccatcagtttcctgaagggccccctagtagtgtgagcacgccgaactctccgagttggcagcgaccgacccgctaccccggaacccggcccgacttttagtatttntnntaaaacagagggaacctccgagcgaatgtaaggaccgcttccatcggttcgtaacactcctttgctgctgtcttgtgtttgtgtacntntcagaaccatttcttgtccgaaggggataatagaagctacagaaacacaatcctgtcttcctannnttataaattagattttgggggccatnnttacccgatggtgcactctttctccttaccaccgccgcctgtggggggtcacgctcctatcttagttggccctcggacgacaggagaccacccaaatcaacattntnnnnggntgttgttccgagggtgttaaatcaagttactgggngcngtagacgttgtacctcccagcaacatcgagaatttttgtntaaacagataaatgttccgcgcgatccgggcgcatatttacatctcacctcagtggggtatattcgcttgcgtgcgacacggattaatttcgcggaggagtttctgtccttntnngaggtcttcaccagatttctctgctgcggagagcacctatgtcaacctaatgtgtttacccaccgcgaacctgcgcacattgtgaaagaatttctttccatagatatatgtgtcaacacatcgtgcggacaccacantttacataggatcgcgtgagtaggagagacacgcatantan

SEQ ID NO: 91887 - DNA, 790 bp, Zea mays
  misc_feature: Ceres CLONE 1580412
  misc_feature: SWISSPROT Homolog: EC 2.7.7.49 RNA-directed DNA polymerase
  misc_feature (756)..(756): n is a, c, t, g, unknown, or other
  misc_feature (784)..(784): n is a, c, t, g, unknown, or other
ctggagctccccgcggtggcggccgctctagaactagtggatcccccgggctgcaggaattcgtctcacccctagaaaaaatcgcttcagctcggcgtcttcacaaacgccggcgcaaactctcgcccgagcccgacagatcttcaattccccattccgcccaccgatcgaccttcacgccagtctcggtctcttccgaaggcgtcggcaaccggaggcccatcgtcctcagagagcttcgcctgagtgtcgacaggcgtggagcagggcttgcagtcagacatgccagcccgctccaggatgtcgatggcgtactggcgctggtggaggaagagaccctgggagcggcgctcggcggtgatgccgaggaagtggtgtaggggccccaggtccttcatcgcgaactcacgctgaagggcgacgatcgtgcggcgtagaaggtcggcggtggatgccgtgagcacaatgtcgtcgacgtagagcaagaggtagacggtgtcgtcgccgcgccggtagatgaacagggacgtgtccgacttggcctcaacgaagccgatggaggccaggtaggaggcgaagcgactgtaccatgcccgtggcgcctgcttaaggtcgtacagggaccggttcagccggcagaccagatccggacggtcagcgtcgacgaagccggtgggctggctgcagtagacagtctccgtcagagtgccatggaggaaggcattcttgacatcgagctgatggatcgcccagtcncgggagagggcgaaggagaggacgacgncgacat

SEQ ID NO: 91888 - DNA, 1009 bp, Zea mays
  misc_feature: Ceres CLONE 1580414
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (70)..(70): n is a, c, t, g, unknown, or other
tttttttttnnccttnnttttttttgcggatttcattctttattctctctaccgtcagttctaaaaaaanaaaaactcgggccggtgaaaactggggctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcggggaggtccacggcagcaacaactggggaggggtctgcttgggaaccccccatcgacgggcgtgctccctcccaggaagctcattccgccttacggggggagtttccccccaagggcccaccctaacggaacaggctttccaacttaccggacccggctttcctccccccctaacctggcgggccagccttgccaaaggtaccccggggcggaagaaaacctttcctttcccaacaacctttcgggcccttcgggcgggcattccgggccttaccaaaggtcaaccccgcctaaccattcttacggcccagcctggcaaacgaaccctctaaggttccccccaacccttccggggcattcaaagacggggcccggccaaacggcccaaaaaatgggggaaaccggagtcccgggccccgttta

SEQ ID NO: 91889 - DNA, 2176 bp, Zea mays
  misc_feature: Ceres CLONE 1580417
  misc_feature: Encodes the peptide sequence at SEQ ID NO. 91890
gcgcccgagcagagagagcctgactctgcagctatacgagctcagaccctctcctccctcctttctcttaccttcctcgtgagacatcaccgccgtctcggtacgtggcagcaaccaaccgttcgcttctctctcctggagcgtcgcgcggggcccggcgggggaccgtacgtacctgtgcgcgaagacggggaccgtggcggagttcgagatggaggcggcgccgatgcgaaaggcgtcgtcgcaggcgtcgctggcggacccagacgacttcgacctgacgcgcctgctgaaccacaagccgcggatcaacgtggacaggcagcggtcgttcgacgaccgctccctcggcgagatatcgctcgccggcgcgggcacggccagccgcggtggctggggctacggcggcggggggatggagagctacgagagcatgtactcccccggcggcgggctgcggtcctactgcggcacgccggcctcgtccacgcggctctcgttcgagccccacccgctcatcggcgaggcctgggacgcgctgcgccgctccatggtgtccttccgcggccagccgctcggcaccatcgccgccgtcgaccactcctccggcgaagtgctcaactacgaccaggtgttcgttagggacttcgtcccgagcgcgttggcgttcctgatgaacggggagccggagatcgttcggaacttcctgctgaagacgctgctgctgcaggggtgggagaagcggatcgaccgcttcaagctcggcgagggcgccatgccggcgagcttcaaggtgctcaaggacccgaagcgtggcgtcgacaagctggtggccgacttcggggagagcgccatcggccgcgtggcgccggtggattccgggttctggtggatcatcatcctgagggcctacaccaaatccaccggcgacatgaccctcgccgagacgcccatgtgccagaagggcatccggctcatcatgaaccagtgcctcgccgagggcttcgacaccttccccaccctgctctgcgccgacggctgctgcatgatcgatcgcaggatgggtgtgtatgggtacccgatcgagatccaggccctgttcttcatggcgctgcggtgcgcgctcctcatgctgaagccggacgcggaggggaaggagatcatggagcggatcgtgacgcggctgacggcgctgagctaccacatgcggagctacttctggctggacttccagcagctcaacgacatctacaggttcaagacggaggagtactcgcacacggccgtcaacaagttcaacgtgaacccggagtccatcccggactggctcttcgacttcatgcccacccgcggcggctacttcgtcggcaacgtcagccccgcccggatggacttccgctggttcgcgctcggcaactgcgtcgccatcctcgcctcgctcgccacgcccgaccaggccgccgccatcatggacctcatcgaggagcgctgggaggacctcgtcggcgaaatgcccgtcaagatatgctacccggccatcgaggggcacgagtggcagatagtcacgggctgcgaccccaagaacacaagatggagctaccacaacgggggatcttggccagtgctgctgtggctgctcaccgcggcatgcatcaagaccgggaggctgaagatcgctcggcgcgcgatcgacctagccgaggcgaggctcgcgagggacggctggccagagtactacgacggcaagctgggtcgctacatcggcaagcaggcgaggaagctccagacgtggtccatcgcggggtacctagtggccaagatgatggtggaggatccgtcccacctcggcatgatctccctggaggaggagaagccgaccaagccggtgctcaggaggtcggcctcttggacagggtaaggtagtggcgggctggcggccacaaagacggcagcaggacccgagttctggttctttgagctaacatctcgaatttctctgcaacttcttgctttccggctggggaagtaggcgtgtccaatgttttggtgggtctcccatgtatgaatctttctctatatgatatataagtcccgtcggcgaaataaggaaccaaaaaaaaaaaaaaaaaaaaaaaaaaaaaaaaaaaaaaaaaaaaaataaaaaaaaaaaaaaaaa

SEQ ID NO: 91890 - protein, 568 aa, Zea mays
  misc_feature: Ceres CLONE 1580417
  misc_feature (94)..(561): Pfam Name: Invertase_neut Pfam Description: Plant neutral invertase
MEAAPMRKASSQASLADPDDFDLTRLLNHKPRINVDRQRSFDDRSLGEISLAGAGTASRGGWGYGGGGMESYESMYSPGGGLRSYCGTPASSTRLSFEPHPLIGEAWDALRRSMVSFRGQPLGTIAAVDHSSGEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKFNVNPESIPDWLFDFMPTRGGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKLQTWSIAGYLVAKMMVEDPSHLGMISLEEEKPTKPVLRRSASWTG

SEQ ID NO: 91891 - DNA, 1241 bp, Zea mays
  misc_feature: Ceres CLONE 1580419
  misc_feature: Encodes the peptide sequence at SEQ ID NO. 91892
  misc_feature (51)..(51): n is a, c, t, g, unknown, or other
tttctttttttacttgcggctctttctttatcttctagcacttaaacgtanctttccattttctatgatggagctcaccgcggtggcggccgctctagaactagtggatcccccgggctgcaggaattcgtctcacccctagaaaaagtcttcctcctgtaaccagatctgaacccgcggcgacagaaacaaacgctcgctcgctcgttcgttgtccgttcattgtcttcgccggcgccgagggaccctgagagggcaggcgggcgagatggcgggcggcggcgttgaggacgtgtacggcgaggaccgcgctaccgaagagcagctgatcacgccgtgggccttctccgtcgcaagcggctacaccctgctgcgcgacccgcggcacaacaagggcctggctttctcggatgcggatttcgaagcgcactacctccggggcctgctgctgtctgctctgggcccccacgagctggtggagaagaagcccatgccgaacctgtgccggtaatagcagccgctgcgcgtctatatcctctttatggggacgtgtcggagcgcgactattaggtttcttttacaacgctcttctatagactacttttcaggagcctgcgtccccggttgtatataaacgccacctgctcgggcgatgctttggccaaaagagtccggcaggttttcttactcccctcgctctgtatgggggcatggtataatccactcctcgctagttgacacactttggtgtcacacacatttcctcgcaagagtgggccctcaaatctaacccaatgtttctcgctccattatgtgttgctccatcaccccggtagatctgaccgcggtcgtttgtgtctctctgatcgggcgctgcaattatcgctacctatcatctgtcgaggatgtatggattataaatagttcttgacgctgctacagctgcggtgtaccgggtattttattccagtgtggtgagcgacgctgtttgtttttcctcaccctcgttttaccctctgttattggcaattgttttttttttcaccatgtatctctcgtccttctatcccacatttgtgtgtttgtgctttctccgtctctccatacccgcttgcgctcagatgtatacgcatttttgctgttctccgcccttcatttcgacttgacgcgttacccgtcctcgggacttaatcttaatcgcctctgacaataatcgatgtgctgaatatcttcagatattg

SEQ ID NO: 91892 - protein, 80 aa, Zea mays
  misc_feature: Ceres CLONE 1580419
  misc_feature: SWISSPROT Homolog: EC 1.1.1.40 Malate dehydrogenase (oxaloacetate-decarboxylating) (NADP(+))
MAGGGVEDVYGEDRATEEQLITPWAFSVASGYTLLRDPRHNKGLAFSDADFEAHYLRGLLLSALGPHELVEKKPMPNLCR

SEQ ID NO: 91893 - DNA, 949 bp, Zea mays
  misc_feature: Ceres CLONE 1580421
  misc_feature: Encodes the peptide sequence at SEQ ID NO. 91894
  misc_feature (781)..(781): n is a, c, t, g, unknown, or other
  misc_feature (795)..(795): n is a, c, t, g, unknown, or other
tggagctccccgcggtggcggccgctctagaactagtggatcccccgggctgcaggaattcgtctcacccctagaaaaaggccgttaagcccacatccatcatcgccgcctccgccacagcacgccatggagaccagcaagtcgccaccgctctactcggcgccgcgggagccctctgccacgacagtgatgctgtgtccgtgcctggcgttcttcctcctcgctctcatcatcacctccatcgcactcactgtccactttcgcctctactgccacactcctcttgcccacctcatctccccgcaccgctgcccccaccacatctgacctccgtctccgcccgcatcgctggcgtggtcctgcttcccagaggcgtgttccctctgctgccggcgagatccccatacgttatgggttcgcctctcctcgcgacgccggcatgcggggcttacgacgtgctctggggcttccgcaccggaaggttcctctccatcttgggtgcctccctacgaagatcaggggctcgcggaagcaggtaggcggcttccaaaccaccccctgaggggcttgcgaccgccgtcatgcgacgggccaatcgcggaaccgtggttctcccctcccgggggcccgaacaccgaaaccctgggaggggcgggcgaatttataagagggttctttcgcaacaccgctttctggcaaaaaccggttccggtgacctcatagggggcgttctacacgcttttcaaagcatctctactattgggtcccgttcactaccggnttttttgtgaggtntggaggccctcaatatgatcacggggtggggcttgtacccccgcgttcttccctcttaccgcgtcttgggggagtgaggttacacgccttctttatagacttacaaataagggctacgtctgctattatttcttaggagttgctgaaccacata

SEQ ID NO: 91894 - protein, 42 aa, Zea mays
  misc_feature: Ceres CLONE 1580421
MGSPLLATPACGAYDVLWGFRTGRFLSILGASLRRSGARGSR

SEQ ID NO: 91895 - DNA, 964 bp, Zea mays
  misc_feature: Ceres CLONE 1580422
  misc_feature: Encodes the peptide sequence at SEQ ID NO. 91896
aaaaagctggagctccccgcggtggcggccgctctagaactagtggatcccccgggctgcaggaattcgtctcacccctagaaaaaaatcccacaccaccgcaatcatccacaaccagagccaccctgccgtcgtaggcgcacgcgccgtagataggaagcttattaagctagcgcgtgtcgctgcgccatcctgccatggaggatcaggcgctggcgccgctgctgcagccgctcccgctcggcgaaacgggggccatcaaggggcgcgcgaggcgggcggcgctggagtggtgggtggagtcgaagaagctatggcacatcgtgagcccggccatcttccaacgatcgcgctgtacggggtcaacgtcgtcacaaaatccttcatcgggcaacctcggggaccctcaaacttcgcgcctttttcattggttgcacccgtcgtgggggggctttcaaattcgggtttcctgcctggaaaaaggcgaaaccccctgagaaaacccttttggggggagggggttttcccgccccaaaaaaaaccccccatggcttgggggggtgtaccctggggagcgcccctcggagaaaaggggggcccaaaaattttctcccccccccgccttttttagcccccaacgattatttttttttttttggagaaaaacactctcctctcccctatataaaagggggggctctcctccccaaaaaaatattctccggtgggttggggcggggagaaataaaaaaaaggggggtggggggctcccccccccaaacaacttttttctgacggggggggtggagggtgcgcccccccccccccaccgggggttttgttggggaaaaaccctcgcaaaaaaaaagagggggggggcgcgcatattatccctcggggggcctgtgggccgcgctcctaatatccgggggtggggccccccagggtgggggtggtgggctcc

SEQ ID NO: 91896 - protein, 99 aa, Zea mays
  misc_feature: Ceres CLONE 1580422
MEDQALAPLLQPLPLGETGAIKGRARRAALEWWVESKKLWHIVSPAIFQRSRCTGSTSSQNPSSGNLGDPQTSRLFHWLHPSWGGFQIRVSCLEKGETP

SEQ ID NO: 91897 - DNA, 778 bp, Zea mays
  misc_feature: Ceres CLONE 1580423
  misc_feature: SWISSPROT Homolog: EC 3.2.1.21 Beta-glucosidase
ctccccgcggtggcggccgctctagaactagtggatcccccgggctgcaggaattcgtctcacccctagaaaaaattcactactcaagccgatcatgactctcccctcagtctagcagggggggaaatggctcctcttctcgccacatccctgaaccacgctgcccgtccagtccttagaagccatctaagacccagcatatgagactttctcactacaccacctatctacttcacacgcacagaacgtaagcaaaggaataaccttatctttacaccacgatctgccatagtaggcgatacatgaactgcagccaattgttgagcccttctgaaatccctccaacggacttggtacccctccgacttcatctatggtgccgccacatcagcgatgcaaagtgatagtgcttggactcatcatgaatgctggacaagcattgggatactcctgtcaaagctttcatgaaaggaaaattgaccggcaccatgcaggaatttggaggaattctacttatgtacaaacggatgtccattcctaacgaaggggcatggaccttagagattttttactactggccaaaaaaccccctaagaaacgcccaaggcgttttaacccggaggggttcctttttcaaaaaggtcttcccctgtgggccaaaacaagcgctataccccctttaaagaaatttttcccccggggggggcccccccgcccttttaaaaaaaaattcccgggggacctttttaaaaaaaaaatccttccaagaggggtggaa

SEQ ID NO: 91898 - DNA, 956 bp, Zea mays
  misc_feature: Ceres CLONE 1580424
  misc_feature: Encodes the peptide sequence at SEQ ID NO. 91899
tccccgcggtggcggccgctctagaactagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaagaggagtacgagaagaccggcaagatccccggacccggagtccaccgacaacgctgagttcaagatcgtgctcaccatcatccgcaacggggtcaaggctgaaccccaaaaaataccgccagattaaaggagaagcttgtcgggctcccttaaggaaacccccaccggggttctagaggctctttccatatgcctggagaaccggggcccttcctcttctcgtgccatttacgttcaacgatttccttccccaagaagcgagttttgaacaaccttgtttgggttgccgcccctccacccccctcattgggcttgataaaggccccccgaccttttttgatcccc

SEQ ID NO: 91899 - protein, 172 aa, Zea mays
  misc_feature: Ceres CLONE 1580424
  misc_feature (12)..(172): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQDHAAAAIARDSAAVFAWKGETLEEYWWCTERCLDWGEAGGPDLIVDDGGDATLLIHEGVKAEEEYEKTGKIPGPGVHRQR

SEQ ID NO: 91900 - DNA, 965 bp, Zea mays
  misc_feature: Ceres CLONE 1580426
  misc_feature: Encodes the peptide sequence at SEQ ID NO. 91901
tcaccgcggtggcggccgctctagaactagtggatcccccgggctgcaggaattcgtctcacccctagaaaaaatcttcctcgcaacgccgacgctgcaacttccgctccctccccgactcgcgctcggcacgcaggcaggcgactgcggtggcgctcaggctcgggctctcagcaacggcggggttgcaagattttccagcatagcttgctcacctacttctcaatttagaagacctcaatttctggatctgagcatcaaatcaagaccataccactttagtcagtcctgtctgatggcactgactgcagctccagccagtggtgattcacagagtggtcctcagaggaactatcaggttgttgttgctgccacttgtgacatggggtattcccccccctggggtattgccatggaagcttcgtgggagatcttaaattcctcaaagaacttacactaacgtaccactggatccctggcaaaaataaatggcactttataatggggaagggaaacacttgggggagagcctttccctggttaaatgcaaaggcccacctgccctgaggccgtttggaaatgtctttaactttaccctcaattcccgggaaagttttctggaatttttgacacccccctactaagaaaagggctggatttaaaaagatcgggaaaattacgtaaaaaatctagtccactttaaaaagcggggtgagagcaatcagacaccccagttaacctggcttattccgattatgagcaaaggtttcttttggtccctaatgcagggtagaggcgcgcgctactttgaaaggaattaattgtgagaaaagggacgtcagcgtggtgcggggggctctccccacgcgggagagggaatagcgtcactccaagaccctttgagaggcaggggaattttttaaggaaccctccactgttgatgttctcagaagatgtagcaagga

SEQ ID NO: 91901 - protein, 54 aa, Zea mays
  misc_feature: Ceres CLONE 1580426
MALTAAPASGDSQSGPQRNYQVVVAATCDMGYSPPWGIAMEASWEILNSSKNLH

SEQ ID NO: 91902 - DNA, 888 bp, Zea mays
  misc_feature: Ceres CLONE 1580427
  misc_feature: Encodes the peptide sequence at SEQ ID NO. 91903
  misc_feature (829)..(829): n is a, c, t, g, unknown, or other
  misc_feature (840)..(840): n is a, c, t, g, unknown, or other
  misc_feature (864)..(864): n is a, c, t, g, unknown, or other
  misc_feature (888)..(888): n is a, c, t, g, unknown, or other
ctccccgcggtggcggccgctctagaactagtggatcccccgggctgcaggaattcgtctcacccctagaaaaacccctgcgacttcaacctctctcaatctcctctccttgtccactggcttgggcgtgcctttgcgtgcgacgggagctaggaatccacggcatcggaaaagtggccgcctgaagaaccgatttctccaagatttttttgtccatcctatcgcttgcaggatcggattcgccgtctctggccatggttctcgccggcctccgccggcacgtcggccagttcttgaccagcagtaatgagcttatggcggcgtcgctctcggccgtgagctgcgcggacgaggtgcagaaggcggagggggcggggtgccgtgacgacgccgcggcgctgcggctcaagaaggtggccatggcggcgatactggtggccggggtgctcggggtggtcctgccgctcgcagggcggaagcggcgcgcgctgcgcacggacagcgccgcgttcctggcggccaaggcgttcgccgccggggtcatcctggccacggggttcgtccacatgcttcacgacgccgagcacgcgctgtccagcccgtgcctccccgccgcgccgtggcgacggttcccagtccccgggttcgtcgccatggccgccgcgctagccacgctggtgctcgacttcctggccaccaggttttacgaggccaagcatcgcgacgaggccgcgcgcgtcaaggtggccgccgccgccgcactgggtgcgacctcctctgggagcgacgaggacatcaccgtggtcaccgtcgacgaggacgagcgcanggccccgctgnttgcaacgcactgccatggacacngtcacagccacagccacagccatn

SEQ ID NO: 91903 - protein, 211 aa, Zea mays
  misc_feature: Ceres CLONE 1580427
  misc_feature (192)..(192): Xaa is any aa, unknown, or other
  misc_feature (196)..(196): Xaa is any aa, unknown, or other
  misc_feature (204)..(204): Xaa is any aa, unknown, or other
MVLAGLRRHVGQFLTSSNELMAASLSAVSCADEVQKAEGAGCRDDAAALRLKKVAMAAILVAGVLGVVLPLAGRKRRALRTDSAAFLAAKAFAAGVILATGFVHMLHDAEHALSSPCLPAAPWRRFPVPGFVAMAAALATLVLDFLATRFYEAKHRDEAARVKVAAAAALGATSSGSDEDITVVTVDEDERXAPLXATHCHGHXHSHSHSH

SEQ ID NO: 91904 - DNA, 886 bp, Zea mays
  misc_feature: Ceres CLONE 1580428
  misc_feature: Translation starting site: 196
ctttgctggagctccacgcggtggcggccgctctagactagtggatcccccgggctgcaggaattcgtctcacccctagaaaaagctaccagcgtactgccatggttccgattctgagtcaccttgccgttgttcgcgcacgcgccgtagataggaagcttattaagctagcgcgtgtcgctgcgccatcctgccatggaggatcacgcgctggcgccgctgctgcagccgctcccgctcggcgaaacgggggccatcaatgggcgcgcgaggcgggcggcgctggagtggtgagtggagtcgaagaagctatggcacatcgtgggcccggccatcttccaacagatcgcgctgtacggggtcaacatcctcacacaatccttcatcggccacctcgggcgacctcaagctcgccgccttctccattgctgccaccgtcgtcgggggcttcaacttcggtttcctgctgggaatggcgagcgcgctggagacgctgtgcgggccggcgttcggcgccaagaaacaccacatgccggggggggtacctggggccctcctggatgcagggtgttcaatcttgcccgccacgattggaagcctacggtaaattgtttagtgggagaaaccttgctgcttgctgaatcggggctgttccccaggaagcctgttcgcaagttaggtgggggccataagaaaggagtgttgggttggcctcccgtcaggcaattttacaaccatgagcgattgcgaggggcccgagcttccccgccgggttttccgggcaagaaggcctaggttagaaagaacacggaggatggaacacaggcaaatcaaccgtgtttgaatctgatatgcgacctccggaaaaatatcagcacgggtgttg

SEQ ID NO: 91905 - DNA, 919 bp, Zea mays
  misc_feature: Ceres CLONE 1580429
  misc_feature: Encodes the peptide sequence at SEQ ID NO. 91906
  misc_feature (754)..(754): n is a, c, t, g, unknown, or other
  misc_feature (810)..(810): n is a, c, t, g, unknown, or other
  misc_feature (811)..(811): n is a, c, t, g, unknown, or other
  misc_feature (865)..(865): n is a, c, t, g, unknown, or other
  misc_feature (876)..(876): n is a, c, t, g, unknown, or other
ctggagctccccgcggtggcggccgctctagaactagtggatcccccgggctgcaggaattcgtctcacccctagaaaaagacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgccctcgtcggcggcttcctcgccgacgccaagctcggccgctacctcaccatcgccatctccgccacaatcgccgccacgggcgtgagcttgctgacggtggacacgacggtgccgagcatgcgtccgccggcgtgcctggacgcccgcgggccgcgcgcgcacgagtgcgtgccggcgcgcggcgggcagctggcgctgctgtacgcggcgctgtacacggtggcggcgggggccggcgggctcaaggcgaacgtgtccngggttcgggtcgaacagttcgacgggcgcgacccgcgggaagagcgcgccatggtnnttctctcaacgcttctactctgcgtcagcctggggtcgctgttcgcggtcacgntgctggtgtcntgcagaacacctgggggcgggctggggctacggcgtctcccaa

SEQ ID NO: 91906 - protein, 229 aa, Zea mays
  misc_feature: Ceres CLONE 1580429
  misc_feature (175)..(175): Xaa is any aa, unknown, or other
  misc_feature (194)..(194): Xaa is any aa, unknown, or other
  misc_feature (212)..(212): Xaa is any aa, unknown, or other
MVSGAGHGGYGGGDDGQAVDFRGNPADKSRTGGWLGAGLILGTELAERVCVMGISMNLVTYLVGELHLSNSKSATVVTNFMGTLNLLALVGGFLADAKLGRYLTIAISATIAATGVSLLTVDTTVPSMRPPACLDARGPRAHECVPARGGQLALLYAALYTVAAGAGGLKANVSXVRVEQFDGRDPREERAMVXLSTLLLCVSLGSLFAVTXLVSCRTPGGGLGLRRLP

SEQ ID NO: 91907 - DNA, 929 bp, Zea mays
  misc_feature: Ceres CLONE 1580432
  misc_feature: Translation starting site: 193
  misc_feature: SWISSPROT Homolog: EC 2.7.11.1 Non-specific serine/threonine protein kinase
  misc_feature (929)..(929): n is a, c, t, g, unknown, or other
atagctggagctccccgcggtggcggcctctctagaactagtggatcccccgggctgcaggaattcgtctcacccctagaaaaagcttctagtactctccgcgcaagcagccccatccatgatagtgctgcctctgagctaaggtgctctcacctacccacccgctcaccctgaccccagtccccgccggcgatggccgcaatgccggcgccggcagcgggcttggccgtcctggtgctcttcgccgccgccctgccggccatttctgccgatgacctcaacaccgacgcacaggcgctgcaggcgctgcgctcggcggtcggccgctccgcgctgccatcgtggaacagcaccacgcccacgtgccagtggcagggcgtcacctgcgagagcggccgcgtcgtcgagctccgcctccccggggccgggctcatgggcaacctcccctcgggcgtgctcggcaacctgtcggcgctccgcacgctgtccctccggtacaaagcgctcacgggggcccattcccgacgacctctcccgcctgtccgagctccgggcgatctacctccagcacaacagcttctccggcgaggtcacagcgtcgctgttcgagctcaagaacctcgtgaggctggacatcgcatggaacaagttcagcggcaagatctcgccggacttcaacaagctgatccgcctcgggacgctgtacatggacgggaacagcttcatcggtgtgatccccaagcctgcagctgccttgcattggaagcaattcaaacgttgtcgtacaaccaggttcaaaggggtcaatccccatacacgcttccggatatatgcccgaaaagactcgttttctaatggcaaaaacagggccttcttgaaggggggtcccacctcgtgccctgttggcccccgggcggaagtcccgcccn

SEQ ID NO: 91908 - DNA, 934 bp, Zea mays
  misc_feature: Ceres CLONE 1580434
  misc_feature: Encodes the peptide sequence at SEQ ID NO. 91909
cttagctgtagctcaccgcggtggcggccgctctagaactagtggatcccccgggctgcaggaattcgtctcacccctagaaaaaataacccatataaccctcgtccacgtcctttgctcgactcgcaaaaacttgcttccttcaacggccgcatcattcttccacgtacgtcccgcccggcacgtcgatcacggcaaaagctagccagcgcacaggacctgcggaggagctcggttttcgatcagggtcaataatcaccacgccgacgctgatgacgccggcgtcccatgcggcaccgccgcgcgcgcggcggtccgtggtggcggagctggagggcgcgctgcttcggagcgcggacatgctcccgtacttcatgctcgtggcgttcgaggcgtccgggctaccactcttcgcgctgctgctggcgctgtgcccgctgctgcggctgctggagctggcgggccgtcgcggcctggcgctgcgcgccgccgcgttcgtggccaccgcgggggtgacacccgccgagctggaggccgtgtcccgcgccgggcttgccaagttcatggccgaagaacttcgacccccgcggccctgggccggccttccgggaactgccaaggggaagcgcggtcgttcgttaacgcgggaatgcccccgcggtcaagggtccaaaccgctttcccccaaaggaaagcaacttgggcgacgcacgccccgtgggacaggcttcttgaactccgaagtacagccgggctcaaggggcctcccacggggggcccccctcaaaagggcggccggcccatgaaaggacgatcgacacagaccgggacccgggcccgcttgtttcggccgggggaacaaaccttggccaggaaccatcggagaatcggcgcgggattcaaaaaaatgggggcccgcccctcttaaccattc

SEQ ID NO: 91909 - protein, 177 aa, Zea mays
  misc_feature: Ceres CLONE 1580434
MTPASHAAPPRARRSVVAELEGALLRSADMLPYFMLVAFEASGLPLFALLLALCPLLRLLELAGRRGLALRAAAFVATAGVTPAELEAVSRAGLAKFMAEELRPPRPWAGLPGTAKGKRGRSLTRECPRGQGSKPLSPKGKQLGRRTPRGTGFLNSEVQPGSRGLPRGAPLKRAAGP

SEQ ID NO: 91910 - DNA, 796 bp, Zea mays
  misc_feature: Ceres CLONE 1580435
  misc_feature: Encodes the peptide sequence at SEQ ID NO. 91911
ggagctccccgcggtggcggccgctctagaactagtggatcccccgggctgcaggaattcgtctcacccctagaaaaaaactgacctcgtccccatcccgcaaccgcaagcaaccaccgatccagcccgttcggcctttcggcgaatggtgacgaaccaggacgcggaggcggcatcggcggcagccccggggccaggggcgacggtgccggagctggaggctgagccggagccgtccgagctcaacaccgtcaacagttcgggactcttctccgtcgtctctacggacaagttgtccgtgaaatacctcggcagccatcaccacggccacgacgtcggtgtcgtgcaggccgaccgccccgctcccacgcgccgggccgtgtactacttcgagatggccgtcaggaacgcgggatacaaggggcagacatccatagggttcacgagcgagagcttcaagatgaggcgacaaccgggttgggagtcaaacagttgtggataccatggtgacgacggccacctttaccggggtctagggaaaggcgaaccgtttgggccaaaattcacatctggtgacataattggcgctggcatcaactacttgtcacaggagttcttcttcacgaaaaatggagctccggttggagccattccaaaagaaattaaaggcccactatatcctacaattgcagttcatagtcaggggtgaagagttgactgtaaactttggaaaggaaccattctgttttgacattgagggttatattcttgaagagaaatgaaagcacaatcggta

SEQ ID NO: 91911 - protein, 187 aa, Zea mays
  misc_feature: Ceres CLONE 1580435
  misc_feature (77)..(188): Pfam Name: SPRY Pfam Description: SPRY domain
  misc_feature: SWISSPROT Homolog: EC 2.7.10.2 Non-specific protein-tyrosine kinase
MVTNQDAEAASAAAPGPGATVPELEAEPEPSELNTVNSSGLFSVVSTDKLSVKYLGSHHHGHDVGVVQADRPAPTRRAVYYFEMAVRNAGYKGQTSIGFTSESFKMRRQPGWESNSCGYHGDDGHLYRGLGKGEPFGPKFTSGDIIGAGINYLSQEFFFTKNGAPVGAIPKEIKGPLYPTIAVHSQG

SEQ ID NO: 91912 - DNA, 843 bp, Zea mays
  misc_feature: Ceres CLONE 1580437
  misc_feature: Encodes the peptide sequence at SEQ ID NO. 91913
  misc_feature (615)..(615): n is a, c, t, g, unknown, or other
gagctccccgcggtggcggccgctctagaactagtggatcccccgggctgcaggaattcgtctcacccctagaaaaaacaaagcaaagcagcttctctctctctgtctctctctctcgcctccctctcgacgacgatctcaggcgctcgcggggagtcgagtcgagaccagcctcgttccttcataaaaagctcacttagttgttgtccccgcatctttttttagctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgccgccgccgcgccccggccgccgctgcaggaggcgggctcccgcccctacatgccatcgctgagctcgggaccccgcaacccgtcggccaagtgctacggcgacaggttcatcccggacaggtcggcgatggacatggacttggcgcactacttgcttactgagcccaggagggacaaggagaacgcgtcgggcatggcggcgtccccgtccaagggagcgtnacgggaggctgctcgcgggagaagctgctacacaaccggaaacgggatcctcgctttccaggaacaagcccccccgaaacccgaaaaacgttttcttttgggggaaccaatttcctccaacctggagggcaagcccggcaaaaaagggttcccacatttcccatttggcgagaagggcccttaacccccccaaactttttgaaaaaaccccccccaactttggttgaa

SEQ ID NO: 91913 - protein, 152 aa, Zea mays
  misc_feature: Ceres CLONE 1580437
  misc_feature (92)..(92): Xaa is any aa, unknown, or other
MDAGSRSISSAKNRAAAAAAAPRPPLQEAGSRPYMPSLSSGPRNPSAKCYGDRFIPDRSAMDMDLAHYLLTEPRRDKENASGMAASPSKGAXREAARGRSCYTTGNGILAFQEQAPPKPEKRFLLGEPISSNLEGKPGKKGFPHFPFGEKGP

SEQ ID NO: 91914 - DNA, 1151 bp, Zea mays
  misc_feature: Ceres CLONE 1580438
  misc_feature: Encodes the peptide sequence at SEQ ID NO. 91915
  misc_feature (48)..(48): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (835)..(835): n is a, c, t, g, unknown, or other
ctctgttcttatcctttattaatattttttttttttctttcccctttntcttcccaaatacgaaaaaannnnnnnccnnnggggagctcaccccggtggcggccgctctagaatagtggatcccccgggctgcaggaattcgtctcacccctagaaaaaacactgacctcgtcgccatgccgcaaccgcaagcaaccacggatccagcccatggggcctttcggggaatggtgacgaaccaggacgcggaggcggcatcggcggcagccccggggccaggggcgacggagccgaaacgggaggctgacccggatccgaccgagctcaacaccgacaacagctcgggactcttctccgtcgtctctacggacaaatagcccgcgaatatacctcggcagacatcaccacggtcacgacttccgtgccatgcaggccgaccgacccgctcccacgcgcctggccgtgtactacgttcgagatggccgtcaaggacacgcagggatacaagggtgcatacatccatacgggtgcacacaccgtatagctctcaagcatgaacgcgcacgaaccgaggtatgtgcgaggtacacaacagccttggcgagaataccccattgcgttgcaccccaacgggctcagcacttattcaccccggtggggtccttacgggggcattagggggctcgaatacccagggggtgtggggcggccccaaaaagagttcttcaacgcaaatccgttggagcctggaaaaccaccttacaagtctttgcggcctgttccctcgtgggccaaatgccaagaagcaatgaagccttttggcctcctaatgagnggggaaagccctaccctttttcttgctgccagccgtgaacgatgaaagttagagcagagccttggcccggaggttttggagaaaagaccacactttcctcctaataaaaggaaaacatttaatgaaagaggcacccccacttgattcatttctcctgaaacaaattgtgggcgcagttttcagttaccgctctaaggtgccggaacagaaacttggaacacgtggtaaaaaccttgtgggccaaaagggaaaaccaatttcctgggtattgaaacattctgcacgcgccttatgtttccaatgcgaagaaaaaaac

SEQ ID NO: 91915 - protein, 83 aa, Zea mays
  misc_feature: Ceres CLONE 1580438
MQADRPAPTRLAVYYVRDGRQGHAGIQGCIHPYGCTHRIALKHERARTEVCARYTTALARIPHCVAPQRAQHLFTPVGSLRGH

SEQ ID NO: 91916 - DNA, 916 bp, Zea mays
  misc_feature: Ceres CLONE 1580440
  misc_feature: Encodes the peptide sequence at SEQ ID NO. 91917
  misc_feature (190)..(190): n is a, c, t, g, unknown, or other
ggagctccccgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggccagggcgatcgcccggctgtnaggatctatatcggcacgacgtactcttgcgtcggcgtgtggcagcgcgaccgcgtcgagatcattgccaacgaccagggtaaccggaccacgcgctcgtacgtcaccttcaccgactccgagcgcctcatcggagatgcggccgagaaccaggtcgccatgaaccccatcaacaccgctctttgatgccaagcgtctcatcgggaggagccccaatgatgcgtctgttccgagtgatatcgagttgttggaccttataggtcatttctgggcctggtgagaagcccatggattgttgctcctcccaaggggtgatggacaaaacggttgcaaattgaagaaatcctcctcttgggttcttttcaaaaatccgtggtgatttgctaaaagctttgcttggcttacccgagaaaaaaaatgttggtggggcaaaagcccccggccctacttttatagacttggcctgaggcgggccccaaaaaggatagctgggggtgatttggctggcctttaaagtgggggtggggctttttcagggaaggcaagtggagtgcaggcttttcccccttagggcgtttttaaaaaaaaaggtctccccctgtccagaaaaaaaaaaagggcccctcctctttactcttggggagagggggacccttgaaggggcccgccccctctccccttttttaaagaaaatatttttttgttggtcgtgaggcacaactttgt

SEQ ID NO: 91917 - protein, 71 aa, Zea mays
  misc_feature: Ceres CLONE 1580440
MAGQGDRPAVRIYIGTTYSCVGVWQRDRVEIIANDQGNRTTRSYVTFTDSERLIGDAAENQVAMNPINTAL

SEQ ID NO: 91918 - DNA, 896 bp, Zea mays
  misc_feature: Ceres CLONE 1580442
  misc_feature: Encodes the peptide sequence at SEQ ID NO. 91919
gagctccccgcggtggcggccgctctagaactagtggatcccccgggctgcaggaattcgtctcacccctagaaaaaatatggtgccgtgcgtttcatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtattcagtttcgccaactacctctgcgaactaaattttactgggggaaagggaagaattccggtttgaaatttattaaaccaggggttccaaaattttcctttccccctttttcccgggggggctttaaaaacccaagggtttattcccggggttccaaaacccccttttttttttaaaaaacccccccggggggcccccgtttttccccccccccccgtggggggggggggacccccccccccccaaaaaaaaaaaagggggaaatggggaaaacacgggggggtgtcccccccctcttcttagggaagggccgcccccccccctccttagaggggaggggggcctcccttctttcctggggggggggggggccacaaaaaacacaatggcg

SEQ ID NO: 91919 - protein, 122 aa, Zea mays
  misc_feature: Ceres CLONE 1580442
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYSVSPTTSAN

SEQ ID NO: 91920 - DNA, 1261 bp, Zea mays
  misc_feature: Ceres CLONE 1580444
  misc_feature: SWISSPROT Homolog: EC 2.7.1.90 Diphosphate--fructose-6-phosphate 1-phosphotransferase
  misc_feature (1071)..(1071): n is a, c, t, g, unknown, or other
tttttgggtctggggggggcttatcttttttcatctgacaagagatagatagtttattacccaacatttttttcccatactggaactccccgcggtggcggccgctctagaactagtggatcccccgggctgcaggaattcgtctcacccctagaaaaaatcacagtgcgggcggcgggcgccactctcactcctaccaggaaaccaatcaaaacttaaaacctatcgaaattagaccggcgacgaggattagcgctcgccggcgatggattctgactacggcgtgcctcgtgagctctcggaggtgcagaagaagcacacgctctaccagccctagctgcccccctgcctacaggacaaccactgacagggtggagtatggtgatgctgcaattgcagctgacccggcatgtgctcatgtgatcagccatgcattcagtcagggctacaagcagcctacccctcatttttctcaggcacccccctcttgtccctggaggctaaggtccaatctcataaccaggggatgccaagcttggacattggtcttctgtggctaaaccattcccccaaaaaaccacacaatggtttttctgagggggcttctattgaagtattaaaataagggccacaccaacccagaaatagacgaagacccaatttgagaaatttcctctggagcgggggatcctaataacgggaaccccggcccgtacgccttgaccaagataaatgcccgtgggggagtgaaggtcctctcctgtattcataagatcgagtgcaatttgtgctcttttcgacccgtatgttatatataaaactgcctgtaagagggaagggaggaaaagcaaatcgagtgaacaatagtaacgcccatggggtattccgcccaaaatacaaacatataggaagtacatgaagataatattccagtggcttcgtgcttactcgccataaaactacgtagagtgatcgaaaatatagggaagcgcggttaagagatggtctatataattcatatgtcacatacgaagccatctccgcgacaagggattcgataaaaatgcactnctctaagatttcttaaaaccaccctgtggtgaaagagggggtatattagcgttggtgagtaaaagcgccgtagtagatgttcgtgcttaaatatttggtgaaccacgaatggaactagttctgtgaagaagacactagtatgtggcggtcccacacacaatgtgcttggggatgtggcgtgtgcatacgg

SEQ ID NO: 91921 - DNA, 752 bp, Zea mays
  misc_feature: Ceres CLONE 1580445
  misc_feature: Encodes the peptide sequence at SEQ ID NO. 91922
tggagctccccgcggtggcggccgctctagaatagtggatcccccgggctgcaggaattcgtctcacccctagaaaaaacacacaggtcgcaggcgcgcgcatccgcaccacggcgccccatccctcccgtcagcgtcgctgccctgcctgcctgcctgcgtccgctcgcaactgcaacgacagggaggcgcacgcgcggggagggagagagacaaaccgagaaaggcacggcacagctgcctgcctcggcacgcgctcgcgccctggtgactggtgaacactgaggactggaggcggtgggcgcggcgggtccagccaccgcgcggttcacggcgcgggcgaatgccggccgtttcaacggcgggcggatcggcctgttcccctggcgctgctggcccccctgggcggtgactgcgaggcccgatcctgaggcgggcggcgactccgagagggcggttggctggttttcttgccaagtgccagtcagtctctctcgtctcggcgacgccgcgcgaaggtcggaactcggaatcctcttcccggcgtcgtcatcccacccccgtcggttcccttctaactcctggctcctggggccgccgccgagccgaggagaggcgcacgcgcctcgggaatggagctggcgcctccgctccgcctacgggatccgagcctgggatggcttcctgcaacttgcgcaggactcaagtgtgatgaactgatggggactcttggactataactggtttcctct

SEQ ID NO: 91922 - protein, 35 aa, Zea mays
  misc_feature: Ceres CLONE 1580445
MELAPPLRLRDPSLGWLPATCAGLKCDELMGTLGL

SEQ ID NO: 91923 - DNA, 972 bp, Zea mays
  misc_feature: Ceres CLONE 1580448
  misc_feature: Encodes the peptide sequence at SEQ ID NO. 91924
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
ttttttcacattcccnnncaagtccacttcgctctgccatacaaattaaaaaataggaaagattttactataatacaaaactggagctccccgcggtggcggccgctctagaatagtggatcccccgggctgcaggaattcgtctcacccctagaaaaaaaaaatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctactcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtccccgacaaggacaatccccgtgcttcgtccgcgcgcgcgggccacatgcttacagggatgctaaaacctcgacaaggtgcctccgggctttctcaacggaacgcccctccggcctcgttcgcaccgctccctgcagaatctctgaagaaacttttgtttccctgaaaagaagtgtataaattgcccaaatgaaaagggagccaaaatggcccccaaggaaacttcgcccgtcaaacaatattcaggattcgtggtgtaacccgtgaaaacttccttacctgaaaagaaaactcccaaagttggaaaacccggct

SEQ ID NO: 91924 - protein, 184 aa, Zea mays
  misc_feature: Ceres CLONE 1580448
MGGEVPEPRRLSRSLSFGCGGVPEEALHLVLGYVDDPRDREAASLVCRRWHRIDALSRKHVTVGFCYAVEPARLLARFRRLESLALKGRPRAAMYGLIPEDFGAYAAPWVAELAAPLDCLKALHLRRMTVPDKDNPRASSARAGHMLTGMLKPRQGASGLSQRNAPPASFAPLPAESLKKLLFP

SEQ ID NO: 91925 - DNA, 804 bp, Zea mays
  misc_feature: Ceres CLONE 1580449
  misc_feature: Encodes the peptide sequence at SEQ ID NO. 91926
  misc_feature (716)..(716): n is a, c, t, g, unknown, or other
  misc_feature (767)..(767): n is a, c, t, g, unknown, or other
ctccccgcggtggcggccgctctagaactagtggatcccccgggctgcaggaattcgtctcacccctagaaaaactagcttgtccctcctgctcccagatctcttccactcggccactccctagcacatcaaaccctagctccgcccagcccccaaccatgtcggcgatgatgcaaccgcagatcatcctgctcaaggagggcacggacacgtcgcaggggcgcgctcaggtggtgagcaatatcaacgcgtgcacggcggtgggcgacaccgtgcggaccacgctggggcctcgggggatggacaagctcatccacgacgacaagggcggagtcaccatctccaacgacggcgccaccatcatgcgcctcctcgacatcgtgcaccccgccgccaagatccttgtcgacatcgccaagtcgcaggactccgaggtcggcgatgggacaactactgtggtgcttctagctgcagaattcttaaaggaagcaaaaccttatatcgaggacggggtgcacccccacagtctaattcgcagttatagaactgcaggcaatatggcaatccaaagggttaaagagctggcagttagcatagaaggaaaaagccttgaagagaagaaatcactgctagccaagtgcgctgctacaacactctcttcaaaactataggtgggtgaaaagaaatcttgcttctatgggtgtggatgctgtccntggcattgggcatgatgacaggcttaaaatctatgggattaaaagggtccntggaggtaccatgagagactcttttttgggtgaaagg

SEQ ID NO: 91926 - protein, 170 aa, Zea mays
  misc_feature: Ceres CLONE 1580449
MSAMMQPQIILLKEGTDTSQGRAQVVSNINACTAVGDTVRTTLGPRGMDKLIHDDKGGVTISNDGATIMRLLDIVHPAAKILVDIAKSQDSEVGDGTTTVVLLAAEFLKEAKPYIEDGVHPHSLIRSYRTAGNMAIQRVKELAVSIEGKSLEEKKSLLAKCAATTLSSKL

SEQ ID NO: 91927 - DNA, 859 bp, Zea mays
  misc_feature: Ceres CLONE 1580453
  misc_feature: Encodes the peptide sequence at SEQ ID NO. 91928
ctccccgcggtggcggccgctctagaactagtggatcccccgggctgcaggaattcgtctcacccctagaaaaattcgctgggcccgtgggagctagatactgccagcttcgccgtgcgcgagctgtgctgctgctcggaggctcgcccactcccagggcgctctctcgttaccccgcctgccgggaatcggcctgtatatatataggtggatcgaggcgatgcgcaaaaccacagcatgcaaacatagcgagcgtgcacaatggcaccacacatgttctaatgctctgcctgctactcctggggagagctgactacctcaagtacaaggacccgaatgcaacactcgtcgctgttctcgatcaagacctagctgggtcagatgactctctctgaagagatcagcaacatgacccacatcgagagggaaaacgccacagacgacgcgctggacaaatactacgtatgcatcgtgctcaacggagaacgcatcgtgcctgatcctcagaagtctgctcaggcttgagcccccatggtgaccaacatgcagaagggcgctctttctacgaatccgggtataccgatcatcatcagtgtcgatggaggactgggcacaacaacgtctacatggctactatctacactgacgaacactggcgttggagctacgatggatcctgacatcgttaagaccattagaagaaacaactggctcgttgaagtcatagctaacagcaattgctttacgccttttgctgccctgtaataacagacctgtaaaagatcccaggatggcgggacactatcctttgtacacctagggctgtagggaatcacaatggtttgaccaattccactga

SEQ ID NO: 91928 - protein, 47 aa, Zea mays
  misc_feature: Ceres CLONE 1580453
MTLSEEISNMTHIERENATDDALDKYYVCIVLNGERIVPDPQKSAQA

SEQ ID NO: 91929 - DNA, 876 bp, Zea mays
  misc_feature: Ceres CLONE 1580454
  misc_feature: Encodes the peptide sequence at SEQ ID NO. 91930
  misc_feature (876)..(876): n is a, c, t, g, unknown, or other
aaagctggagctccccgcggtggcggccgctctagaactagtggatcccccgggctgcaggaattcgtctcacccctagaaaaaactccgatacgcggggatgcataggcgtcggcaggaggagctcatgtcgaacaccaatagcgttagccgttagccaccaccagtaggcagtagccacagcagtcatggggtcggtgccgccggcagagggggacaggcgccagccccagcagcagccgcacgtgatgatgatcccgtacccggcgcagggccatgtcacgccgatgctgcagctggccaagctactccacacacgcggattccacgtcaccttcgtcaacaacgagttcaaccaccgtcgccacctgcgcgcgcgggggccgggcgcgctccacagcgccccggggttccgcttcaccgccattgacgacagccttccgccctccgacgccgacgccacccaggacgtccccaagctctgctactccaccatgaacaccgtgcctacccggttcagggaactaattgtcaggaacaatgccgaggcacgaggccgagggacgccccgccgtgacgtgcgtcgtcgccgacagcatcatgagcttcggccctcgcgacgcgcggggagctcggtctccgctgcgccacgtttctgggaccgccagcggcctgcgggcttcatttgggctactactacaaccggccccctcgttcgcaacgggggtattcgtcccgccttaagaaatggaagcgtaacctcacccgacaggggtactttggaaaacccgtcgttcaaactggaattcccttgcggccccccaaagggaacgtggcaaccttcccgggaaattttccccagagcctttgtgtcgn

SEQ ID NO: 91930 - protein, 229 aa, Zea mays
  misc_feature: Ceres CLONE 1580454
  misc_feature: SWISSPROT Homolog: EC 2.4.1.121 Indole-3-acetate beta-glucosyltransferase
MGSVPPAEGDRRQPQQQPHVMMIPYPAQGHVTPMLQLAKLLHTRGFHVTFVNNEFNHRRHLRARGPGALHSAPGFRFTAIDDSLPPSDADATQDVPKLCYSTMNTVPTRFRELIVRNNAEARGRGTPRRDVRRRRQHHELRPSRRAGSSVSAAPRFWDRQRPAGFIWATTTTGPLVRNGGIRPALRNGSVTSPDRGTLENPSFKLEFPCGPPKGTWQPSREIFPRAFVS

SEQ ID NO: 91931 - DNA, 860 bp, Zea mays
  misc_feature: Ceres CLONE 1580456
  misc_feature: Encodes the peptide sequence at SEQ ID NO. 91932
ctccccgcggtggcggccgctctagaactagtggatcccccgggctgcaggaattcgtctcacccctagaaaagtcaggctgcgcatccctcctcttcccgtacggtctccgtccccacgcctccacaggccgcgtcgttcccgccggcatctcattcgctcgtctccgccggtcgacgttacgccgcgtcgccacaaaccccccggccgcccctatcgctaccacctatcctctcctgaagccacccggacgccggacacaatggatttttcaaccgcatctacctcctctccccatggcgccgcctgctgactcgacccctgatctaaggcccatagccagcgtgcccgtgcccatcaccgtgccgagcccgcgggaccacactcaccaccaccaccacctagtcgatcgtcgggacacgccgcggggccgcgcgtgggagccagagcggaaccggcgcggagaggcgatggacggtgctgcagtggtcaagctgatgtccggcgaggccgggtatgtcttagaagacgtaccgcaggtgtcagactatctccccgatctcccgaactacccaaatgcattagcagataaaccggcatactccgttgtgaagcagtactttgtaaacccagacgacactgtctgccagaagattgttgttcacaaggatggccccagagggaaacacttccgtcaggtcgggacctcgccaaagggtatatttttgaaccggatgaggtcccatgcttgtattgtcacttgttggaggatggtgcccgggaacataaaaccgggaattaggaaaaattgatgtgggatttatctgacagttatgggggtcacccagaatacttgggga

SEQ ID NO: 91932 - protein, 171 aa, Zea mays
  misc_feature: Ceres CLONE 1580456
MAPPADSTPDLRPIASVPVPITVPSPRDHTHHHHHLVDRRDTPRGRAWEPERNRRGEAMDGAAVVKLMSGEAGYVLEDVPQVSDYLPDLPNYPNALADKPAYSVVKQYFVNPDDTVCQKIVVHKDGPRGKHFRQVGTSPKGIFLNRMRSHACIVTCWRMVPGNIKPGIRKN

SEQ ID NO: 91933 - DNA, 1240 bp, Zea mays
  misc_feature: Ceres CLONE 1580457
  misc_feature: Encodes the peptide sequence at SEQ ID NO. 91934
  misc_feature (1)..(1): n is a, c, t, g, unknown, or other
naatgttgtttgggtgaaaaaaaagacggaaaaataaaaaaaaaaacaaaatataaaattattcacaaaatggggctcccgacgaggcggccttctagaacagtggatcccgggcttttgaatcgtctcaccccagaaaaacaccaaaaccgcgaaccggcactttcccagtcccctctagacgccgactaccgctcgcgctctcctcgcgttcaggaggtcgcttcgccatggcctccgagacggagacgttcgccttccaggcggagatcaaccagctgctctcgctcatcatcaacaccttctactccaacaaggagatcttcctcaaggagctcatctccaactcctccgatgccttgaacaagatcagggttgagagtttgacggacaagaacaagctggatgcacagccagagctgttcatccacattgtccccaacaaggccaacaccaccctgacaatcatcgacagcggcattggtatgaccaagtcagacccttgtggaacaaaccttgagtaccattgacgcggggccgggcagcgatagggaattcattggaagggcaacttgactggctgtgtagcctggattggggtcccactggaattggggccaagcttttggaagggtccggttctttccctaacctccttgggccctaaacccgtgggggtttgggcagataaagaaggcggggtataggttcccgtggaggtacaccgcactcttacagcgccccaccccaaatggggagaacgcggaaatcgggaagagcctaaatgggaaaacccccctgtgcgagagggaggaggaagagtcacccctttctaaaagaggtccactgtgagggagagggggcccttcccccctttttccccccctgggggtaccccggccataccggggtggtgaattataccccctttctccgtgggggaggaaaaaccaaaacacccttgggggctttacagggggaggggttaaccaaaatcgtagagtgggaaaacaccagttgcgtaaccccttcccaatgtggggatatggaatctcaagtgtgtgggagaaaaataagacccactggagaaagagataaaacggacacagcccgcttagaagagggggaattcccgggatctccacaagaaaagcaccccactcgcccacaggttttctattcacacgcgttatctcgaatatcccccctataacaccgagggagaatagagaaaataaaa

SEQ ID NO: 91934 - protein, 99 aa, Zea mays
  misc_feature: Ceres CLONE 1580457
MASETETFAFQAEINQLLSLIINTFYSNKEIFLKELISNSSDALNKIRVESLTDKNKLDAQPELFIHIVPNKANTTLTIIDSGIGMTKSDPCGTNLEYH

SEQ ID NO: 91935 - DNA, 960 bp, Zea mays
  misc_feature: Ceres CLONE 1580458
  misc_feature: Encodes the peptide sequence at SEQ ID NO. 91936
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (79)..(79): n is a, c, t, g, unknown, or other
  misc_feature (117)..(117): n is a, c, t, g, unknown, or other
ggggtgggggggtttttttttttagccagaagctgagggaaattataattatgacgtgtgggtttnnnttccaaaatantcaaagctggagctccccgcggtggcggccgtctctgnactagtggatcccccgggctgtcttgaattcgtctcacccctagaaaaaaaattccccccggaccaaactagatcagcgaaacccactccgctctcccgagatcggacacatggcggcggcagcagagacgtccaacggcggcgcagtggccgcgaacgggccggcgcccggcaggctggcctccgtgtacagcgaggtgcagacgagccggctcctgcacacgctgcccctcccctccgtcctccgctccaacttctcggtcgtcgacggccccgccagctccgccgcgggtaaccccgatgagatcgccaagctcttccccaacctgttcggccagccctcggcgtcgctggtgccttcggccaaccccgcggcgaccaggccgctaaaggtcagtgtcgtgctctctggtggacaggcgcccggcgggcacaatgtcatctgcggcatctttgattaccttcaggagcgtgcaaaaggtagcaccttgcttggattcaagggaggccctgctgggatcatgaagtgcaaatatgtggaactcacttcagactttgtgtatccctacagaaaccagggcgggattcaatatgatctgcactggaagggacaaaattgaaacaccggagcagttcaagcaagctgaagacacagccaacaaagctggatcttggatggaccttgttgtccttggggggggaagatttcaaaaaaccaatggccggccctccttggggggaaaacctttaaggcccaggggaaccctgaaagacaccgaagttaattaggttgcccccaaagaacctttccattggggaactccggaaaattgttaagggaaa

SEQ ID NO: 91936 - protein, 169 aa, Zea mays
  misc_feature: Ceres CLONE 1580458
  misc_feature: SWISSPROT Homolog: EC 2.7.1.90 Diphosphate--fructose-6-phosphate 1-phosphotransferase
MAAAAETSNGGAVAANGPAPGRLASVYSEVQTSRLLHTLPLPSVLRSNFSVVDGPASSAAGNPDEIAKLFPNLFGQPSASLVPSANPAATRPLKVSVVLSGGQAPGGHNVICGIFDYLQERAKGSTLLGFKGGPAGIMKCKYVELTSDFVYPYRNQGGIQYDLHWKGQN

SEQ ID NO: 91937 - DNA, 1251 bp, Zea mays
  misc_feature: Ceres CLONE 1580461
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (722)..(722): n is a, c, t, g, unknown, or other
  misc_feature (920)..(920): n is a, c, t, g, unknown, or other
  misc_feature (951)..(951): n is a, c, t, g, unknown, or other
  misc_feature (960)..(960): n is a, c, t, g, unknown, or other
  misc_feature (961)..(961): n is a, c, t, g, unknown, or other
  misc_feature (997)..(997): n is a, c, t, g, unknown, or other
  misc_feature (1004)..(1004): n is a, c, t, g, unknown, or other
  misc_feature (1056)..(1056): n is a, c, t, g, unknown, or other
  misc_feature (1065)..(1065): n is a, c, t, g, unknown, or other
  misc_feature (1082)..(1082): n is a, c, t, g, unknown, or other
  misc_feature (1084)..(1084): n is a, c, t, g, unknown, or other
  misc_feature (1091)..(1091): n is a, c, t, g, unknown, or other
  misc_feature (1092)..(1092): n is a, c, t, g, unknown, or other
  misc_feature (1124)..(1124): n is a, c, t, g, unknown, or other
  misc_feature (1125)..(1125): n is a, c, t, g, unknown, or other
  misc_feature (1159)..(1159): n is a, c, t, g, unknown, or other
  misc_feature (1161)..(1161): n is a, c, t, g, unknown, or other
  misc_feature (1197)..(1197): n is a, c, t, g, unknown, or other
  misc_feature (1225)..(1225): n is a, c, t, g, unknown, or other
  misc_feature (1226)..(1226): n is a, c, t, g, unknown, or other
  misc_feature (1228)..(1228): n is a, c, t, g, unknown, or other
nnnnnnnnnnnnnnnnnnccacgcggggcggggaggccggagaccgaagggaggcccgtgaaataggggggtgtanntntcaaagctggagctccccgcggtggcggcctctctagaactagtggatcccccgggctgtttgaattcgtctcacccctagaaaaatcccatcgttccactctctctgcccttcctacgcctcgccccagacgcatcataccgctctcctctccctccctgcccccctcgcaaccctgaagaagctcccacacgcaaggccgcaaacgcgccgcgcaccgcaaggtcccagggagcaactcgaggcggcctcattgtaccatggctgctatggccaccgctggcggcgtcgggctccacctcattggggctgccacggccaccctcatcgtggcggtccttggtgcggccttgcctggggcgccgacgccgggcccggaccccggcccaggaaccccccgacgaagggaaacccgcgccggaggcagactgcacgggtcggtgaccggcgcgggctcccgcacatcggggacggaaacgtcaatcaatcatcaagcggcccggaagcggggggggaattgtggcgcctaggggggtacaaacgccttccggaaaaggacatggagccggccgaaagaaaccaatggtacaattccggagaaagcgggaatcctggaaacaccataacacccttgaaactaggnaatatttggtcatggggaccgaaaaggacaaggtatgtgggcatatagcgccgtgggggagaggggggtgtaaagcgctcgtgttggggagaaaagggttgagaaaacctcgggagaagcgacttttggcgggagagcccccctccccgcagagggagataacatagggcgggtgtgtgcgcgcgacagagaatacantttttgggatatatgcacaaaccccaaaaanccattgggnnttgagccttttgtgcaggcaggtatacccccacccncattttncgtcgttcccactccctagaagtgtggggaataagatataacaaccatgggntgaaaaagnccgtagagacctgacantncaacacnngtttagagaataagaatagactctctcgcgcnnttcctctcccgaatgtgtggtgtatcatagaggntncgggggaatgacttttatacacaatatatggggacnaagagtgttgtacaaactacaacagggnngnggggcatgactaaataacaaccg

SEQ ID NO: 91938 - DNA, 896 bp, Zea mays
  misc_feature: Ceres CLONE 1580462
ctggagctccccgcggtggcggccgctctagaactagtggatcccccgggctgcaggaattcgtctcacccctagaaaaaaaaaggagtacacacttctccttagaattggagctgtacgagccacccagcaactttcttcatcatcttcttcagccctcgctctgtccgtcgacacagcagctttgcttgccaccaagctagccatgcaggaggagtaagagtacaaccgtaggagagagagagagagagagagagagagagagagagagagagagagagagagagagagagagctaacaccaccccgattccacccaccactgtccctagctagcttatttacaggcgttcgtgatcgccaacagcttctcgtcagaaagagtgcaacgggccggccgggcagaagaggtagctgggagctagagagaaaaaaaaaggtgcaccgagcaacccaggccagggaaggaagggaggagtgagccgtcagtcgaccgtttccggcgaactcacagcaggcagatggcaggcggcggattcgtggaagacatgaacatgatgagggagcagagcctcctcgaggcgacgtgcggccgacctcttccaacacatcgaacgacctcctcgacttcccaaagaggactccgccgcccccgtgttcctcctggaccccccggccccggggaccccctgttcgggcgacaataacaaattggccgcgccggaaaggcctccccccccctggtgccccgggaaagaaaagcttccctatggccctttttcccccccgggggaacaatttttcaacacaaggaattttgggggaaaattggtttgggggaaattttattggacggggcccgtggggggtttgggggtttttaaaaacccctcccc

SEQ ID NO: 91939 - DNA, 928 bp, Zea mays
  misc_feature: Ceres CLONE 1580464
  misc_feature: Encodes the peptide sequence at SEQ ID NO. 91940
gcggtggcggccgctctagaactagtggatcccccgggctgcaggaattcgtctcacccctagaaaaagaggagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgttgatgaaggagagggcaaaggtcaaggagcaacaggtgaggcagatcatacaggaaacaatggcctcctccaacctgcttcgcaagttggagcttgtggacacgctgcagcccctcggggtggactaccgctacaacgaggagatcgaccagttgcttcgctctgtatacgacgacgacgacagggacggaggcggctccgacgatctctacctcacctcgctgcggttgtacttgctcaggaagcatgggtatacaacctcttcagatgtgttcgagaaattcaggtacgagtgcgggagcgtctcgagcgacgatgccggctgcttgctcatgctgtatgacgctgctcataccaaaactcacggggaggagattcttgacgacttcatctcttggagcagaagcccccgccatccctgccgggaggagaaaaccttggagccagagccttgccgaagaaggggaggggcgcttttggaaaaagcctctgtttcaggccgggtgaagccaagtggaaggccaggcccttcaatctttccgggtccaaaaaaaaagggccgggccaaaaatgggaacaatacctgagaaatctccccgaacctgggagaaaaaactattctcgcgagaggctatttttctgtggtg

SEQ ID NO: 91940 - protein, 194 aa, Zea mays
  misc_feature: Ceres CLONE 1580464
  misc_feature (1)..(171): Pfam Name: Terpene_synth Pfam Description: Terpene synthase, N-terminal domain
  misc_feature: SWISSPROT Homolog: EC 4.2.3.13 (+)-delta-cadinene synthase
MKERAKVKEQQVRQIIQETMASSNLLRKLELVDTLQPLGVDYRYNEEIDQLLRSVYDDDDRDGGGSDDLYLTSLRLYLLRKHGYTTSSDVFEKFRYECGSVSSDDAGCLLMLYDAAHTKTHGEEILDDFISWSRSPRHPCREEKTLEPEPCRRRGGALLEKASVSGRVKPSGRPGPSIFPGPKKKGRAKNGNNT

SEQ ID NO: 91941 - DNA, 895 bp, Zea mays
  misc_feature: Ceres CLONE 1580470
  misc_feature: Encodes the peptide sequence at SEQ ID NO. 91942
  misc_feature (739)..(739): n is a, c, t, g, unknown, or other
  misc_feature (749)..(749): n is a, c, t, g, unknown, or other
  misc_feature (806)..(806): n is a, c, t, g, unknown, or other
  misc_feature (807)..(807): n is a, c, t, g, unknown, or other
  misc_feature (895)..(895): n is a, c, t, g, unknown, or other
ctccccgcggtggcggccgctctagaactagtggatcccccgggctgcaggaattcgtctcacccctagaaaaagtctcacccctccggacgaaatctgacccgggccacactccgctgctccgccatggcgatccgctccaaggcctggatctcgctgttgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtggtggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatcttcagggaccaggggaagaacattcaggaatacaagggccctagggaggctgatggcattgtcgattacttgaagaagcaggttggccctgcgtccaaggagatcaagtcaccggaagatgcggtggcccttatcgatgacaagaagatctacattgttggtatcttcgcagaattcagcggcactgaattcacaaacttcatggaggtcgcagaaaagctgaggtctgactacgactttggccacactttgcatgccaacaccntcccacgtgntgatgcagcgggtggaaggccattggtcaggctgctgaagccatttgatgagcttgnntgtgacagcaaggattttgatgtcgctgcactgatgaagtttattgatgctagcaccatccctaagagtgtcactttttgaccagacn

SEQ ID NO: 91942 - protein, 253 aa, Zea mays
  misc_feature: Ceres CLONE 1580470
  misc_feature (35)..(143): Pfam Name: Thioredoxin Pfam Description: Thioredoxin
  misc_feature: SWISSPROT Homolog: EC 5.3.4.1 Protein disulfide-isomerase
  misc_feature (205)..(205): Xaa is any aa, unknown, or other
  misc_feature (208)..(208): Xaa is any aa, unknown, or other
  misc_feature (227)..(227): Xaa is any aa, unknown, or other
MAIRSKAWISLLLALAVALSARAEEEPAAAAEGEAVLTLDVDSFDEAVAKHPFMVVEFYAPWWWHCKKLAPEYENAAKALSKHDPPIVLAKVDANEEKNRPLATKYEIQGFPTIKIFRDQGKNIQEYKGPREADGIVDYLKKQVGPASKEIKSPEDAVALIDDKKIYIVGIFAEFSGTEFTNFMEVAEKLRSDYDFGHTLHANTXPRXDAAGGRPLVRLLKPFDELXCDSKDFDVAALMKFIDASTIPKSVTF

SEQ ID NO: 91943 - DNA, 1176 bp, Zea mays
  misc_feature: Ceres CLONE 1580473
  misc_feature: Encodes the peptide sequence at SEQ ID NO. 91944
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (41)..(41): n is a, c, t, g, unknown, or other
ncccggcccnncccgcgcgcggcggtgggaagggggggggnggtggttggggggggcgcgcggtcgaataaccccacgcttggactccacgcggtggcggcctctctagaacagtggatcccccgggctgtttgtattcgtctcacccctagaaaaagtgtcactcagtccctcgctcccggcctccctcgggtcgaccacacctcaccgccgcgtacctcgctccagtccagtcctacctggacggcctgccaacacaaccaagagggcatttctcagttctcaccatcgtcccatggcgtcgacggagatggagatgggcgtcgtaggcggcggcgtcaatagcagtggaggaggcagctgcggcgggctggtggtgacggagctgagcctcatcaaggagctggtgaggcagctggaggtgcacctcggcgggtcccccggacctgtgcaagcacctggcctcgcagatcttctcccctcaccgagcgctccatcgggcctaatcaccctcctcccaaactcgaacaggcgccccggcgggccggaaagcctaccccgcgagggcgaacccacggggccttcgaccctcgacccgggttctccgggcggaaaacccccaaccaggcgggaacggtccacccggaaagggggcccctgtttccccaggaaccccaccccaagggaaaaaaaaagaaaaggggtggaaaacctttgccgcgcacacccgaaaaaaacaccctttggcactttgagccttcatggcgcttcgaggggttccacacaggggggaaaaatttaaaaaagaacagcgggccggttaggtaaggcgattataaactccggggtgcccggaaaaaaacacagtaaaaaacaacaggccaaaccacaaaatttttaggggcaggtgaaactcccctcttcctgcgttaaaagacctggaaaacccaccctgtcccccgatttgtctgttagcgggggagctccccctctcccccacgaggaaagaggggagatgagaaacacaacccgggaagggccacaaaggggttggaaaccctcttccccgcgtggggggagaaaaaccccggtccgaagggaacgggcccaatctcccgggggaaaagtaccccccactaaaggggatatcctcaggaaacaaagggcccccagggg

SEQ ID NO: 91944 - protein, 168 aa, Zea mays
  misc_feature: Ceres CLONE 1580473
MASTEMEMGVVGGGVNSSGGGSCGGLVVTELSLIKELVRQLEVHLGGSPGPVQAPGLADLLPSPSAPSGLITLLPNSNRRPGGPESLPREGEPTGPSTLDPGSPGGKPPTRRERSTRKGGPCFPRNPTPREKKRKGVENLCRAHPKKTPFGTLSLHGASRGSTQGGKI

SEQ ID NO: 91945 - DNA, 909 bp, Zea mays
  misc_feature: Ceres CLONE 1580475
  misc_feature: Translation starting site: 141
  misc_feature: SWISSPROT Homolog: EC 1.4.1.2 Glutamate dehydrogenase
cggccgctctagaactagtggatcccccgggctgcaggaattcgtctcacccctagaaaaagaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccaccaaggatgctggggtgaatgctggccttaatgtgctgcgtatcatcaacgaggcaacagctgcagctattcgcctatggccttgacaaaaaggctacccatgtcggggagaaaaaaggtcctcatctttgaaccttgaaggggggacctttggagtctcccctcccccccaatggaggaagggaatctttgaagggcaagggccaccgctggtggaacaccctttcttggggggtgaaggaactcttgacacaacgggatgggtccaaccactcttcctcccgg

SEQ ID NO: 91946 - DNA, 940 bp, Zea mays
  misc_feature: Ceres CLONE 1580477
  misc_feature: Translation starting site: 223
  misc_feature (935)..(935): n is a, c, t, g, unknown, or other
  misc_feature (940)..(940): n is a, c, t, g, unknown, or other
ctggagctcaccgcggtggcggccgctctagaactagtggatcccccgggctgcaggaattcgtctcacccctagaaaaagcgcatccgcatcactgcgtgtcctcctcctctccccctcactgcggcgcatccacatctgccaatttctccacctcctcctcctcgcccctgtgcctcgacatctcgcatccgctccatctatggaaggccaccacgcgccatggatcgccgctctctaccgccacctcaattgaaggttcaccgctctctacgcggatccgccacctcctcctcggccgccgtcaatagaagaattccagagatgcaattcccgaggccatggagcagcagacaatatcaattgccaaagcagccattacaatagtactcattttagggacttcatttcttgcagctgccaatccaattacaggacgctacgacgctcttaagtgatcatgaacttatacattgaaataatggtgggcctcgagaggccaggaggtggagaggagttcaacaagtactacatcttgtctgctctcctatccgtggattggtgagttagtttggaagttttgcactgggtatgttatccatccaacccaaaacaattgcagtttcctttaagtcatgtccttgtttaaattcccctataaatttccgtactgcaagttcattaatatgtaaccaatatgggacccctgaaaatggaggcaagcgttcccttcttcaaatccgtgtttgcctccttcatttccctttaacagtatagggcatgttccagaatccattatccacctaaaatttagcaagctaaaaattagttaccaggtggggtccttaaacgggaccctgcccaatttattttggttggaaggaacctggacaaagcctgcctatttagtgttccatttaagcgacacattgggnaattn

SEQ ID NO: 91947 - DNA, 928 bp, Zea mays
  misc_feature: Ceres CLONE 1580478
  misc_feature: Encodes the peptide sequence at SEQ ID NO. 91948
ctggagctccccgcggtggcggccgctctagaactagtggatcccccgggctgcaggaattcgtctcacccctagaaaaacactactgcgagagattctcacccaccaatagatcacaccgacgactgagctacttcatacggcggacaccattgtatgcatactcgtacgataatcccgtggaggaaggcatcctcgagatgcatgaccctccctcgttcatctcacctcctccttcttccccacctggtccgttaatacagatcacgacctatcggggcctcctcttttgggggtggatctgaccgtccacttcctcacctccattttaattgctctgcgctcaggcctgctacctcctcgtctgagatttcctgaccgaacgtccacagattctaccccatcttcgctaggatgtctggtcgcccacccgcgacttctaaatgcgtggaacctcttctcttctgatctgggccgatgaccttctctggttatctcagaggccgaggcctcgtcttcctgctcaaccgatgcctctcatgctacgatctcatatgcttgcgcttcttgcatagtcgaacgactggtcgatgggcctgtccataatattacctcatggctgctctgccattcagctcctgaatggaaacctgctactctacatgccgttactgtgatgctagagctggaactcgtgctcctgttctcaggcaaaaagtattagaatgcttatgtactcctcttcctctttccatgccaactagcgtacatgcgaagatatattcgtttctgtccgttgctagaaaaaaattttcgcacccaaaattctccctgcagagtatggataccacgttacaatccttgatgcactacttgacatcttgaagccatccgtgctcctcttgtaaaagaagcaattggtctctgc

SEQ ID NO: 91948 - protein, 80 aa, Zea mays
  misc_feature: Ceres CLONE 1580478
METCYSTCRYCDARAGTRAPVLRQKVLECLCTPLPLSMPTSVHAKIYSFLSVARKKFSHPKFSLQSMDTTLQSLMHYLTS

SEQ ID NO: 91949 - DNA, 928 bp, Zea mays
  misc_feature: Ceres CLONE 1580481
  misc_feature: Translation starting site: 160
  misc_feature: SWISSPROT Homolog: EC 1.6.2.4 NADPH--hemoprotein reductase
  misc_feature (807)..(807): n is a, c, t, g, unknown, or other
  misc_feature (848)..(848): n is a, c, t, g, unknown, or other
gcggtggcggccgctctagaactagtggatcccccgggctgcaggaattcgtctcacccctagaaaaagcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccactcgccgcgctggcggccaccgccgcggccctcgtcgcggggctgcttattatcgctgtctggttccgatccggaggcgggacgccgtccaagccggtcgccacgccggtacggccaccgccggtcaaggtggacgccgacgccgacgttgatgacggccggaagcgcgtcaccatcttcttcggcacacagactggcaccgccgaggggttcgcaaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatggggatggggagccaactgataatgcagcacgattctacaaatggtttactgagggaaaagagaaggaagtttggttgaaggatcttaaatatggtatttttggcctttggaacaggcaatacgaacattttaaataggttgcaaaggtggtagatgagctagtagaagagcagggtggggaaacgtcttgttcctgttggcctggnagacgatgatcagtgcattgaggatgatttcactgcatggnaaagactagtgtgggcagaattatgatcattgctccgcgacgagaatgacacactggtgcatcgactcatatactgctgc

SEQ ID NO: 91950 - DNA, 816 bp, Zea mays
  misc_feature: Ceres CLONE 1580484
  misc_feature: Translation starting site: 276
  misc_feature: SWISSPROT Homolog: EC 2.7.11.1 Non-specific serine/threonine protein kinase
ctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcacaaacctccgcgtgctctcgctccgctccaaccgcgtcctcgggaccgtccccgacgacgtgctccagcttgccagcctcaaggcgctgtttctgcaacagaaactgctctccggccccatcccgacgggaatcagaagctcggcggcctcgagcgcctcgtgctctcccacaacaacctctcgggcttcatccccttcgcgctcaaacagctcaccgcgctgcgagtgctcaagctcgacggcaaccacctcttcgg

SEQ ID NO: 91951 - DNA, 892 bp, Zea mays
  misc_feature: Ceres CLONE 1580485
  misc_feature: Encodes the peptide sequence at SEQ ID NO. 91952
  misc_feature (884)..(884): n is a, c, t, g, unknown, or other
ctccccgcggtggcggccgctctagaactagtggatcccccgggctgcaggaattcgtctcacccctagaaaaactgtctgtatgcagcaccacggcgcccgtggggaccaccacggcgccgccggcattgtcaccaaccaccacccccacctccgccctcccaccgggactcccctcgcctgctccacgacgcttatgctctcgcgccccgctctcgccgcccacctcctgcgcctgctcctcctctctccctccgcccacctcatcatcatccgccgcgccatggcatccgccgccgcatcgcaggcgcagcctggtggcgcccctccggcgaccgcggagtacgatgaggtgctggagcggctatcctctctcatcacgcacaaggtgcacgctaacagcgccaaccgcggcaaccagtgggacctcatggagcaatacgtcaagattctggagctggaggagtcgatcgcgcggatgaaagtgattcacgtagcggggaacaaagggaaaggttccacatgcacattcaccgagtaaatcctgcgatcgtgtggcttccatactgagctgttcacctcaccacatttgaaggatgtcagagagcgatctcagctacatggggttaatatttctgaagacaaattttcgaaacacttctggtgatgctggaacaagctgaatgagaagactgatgatgatattcccatgccagccgatttccagttcctagcgttgctcgcattcaagatatgttctgctgagcaagtacatgccgctagtctcgcagctggcctatgcagcagtgtgatgcaactaatgcggcaaaatgcactgtatgttgtaggcagtcatccctcgcatatgatcataggagaaatcntgcgaatt

SEQ ID NO: 91952 - protein, 114 aa, Zea mays
  misc_feature: Ceres CLONE 1580485
  misc_feature: SWISSPROT Homolog: EC 6.3.2.17 Tetrahydrofolate synthase
MLSRPALAAHLLRLLLLSPSAHLIIIRRAMASAAASQAQPGGAPPATAEYDEVLERLSSLITHKVHANSANRGNQWDLMEQYVKILELEESIARMKVIHVAGNKGKGSTCTFTE

SEQ ID NO: 91953 - DNA, 1013 bp, Zea mays
  misc_feature: Ceres CLONE 1580486
  misc_feature: Translation starting site: 211
  misc_feature: Pfam Name: eIF-4B Pfam Description: Plant specific eukaryotic initiation factor 4B
ggagctccccgcggtggcggccgctctagaactagtggatcccccgggctgcaggaattcgtctcacccctagaaaaaacagcaccgcgcccgccttttcaccccgctcgatcgatcggcacccgcgcatcgcgtcggcattctctccagccgctactccctccctgcctctccacgatctcgcgaaccctgctagatccttgactcgccatgtccaacccctggggcggcatcgttggtgccggcgtgtgggcgctggacgccgagcgcgctgaggaggaggagcgcgacgcagccgcggctcccgtccccgcccccgcccccgccgcgggcttccccagcctccgcgaggccgcagcgggcgccgccggcaagtccaagaagaagaacaaaggaacaacgctctcgctctcggagttcgccgggttcggcccgggggcggcggctagcgccggcgcccgcggagcccaggggccctcaccacgcggagatgatgatgctgcctacggctccggagaccgtggcggcggttcgacgacgacggcagggggctcggatctcgaaatgccctcccgggcccaacaggaaccgcaactggtccatgaacaaaaggtcgttacagcccctctcccgccaaatcccggttccgggaacccggtaggggggcccccgggatgggggggccccggtttcctggggccggcgctaaaaaaaatggaataggtggccggcggagaaaaaaccctttccttaggggcccttggcgtaccaaaaactcggttcccggggggggggtttccaaaaaaccccccttttaaaaaaactcccaaaaagttggtcccgcgccgccccaatatttagggggggagggccccccctggggtgtttcccccacaaaaggaccgccggccccccccccctccggtgggggggagacccccgccccccctcttttttccacccccccccggaagagggcgccaaaagagggggggagaaaaaaaaacaaaatt

SEQ ID NO: 91954 - DNA, 1197 bp, Zea mays
  misc_feature: Ceres CLONE 1580488
  misc_feature: Encodes the peptide sequence at SEQ ID NO. 91955
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (34)..(34): n is a, c, t, g, unknown, or other
  misc_feature (55)..(55): n is a, c, t, g, unknown, or other
  misc_feature (65)..(65): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (1140)..(1140): n is a, c, t, g, unknown, or other
tttttttccccncccnnnccgtctcccgtcctcnacccccccgtccccccacctnatgagttggngggagaannnnnaaaaaactgggactccccgcggtggcggccgcgacggcggaggccatggccggcgggtggctgcggtcgggcgacctggcggtgcggcacgccggcgacggctacgtgcggatcctggaccggtccaaggacatcatcatctccggcggggagaacatcagcaccatcgaggtggaggcggcgctgttcgcgcacccggccgtggcggaggccgcagtggtggggcggcccgacgagtactggggcgagacgccgtgcgcattcgtgacgctcagggagggcgcggccggcagcgtgcgcgccgaggaggtggtggcgttttggcaggcgcgcctgccgcggtacatggcgccccggacggtggtgttcgtggcccaactgcccaagacagccacccgggaatgggccacaaatttcctgctccgcggagcaggaccagggccccatggggaagcattttccacctccccaagcagcagggatgggggccgtggaacctaaggaggcaagactctgaatccccgaaaatccccatcgcccccccaggggatggtcgtcccccctgtttcccccctggagcgaatagattttggaaggccacccaggccggaaaaaccttgatcttgtggtctggaacaccttcccggacctggcgatgacagcgtcgtcctcttgcccacacccttggttgttgccacgcagacatagaagtaatattgatttcctcaccgacatctcgagcggtggaaatgaacaagcggataggactgtgtctacgtggcgtgtattcgcatagtacttacacaattatgttcgtactgaactcatctactcatcacacgtatcaaagaggtgaggcgtcgccctagaaatttgataaaacacacatcgggggccgtgccgacacgctctccacactctacccaaactacaagtcttaaattggcggtaacctttctttgctcagcggtcatcgccgcacgaaatggcgttcacccctcttttaactacggtagatgacacctcacttgtgtaggattatgcgagctgctgatatttatgncgcgatcattcatattattcatctaccacacgacaagtcagtgataccacgagagca

SEQ ID NO: 91955 - protein, 151 aa, Zea mays
  misc_feature: Ceres CLONE 1580488
  misc_feature: SWISSPROT Homolog: EC 6.2.1.26 o-succinylbenzoate--CoA ligase
MAGGWLRSGDLAVRHAGDGYVRILDRSKDIIISGGENISTIEVEAALFAHPAVAEAAVVGRPDEYWGETPCAFVTLREGAAGSVRAEEVVAFWQARLPRYMAPRTVVFVAQLPKTATREWATNFLLRGAGPGPHGEAFSTSPSSRDGGRGT

SEQ ID NO: 91956 - DNA, 936 bp, Zea mays
  misc_feature: Ceres CLONE 1580489
  misc_feature: Encodes the peptide sequence at SEQ ID NO. 91957
  misc_feature (853)..(853): n is a, c, t, g, unknown, or other
  misc_feature (854)..(854): n is a, c, t, g, unknown, or other
  misc_feature (856)..(856): n is a, c, t, g, unknown, or other
  misc_feature (857)..(857): n is a, c, t, g, unknown, or other
ctggagctccccgcggtggcggccgctctagaactagtggatcccccgggctgcaggaattcgtctcacccctagaaaaaatagcgtcgtagtcctagtcaccgcgttcgcttcccgagcacgcaaccatggctcgactgtcagccaccgccgcgctcctcctcctcgtcctctccctcctcgccgtcgcgcactgcggtgccctcgcagtcgcagcagagcacgacaccgagcccgaatcaaccgccgccgtggccgtcagcgacgacaacgtgctatccgaccccacggtccacgctgaggcgggcaccgccagcgccactgaagaggaggccatcccggcggagcagcagcagcatgggttcgaactcctccgcctgccgtctcaccggctccaccaccaccaccacctctggtggaagcgccaccacgggatctaccgtgacgcgtcgcacaagttcccttgttctggccacggcgcgaggcgcgagcaggcagtgagccaccttgccatcttgcccgcatccgcagaggtggccagggaggcgggggaggagatgcccgtggccgagccggacccggatcgctccctcccggacagcgacggagagggggaggtggctattacaagcgagcagccgtcgccgttcaccgacgccgacgggcacgacgacgagagctcggcggcagtcaggtcgtggaagcacgagatgctgcggaggtggttccacttccaccacgacatgcgccgccaccgtctccaccacgtccacacgagggtggaagatggtagctacaccgccccagagacgacagggagtatgggcatgaaagcgcaccggttccactttcnncnncccgacgacgaagacgaagagaagatatgggcgccaagaagcggctccgccaccctgatgacacgacgaggaagcgtaa

SEQ ID NO: 91957 - protein, 269 aa, Zea mays
  misc_feature: Ceres CLONE 1580489
  misc_feature (242)..(242): Xaa is any aa, unknown, or other
  misc_feature (243)..(243): Xaa is any aa, unknown, or other
MARLSATAALLLLVLSLLAVAHCGALAVAAEHDTEPESTAAVAVSDDNVLSDPTVHAEAGTASATEEEAIPAEQQQHGFELLRLPSHRLHHHHHLWWKRHHGIYRDASHKFPCSGHGARREQAVSHLAILPASAEVAREAGEEMPVAEPDPDRSLPDSDGEGEVAITSEQPSPFTDADGHDDESSAAVRSWKHEMLRRWFHFHHDMRRHRLHHVHTRVEDGSYTAPETTGSMGMKAHRFHFXXPDDEDEEKIWAPRSGSATLMTRRGSV

SEQ ID NO: 91958 - DNA, 949 bp, Zea mays
  misc_feature: Ceres CLONE 1580494
  misc_feature: Translation starting site: 265
  misc_feature: SWISSPROT Homolog: EC 4.2.1.46 dTDP-glucose 4,6-dehydratase
  misc_feature (692)..(692): n is a, c, t, g, unknown, or other
  misc_feature (785)..(785): n is a, c, t, g, unknown, or other
  misc_feature (869)..(869): n is a, c, t, g, unknown, or other
ctggagctccccgcggtggcggccgctctagaactagtggatcccccgggctgcaggaattcgtctcacccctagaaaaactctcctcccccgctctcgacttcccatcccctgcggccccgccccccgactcttctcgtcgcggcgcgcccaatcggctcggtggcaggctagcgcaccggctcggctcgggtccggttctaccgccaacgcgggccgccgcgctcccggatctcggtctagtcagagagttagcagacaaagatggcgacttatgagcccaagaacattctcataactggtgctgctggtttcattgcatcgcatgtcgccaaccgtctggtcaggaactatccccaatacaagattgttgtccttgacaagattgactactgctccaacctaaagaacctcaatccttcacggtcttcaccaaatttcaaatttgtcaagggtgatattgcaagtgctgacctggtgaattaccttctgatcaccgagtcaattgacaccatcatgcactttgctgctcagacgcatgttgataattcttttggcaattcatttgagttcacaaaaaacaatatatatggcacccatgttcttcttgaggcttgtaaggttactggtcagatcaggaggtttattcatgtcagtaccgacgaagtgtatggtgaaactgatgaagatgnctgtggttggtaaccatgaggcctcacagctgcttccaacaaatccatattcagctacaaaggctggggctgaaatgcttgtgatggcatacngaaaggtctaatgggtctcctgtggatacactcttgggccacaatgtgtatggggcaaaatcatttcctgagaactcattcccnaaaatcatcttttgggcatgcaagggtctgctcttcccatttcatggaaatggctccaacgtcaggagctccctgagggt

SEQ ID NO: 91959 - DNA, 2408 bp, Zea mays
  misc_feature: Ceres CLONE 1580495
  misc_feature: Encodes the peptide sequence at SEQ ID NO. 91960
gacactgcttccgttccgtcgcctcgccgccgcgacgagacgaccccgcccctacaaatacaccgccactttggccgcgtcagccgccgccacttcccagatcccgatgtcccgcgcccagattccactcccttgttgcatcgctactctgttcccagctcggggcctctgacgaggcccgaggcgcaggcgccaacctcccggcccgccctagggtttggggctgatcgatccggctaggtcttggcgggagctgctccaatgggggatcgggaggaggacgaggagctccagatggcgctccgcatgagcctccagggctccccgccggcgcagcctgagcccaagcgcagcaagcccccgccccccgctgcggagtctccggaggcagaggcgcgccggaagcagcgcgagctcatggccgccgccgccgagaagcgccgccgcggtgcagcctcaccggcctccgtctcggtggcgcggtctcctctgcagccagtggtggtggagccagcccccgccccggaggtcaccaaagagcaggtggaggagccggaacaagctggcgtatctatggaagaagcgaaggaggtggtggaggaggaagaagaagaaaagagggaggagttgcctccagatgtcgctgagaatctatgggcaatggtgtttgggagaggtgtttcaaaggcggtcttggcgcagtggagtaatcagggcataaggtttagctctgatccagaaacaactatgggacttgtacaacatgaaggaggaccttgtggtgtcttagcaaccgtgcaggcttatgtccttaaatatcttctgtttttttctgatgacttgagtaatccagagatcagtaacccgctgtatactctgggacaaagacgcttttatcagagttcttttgctgcaggggatgatttttcatcccttactgatgatagaaagacaagagcattggttcatgctatggtggagattctttttttatgtggaactgggaaaagagctgttgtagcatctgttgcacgtgccaatcgtgggaaaattgatgcagctttggaagatctttctgtcgaatcagcagtggatctgcagaaagttcttaaaacaagtacatttacttcaaggaaggatgcattcaacacccttttggctaacattcatttgtttcaaagtcgactgggagccatgctatttcttatctctgctttgctttcacgaggattggaagatatccaagcagacagggatgatccaagccagccattggtcactgctccatttggtcatgcttcacaggaaattgtgaatttattactctgtggagaggctgttccaaatgtatttgatggcaagatggaccttggtggtggcatgtccttgaagggcataccaaacaatgttgaagttggttttcttaccctcctggaatcactaaatctctgcaaggttggtcagtacttgaagtgcccaaagtggccgatatgggttgtgggaagtgaaagtcactacacagtcctttttgccttgaaccccaacgttcaagaggagaatgagctggaagagcgcgaatcaaaaataaggagggcttttgatgcccaagatcaaagtggaggtggaggctttatcagcgttgagggcttccaacaagtcctcagggatactgacataaattttccttcggataaactcgaggacctatgtaatgctgggattatagtatggagtgaattctggcaggcattgctacagttggataaaagggctggaggcatgaaggatccaactggtcttatgggcaagaagcaattcaccatcttccacttcaatggaattgccaagtctgtgctgaatgggaatgcaagtgcaggtggttcatgtcctatacagagacccaggttatgcaagctaaatgtcactgtccccccaaggtggactcaagatgagtatctggctgatgttgtaagcgcatcaaccagcagcagcaaggacgatagtattctttctctagctcccccaggtcagactaatcagcacgcaccattggtggactgcattaggacacggtggccacgagctgtttgtagctgggttggagatgttccaagcattgtctgacacagtggatgtcgtgtgcgcactagtcgctctagctatgttgctcgtaacctcgttctgaagaatctgctcagagcaagccacttggagcttcctgattgttcatgccctgcaaaaaggaatcgcccaattacatggtttgtttcggttaaaatgagtgatgttttaatgcgtgttattaatcaagggcctggatattctttttttttgcttttattgacattagatgtacacttgatttatggatatgttttgtgtcttgggctaaaaaaaaaaaaaaaaaa

SEQ ID NO: 91960 - protein, 620 aa, Zea mays
  misc_feature: Ceres CLONE 1580495
MGDREEDEELQMALRMSLQGSPPAQPEPKRSKPPPPAAESPEAEARRKQRELMAAAAEKRRRGAASPASVSVARSPLQPVVVEPAPAPEVTKEQVEEPEQAGVSMEEAKEVVEEEEEEKREELPPDVAENLWAMVFGRGVSKAVLAQWSNQGIRFSSDPETTMGLVQHEGGPCGVLATVQAYVLKYLLFFSDDLSNPEISNPLYTLGQRRFYQSSFAAGDDFSSLTDDRKTRALVHAMVEILFLCGTGKRAVVASVARANRGKIDAALEDLSVESAVDLQKVLKTSTFTSRKDAFNTLLANIHLFQSRLGAMLFLISALLSRGLEDIQADRDDPSQPLVTAPFGHASQEIVNLLLCGEAVPNVFDGKMDLGGGMSLKGIPNNVEVGFLTLLESLNLCKVGQYLKCPKWPIWVVGSESHYTVLFALNPNVQEENELEERESKIRRAFDAQDQSGGGGFISVEGFQQVLRDTDINFPSDKLEDLCNAGIIVWSEFWQALLQLDKRAGGMKDPTGLMGKKQFTIFHFNGIAKSVLNGNASAGGSCPIQRPRLCKLNVTVPPRWTQDEYLADVVSASTSSSKDDSILSLAPPGQTNQHAPLVDCIRTRWPRAVCSWVGDVPSIV

SEQ ID NO: 91961 - DNA, 1960 bp, Zea mays
  misc_feature: Ceres CLONE 1580497
  misc_feature: Encodes the peptide sequence at SEQ ID NO. 91962
aatccgcagttccacaccacactacgccgccgcagccaggcagacagaggcagccccctcatggctgcccacgccgtcaccccgctcaccatctgctgcctccgccgcggcgttcccctcaaccacagccgccgcctcctcgccgtagccgccgcagcgccagaatcgcccgcgcctacccccgcgccatcccagttgccgcttcccccggttcctcctcgcaagggctacttcccgaagcgtggcgagacagtcgagctcacctgcgaggcgctcgccttcaagggcaagggcgtctgcaaggtcgcgggctccacgttcgtcctgctctgcgatggtgcgctccctggcgagcgcctcatcgcccgcgtccgccgcctccgccgtggcgcctttgccgaggccgccaagctcaggaccctcgagccacaccacgacgccatcgaggcgccctgccccctcgccgctgactgcggcggctgcaagacccagtctctcgcgtacgccgcgcagatccgccacaagcatcaccaggttcgcgacttgctcgtgaactttggcaagtttgatcccaagcgcctggagagctcggagccggatgatatcctcaaacccaccgtgcagtgtgacgagatattccggtacaggaacaaaatggagttctcgtttgggacgaagagatgggtgcaaaaagagttgaaggacaagggtgaggaggtggaggtgaagcaggaaacgaatgaaactgatggatatgcgcttggactgcacgcaccagggttcttcgacaaggtgctacatgtgcagaaatgttttctgcagagtgagccagcagataaggttcttgcagttgttcaagaaacctggatggatcctgccataggcctcacaccttatgatgtccataagcatgttgggtttctcaagcatctgatgataagaactggaagaaacatcagcactggaactccagaagtaatggtcaattttgtgacgtcatgttataagccagatgtattgatgcctcttgttgataaaatcacaaaaatacctgaagtggttagtgtcataaataatgtgaactcgtctgttggtaattcatctgtgggtgaacaagaatatactttgtacgggaagccaaacattacagaaatgttgagaggacttgcgttccagatatctgccaactccttttttcagactaatacaaaacaggctgatgttctttacaagcttattgaagattctgctgggcttaaaggagatggctctgaaattgttcttgatctgttttgtggaactggaaccattggtttgacccttgcccgaagggcaaagcacatttatggatatgaagttgtccctgaagccattgaagatgcgcgaaagaatgccaagttgaacggtatcaacaatgcaacatttgttcaaggggacctcaataaaatcaatgaatcattcgggaaggaatttccaaagcctgacataatcatctcagatcctaatcgccctgggatgcacatgaagttaatcaagtggctgttagaagttaaagctcctcgaatagtgtatgtctcatgtaatccagctacttgtgctcgggatttggactacctatgtcatggcgtggaggagaaagatttgagaggattctatgaactgaagagtgtaattcctgtggatatgtttcctcatactcctcatattgagtgtgtatgcttattggagctgcgttgattttcagttttggtcaggtaaacccactggagccttgtttgggtgacgagtattcacctcaatccatataaggccttgttcggcactctagtatttaatacatattgggatccaatacatggtgggattgagtgaatccatcccatgtcacttaaaccatgtgtgtttcaattacagctgagatttaatacatggctaattttcctaaaaaaaaaaaaaaaaa

SEQ ID NO: 91962 - protein, 558 aa, Zea mays
  misc_feature: Ceres CLONE 1580497
  misc_feature (231)..(558): Pfam Name: tRNA_U5-meth_tr Pfam Description: tRNA (Uracil-5-)-methyltransferase
  misc_feature: SWISSPROT Homolog: EC 2.1.1.35 tRNA (uracil-5-)-methyltransferase
MAAHAVTPLTICCLRRGVPLNHSRRLLAVAAAAPESPAPTPAPSQLPLPPVPPRKGYFPKRGETVELTCEALAFKGKGVCKVAGSTFVLLCDGALPGERLIARVRRLRRGAFAEAAKLRTLEPHHDAIEAPCPLAADCGGCKTQSLAYAAQIRHKHHQVRDLLVNFGKFDPKRLESSEPDDILKPTVQCDEIFRYRNKMEFSFGTKRWVQKELKDKGEEVEVKQETNETDGYALGLHAPGFFDKVLHVQKCFLQSEPADKVLAVVQETWMDPAIGLTPYDVHKHVGFLKHLMIRTGRNISTGTPEVMVNFVTSCYKPDVLMPLVDKITKIPEVVSVINNVNSSVGNSSVGEQEYTLYGKPNITEMLRGLAFQISANSFFQTNTKQADVLYKLIEDSAGLKGDGSEIVLDLFCGTGTIGLTLARRAKHIYGYEVVPEAIEDARKNAKLNGINNATFVQGDLNKINESFGKEFPKPDIIISDPNRPGMHMKLIKWLLEVKAPRIVYVSCNPATCARDLDYLCHGVEEKDLRGFYELKSVIPVDMFPHTPHIECVCLLELR

SEQ ID NO: 91963 - DNA, 885 bp, Zea mays
  misc_feature: Ceres CLONE 1580499
  misc_feature: Encodes the peptide sequence at SEQ ID NO. 91964
  misc_feature (805)..(805): n is a, c, t, g, unknown, or other
ctggagctccccgcggtggcggccgctctagaactagtggatcccccgggctgcaggaattcgtctcacccctagaaaaaaatttggacagccgcttcggcttcgcttcatcctcccccctcccaccccaactcctcgtcccgctccggcgtgcgtttcctttcccggcttgggttgcccaccgagatcacccccctcaaaccctagcccctcttctcctcctctgaccatctcctcctcctcgcgcttcgccttcccaatctcgctgccgtttcttgggcctgggactcgcgctctgctatctgtgtccgcgtatggcctgcgacggcgccgccagaggccgccctcccaagcgccccgcttcgggaggcctggcccagcccaacgtcgtcacctacaagagacgccgccgcggcaccggcgccaacgccggccacagcgccgtcacgtctggccccgaccccgctgaaatgagcgcggtggtgcacgccatcgattcccagcaaggtgggcgccaaacgctgggcaggcactggagaaactggagggacacgctggagggcgtcctacaatccactgctgggaagcagggctccggagggattcagagctgcatccgagctgcgctcagatttagtggttgccctcccacagaacatgggaacttagctcacgacggaggagcaggcagagatgaccctgttggagctgtacattctgaagaagatagtggtgccttggttcagttagaagacggaacagctgcacctttggaagcaacaaaacgatgtgccataatgctctncttgacattctgatctccgagaagtttgcgatgctgtgtgatctgctagctgcaacattccatgtcagtaagcctgacga

SEQ ID NO: 91964 - protein, 167 aa, Zea mays
  misc_feature: Ceres CLONE 1580499
  misc_feature (164)..(164): Xaa is any aa, unknown, or other
MACDGAARGRPPKRPASGGLAQPNVVTYKRRRRGTGANAGHSAVTSGPDPAEMSAVVHAIDSQQGGRQTLGRHWRNWRDTLEGVLQSTAGKQGSGGIQSCIRAALRFSGCPPTEHGNLAHDGGAGRDDPVGAVHSEEDSGALVQLEDGTAAPLEATKRCAIMLXLTF

SEQ ID NO: 91965 - DNA, 909 bp, Zea mays
  misc_feature: Ceres CLONE 1580502
ctggagctccccgcggtggcggccgctctagaactagtggatcccccgggctgcaggaattcgtctcacccctagaaaaagtggccctctctctcctattaggcctcccaggtccagctaccacagcagccctctcgcttataaggacgagggagaagggggcgaggcgagcaatgtctgagcagcggcagccattgccgcagccacggagcatcatgcgggaggcgctggagaaggacgacaaagagaaggcagctgcagcggctgccgccaagagagaaggcggcattccccaagaacggcaacggcaacagcagcgagaatggctgcggcgccagcagcggcaacaggggagcgcccccgcccttctgcgaggacacagcccacgagatccaggtgggccacgaaagcgtacccgccaaaagacggccccctccgggctacaatctttcccgaaagaagccccccggcccgtggagggaaactaagcccggctgggaaaaatgatacagcttttctgggaccaaaatattcgattccccaaacttggctggggccacccggtttcctttttggtcccggggccctatcaaattccggggccgggggttcccccttttccccccaaaaattcgggaaatatttccccgcccccccggaaccccggaaggggtgcccccccctccctcaagggggggggggggaaacactgggggtttctttttttctaaaaaaaaaatttttcacttttgtgcccgcaaagggtttttttctcccgggggcgccccccatatttgttttctcaaagggaatcccccccggggtttttcccccctctgggggcttttaaaaagaaaaaacaaggggggggtgtcataacgggatctctcctcacgggggggggcgcgg

SEQ ID NO: 91966 - DNA, 903 bp, Zea mays
  misc_feature: Ceres CLONE 1580504
  misc_feature: Translation starting site: 141
  misc_feature (742)..(742): n is a, c, t, g, unknown, or other
ctggagctccccgcggtggcggccgctctagaactagtggatcccccgggctgcaggaattcgtctcacccctagaaaaaacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaggacggcggtctgctccagctccacggcgtcgaacgccgccgcggcaacgtcgtcgtcccccacgaccccgaactcatagacatcttcccacccaacggcgtcgaaatttccgtctccgaggggcgagtcgggggggcccgggggggttttctccccttctttgggaaaacttctctttcctttttatcggggttcccggggcttttttttcctctttccccccgnccaaagggggggggccccgggcccggggcctgtggggccttccgggggggcccccgggaaattttggcgcccccccaaaaagaaaattttcccagaaagggtgccttaaaacaaggggggcaccccctctcccccacacattttcccggggcggggaaaaa

SEQ ID NO: 91967 - DNA, 850 bp, Zea mays
  misc_feature: Ceres CLONE 1580505
  misc_feature: Translation starting site: 210
  misc_feature (704)..(704): n is a, c, t, g, unknown, or other
ctccccgcggtggcggccgctctagaactagtggatcccccgggctgcaggaattcgtctcaccccctagaaaaaggacccgacgggggtgcccggaccacatccctatttcatcttggtaccccgtccgtctccgatttcagaagcacggcgggctccccggcagcctcaaccgagcagaaagctgagttctaccccagaaccgaggcatggaggacgaagaaaacatcgagggagaactgttgctcgtggagtcacaactccacgacatccaaggacaaattaaaacattactcgatcgccaagaggagttgtatgaacgccaggcacagttgaaggctttgctcgaagcatctaaattgaccagaaatacaacaattaacacatcttcagttgctccggaagattggtctgggagcttcccatgggatctggaggctgacgataccaggttcaatatatttggcatttcctcctaccgatcaaatcaacgagaatcatgagtggaagagatgttctggtcataatggcagctggtggagggaagagtctatgttaccagctcccagctgtacttcgtgatggaattgcactggttgtcagtcctttactttcccttattcaggaccaggtcataggactgtcagctttaggtataccagcatacatgctaactttcactaccaacaaggaaaagtgagaangtcatctataagacacttgataaaggagaaggagaactaaagatattatatgtgacacctggaaagatctcaaaaagtaaaagttcatgtctaagctcgagaaatgcatcatgccggtcgtctttctctgattgcatagatgaggt

SEQ ID NO: 91968 - DNA, 2331 bp, Zea mays
  misc_feature: Ceres CLONE 1580507
  misc_feature: Encodes the peptide sequence at SEQ ID NO. 91969
ctaaatttcttttcgtcctccgccactgctcccaggcggccaagcggccaggccaatcctcccagagtcccactcccaggctcccaggctcccaggcggcgtcctcctcactcctctgtcctctcccagtcggccagtcccaggcggcaccacggcacggcgcacgggcaccagcaggcagcaccggagcagccggccagtcgcccagtcccactgctccacctccactcgcgcaccagcaggcagtaggtagtaggtagcagccagctcctaggcagcaccgcagcaaccagcagggaggcaccgcggcaggaggtagatgtcctgctgaatatagaggtagaatataactggtatagtgtttacttcatatgtcctgcactcctgctgaatatagagctagatgtcctgctgcatttgtcactaatcactaggaaatttgtggatggttaactttctttggcataataccatttgcagggcctcggaacagtagctataaactcaatgctcaattctcggaacagtagctataaacagtagctataaatttgtggatggttttatttcagacaagcacgaccacaatcggataggaaaactgctttagtttggattagttcttaagacaattcaatgctcaattctgggttttttttacttatttacctattgcatatgaaactcggtggatgtaaattgtaatccctttatttaggcattgttatgtaactctagtattttgtgattccattgtcatatagatgtcttgtatatgatttatagtaacgggtacccgaaatttacccaaacccaaacccgaatttgcgggtacccgaaattgcgggtacccgaaagttcgggtacgagtatgggttctactgctggaaacccgaaatctaaaaaacccaaaaaacccgacccgaaatttcgggtaaacccgaacgcccagtcctactgcagactgcttgctaagttgctttgctcaatttgctgcttgctagccttctacagtgctccggctgcttgcctggttgcttggctttggctagttggcttagttgctcgcgtagttgcgttggccgcgttgctgcttgcagtttctgcttgctttgttgcttgctatttgcaaatttagctgccctgcagttgcaaattgcaatagattcaagctcagcaaggtcgacaaaaagaaaggctctagaaagaggtagttgtgttatgtgtaacaatattgtctatacattttttttattaaatttagctctttattttaatgctaatgtatgcttgctctttgtttgacaacttatatttggttaagttactgatttgacatataatctacaaggaattcttcatctaaggtacttcttaataatgtttttatactaaattttgttttactgcaagatatatttttgtcattgccataccttatttttaggtcgtgctccgccactggggagggaggtggtggggaatggcggcggcgacgctccggtgggtgctgcagctgcaccgggacgtaccgcgggcagcacggttctactcggagggtctcgacttcagtgtaaacgtctgcacgctccgctgggccgagctgcagtcggggccgctcaagctcgcactcatgcacaccaacgacagtaatcttgcatcgcagagagtctattcttcaatgctctccttcactgtaccagacataaacagtgccgtatcgaagctaatggcattgggagccgagttggatgggccaatcaagtatgagatccatggaaaagttgcagcactgcgatgcatcgatgggcacatgctaggcctgtacgagccagcttgaagaactcgtgtcacaacgaaagtattgagaagttccattaaccactcactgaagactgatgtgtatgtccggcaaaagatctttccgcgtacagacaacttactgggtctggtgtgcatgaagtggcagaactccttttgttagcaaaatcacgagagacacggtggatggtttgcagtctaccattctcttcctcgtgctgctggttatgatacacatttttctcgaactgaatgtgcctagcaggtcgtcgtggtaagctgaagccaggtttcagtggtcctgctcggtcatggccttgcttcatggcattgtgccagtacatctaattcaagtttcagttgtagtttgactgacattacatgtgtgcgtagtttcaatttgcaattcaagtgcaggagtgctctgcccctgatcatccatgtaattgaaattcttctgtaagcatttgttctgacagtataattgtggaccaaaaaaaaaaaaaaaaa

SEQ ID NO: 91969 - protein, 118 aa, Zea mays
  misc_feature: Ceres CLONE 1580507
MAAATLRWVLQLHRDVPRAARFYSEGLDFSVNVCTLRWAELQSGPLKLALMHTNDSNLASQRVYSSMLSFTVPDINSAVSKLMALGAELDGPIKYEIHGKVAALRCIDGHMLGLYEPA

SEQ ID NO: 91970 - DNA, 933 bp, Zea mays
  misc_feature: Ceres CLONE 1580508
  misc_feature: Translation starting site: 260
tggagctccccgcggtggcggccgctctagaactagtggatcccccgggctgcaggaattcgtctcacccctagaaaaacccctgcgacttcaacctctctcaatctcctctccttgtccactggcttgggcgtgcctttgcgtgcgacgggagctaggaatccacggcatcggaaaagtggccgcctgaagaaccgatttctccaagatttttttgtccatcctatcgcttgcaggatcggattcgccgtctctggccatggttctcgccggcctccgccggcacgtcggccagttcttgaccagcagtaatgagcttatggcggcgtcgctctcggccgtgagctgcgcggacgaggtgcagaaggcggagggggcggggtgccgtgaccaccccgcggcgctgcggctcaagaaggtggccatggcggcgatactggtggccggggtgctcggggtggtcctgccgctcgcagggcggaagcggcgcgcgctgcgcacggacagcgccgcgttcctgggcggccaaggcgttcgccccccgggtcatcctggccacggggttcgtccacatgcttcacgacgccgagcacgcgcttgtcaagccggtggctccccgccgcggcgggggcgaggttccccagtccccgggttcgtcccatggccccccccgcataaccccgcgggggctccaacttcctggccccccggttttacaagggcaaattatctccaaacaggcctccccgccttaaagggggccccccccccccccctgggtttgcgaacccccctcgggagagggaacaaggaacatcccccgggggtcccccctccaaaaaaaaaaaaaccccagggccctcccttttttgcaaacacccattgccttgggaacacgggtacaatgcccacgccccccacctctggctcggg

SEQ ID NO: 91971 - DNA, 906 bp, Zea mays
  misc_feature: Ceres CLONE 1580509
  misc_feature: Encodes the peptide sequence at SEQ ID NO. 91972
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
tgggggtgnnnngnnnnngtgtggggggggttcatcacatcagatgcggatggggggggggggaaaaaagactctattgggggggagttgtggatcaaattgaactcacgcggtggcggccgctctagaatagtggatcccccgggctgcaggaattcgtctcacccctagaaaaagccccacaaaccctcgtctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaaggagatccttcctcaggggagctcatcctccaactccctccgatgcccttgggacaaaaatcaggtttttgaaaagtttgaccggaacaagaacccaagctggggaatgcaccaaccccagaaagcgggttccaatcccacaatttggtccccccccgaacaaaagggccaaaacaaaaacaccgccctgaaaaaaaatcaattccgaaaaaagggcgggggcaatttttgggggttttgggaacccccaaagaggtccaaaaaaaaccccttgggggggaaaaaaaaaaacccccttttggggggaaacccaaaatttttgcccccccggggttcccagggggcccccccgaaaaaagggaaaaatttttcccacggggggaagagggcccccctttttcccctggccctggggggggccccccaaaaaaatgtggggccccacaagaaaatttgggggccccaaaaattttttgggggggggccccgggggtttttttaaaaaaactcgggggggccaaaaacccttttgtttttgacaaaaaaaa

SEQ ID NO: 91972 - protein, 52 aa, Zea mays
  misc_feature: Ceres CLONE 1580509
MASETETFAFQAEINQLLSLIINTFYSNKGDPSSGELILQLPPMPLGQKSGF

SEQ ID NO: 91973 - DNA, 1204 bp, Zea mays
  misc_feature: Ceres CLONE 1580513
  misc_feature: Encodes the peptide sequence at SEQ ID NO. 91974
cattcgtcaagacgaaagaatatattattaatctcttttgcgtggtcaaaagagaagaatctttttttttttaaagctgggactccccgcggtggcggccgctctagaatagtggatcccccgggctgcttgaattcgtctcacccctagaaaaaatacccctagttgtaaattggcggaaaggaaattcgcctcctcttctccaattgcagctgcagttgcgtgctcgagaggggtgaagaacctagaagccctgccagcgcgcggcgccggcgccttgtttactctgcgacggcacgctgattgcattggtactgttcttctcctgatcaccacacatgacaagggtcatccatgactccggagatgacatgcagaaggaggcacttgatttggtctcatctgacgttaatttccccaagggccatttcccagactataggattggaccaaacaaccaaatcattgatccagacgacacacatgaggctgtacctctcaaggagattgttgcaaaggaaacagcgcagctgcttaaagcagcacaagcggtctttttgtggcgtgtatcttcaaggaagaaaattttgaaaaaggggtctattctggggggccttcccaagccttttcctaaaaaagggcccaagtcggggcgtaataaaggccggcttttccatttagtatacaggggacagggttgcccctacccttgaaagaaaaaggcctccataataagaaaggttttttcttaaaggaacgcgccatcctgtgttaaatagggggcccccgtttgtgtggggagctcatgtggtattccccactaaaaagaccctcgaaggaaacacgcaatagcgcccctgtaaaagggtaaaaaaacacctaaagtctgctccaaactatgtggtgtgggggatagggtatcaaaatcataggactgtgtataactaagtattttgtaacacgcacccatgcccaatgtaaaggggggggaacacttttaaatttttttagtgtaaagaaaaagaggcgtgtagaaattgataaaagaaaaaaatagttggggctaaaacacctcgccctttttaaaaaacagggcgtctatcccggcaattaataatcacccgccatatagtgtggcctgtgaaaaaaaggaaaatgggggacccctattgcacatcgggactgggataatattcaaaaagag

SEQ ID NO: 91974 - protein, 124 aa, Zea mays
  misc_feature: Ceres CLONE 1580513
MTRVIHDSGDDMQKEALDLVSSDVNFPKGHFPDYRIGPNNQIIDPDDTHEAVPLKEIVAKETAQLLKAAQAVFLWRVSSRKKILKKGSILGGLPKPFPKKGPKSGRNKGRLFHLVYRGQGCPYP

SEQ ID NO: 91975 - DNA, 889 bp, Zea mays
  misc_feature: Ceres CLONE 1580514
  misc_feature: Encodes the peptide sequence at SEQ ID NO. 91976
ctccccgcggtggcggccgctctagaactagtggatcccccgggctgcaggaattcgtctcacccctagaaaaacattcccgcccgccatccagcccgcaccccgccatccagcccgcaagccgcaattgccactcccagatcccgtcatccgcctccatcaatgccctcctcctagatcccgtcatccgctgcgaatctccattcagctccccctcgcgctttcgtcgtcgccgtggaccgctcgctggcgctgacctctcccaagcgcggcatggtggtacccagtagccagtagtacccagtagccatctccatccaggctcaaaccctagggaatctacccagaaatcacaccccaagcagggtcctatcgtatcaagaagccgtcgcgggggccggatcgccgcggctcggaaaggagcggagcgaaaatcatctgcagacagataaggattcggaggcgggatcaggagctgaaagaacctgttcgaggtggcctagactcgtagggatcgcgttgatattgggagaaatcacggagaggcggaaaccgagcaatagccaataggggaagggaagagcaacagtgcccggggcaccaagaattcgttgcttagatccaggagaagaacaatagaaatctgggcagaacgagaacagaactgactacaagatgcctcaattgagaactgccagcagggcggcgctcgccaacaactctgcgggtggtttttttatcatggagaaggggggctcccccaggacgtcccaggcaaaagtcgccaactaaccgcttgctcgaaggttccaaaacctgccgcgagggcttaacaagtagataatgccctacttcactgtaacaagggtcccactccgtggaataaaca

SEQ ID NO: 91976 - protein, 38 aa, Zea mays
  misc_feature: Ceres CLONE 1580514
MPQLRTASRAALANNSAGGFFIMEKGGSPRTSQAKVAN

SEQ ID NO: 91977 - DNA, 1070 bp, Zea mays
  misc_feature: Ceres CLONE 1580516
  misc_feature: Encodes the peptide sequence at SEQ ID NO. 91978
ctccccgcggtggcggccgctctagaactagtggatcccccgggctgcaggaattcgtctcacccctagaaaaaatcaacaccagcacagcctccctccctccctcggctgccttttcccactccttccagcgatcgatattcctccttccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacaggatggccgccgcgccgccggccaaggccgacgagctccagccgttcccgcccaaagagcagctgcccggcgtcgcctttctgcatcaccagcccccccgccatggccgggaggcattcttgctagggttccagcattttccgtcgtcatgcctgggcacccccgttattttttcccaggggggctcgttcccccaaataggggagggggaaaattaaaaaaaaagggccccgggggggtttcaaaaaccataatgggtgcgggggcgggggaaaaaaacccccccgtgtttccaaaaaattttttttggggaacccgcccctccccgcggtctgtgtgtggggggcggctccaaaaactttttcccgggggggcccaacaccttcccaaatactcttttgggggtggaggggggaccaaaatttaaaacaacaaccccccccaaaaaatttccccggccaaaaaagaagggggggaaaaaggggccctcccccctgggtgggaaagaaaataaaaaaaaaatggggtgtagggccccctcggccccattttgtaaatttataggcccggcgggtggtctcctcgttgtatagaggggggggtggcccacaaaaattgttcttggggggaaaaaatataaaaattggccccaaaccacccggcgggtgttgttttc

SEQ ID NO: 91978 - protein, 71 aa, Zea mays
  misc_feature: Ceres CLONE 1580516
MAAAPPAKADELQPFPPKEQLPGVAFLHHQPPRHGREAFLLGFQHFPSSCLGTPVIFSQGGSFPQIGEGEN

SEQ ID NO: 91979 - DNA, 849 bp, Zea mays
  misc_feature: Ceres CLONE 1580517
  misc_feature: Encodes the peptide sequence at SEQ ID NO. 91980
ctccccgcggtggcggccgctctagaactagtggatcccccgggctgcaggaattcgtctcacccctagaaaaaagaggcagggggttgccgctctctccgccgcacgctgcggctctgctctgctccgcctgatccttcctgcggcccttgttttttcctctcgtttcaggtggccaaccttggttttacaaaactcattcactggcctctgctgaaaagtgttcaatggcgtcatgagccaccttaagctgggttaaaaccccatttgacacccgaacatttcatgacctatctaatctaagtttccgctgccgaaacccttttggatcaattcagccctggtggctgctaactgatcaacactcatccctaatcaaggttcgcgtggctgcccaccattcacactcaatgccagattcaaaatacacgagcagatcggggttatctccctcttgaagaagttaaagaacgtccaaagaagaaggacctgttgctgacagatattgaaacagctagaacagtagtagaggcaaatagcaaggggttgcttgtatttcctgctagggtacacaatgaacctcatggacatgtttcttggtcggagtttcaatacgttgttgatgaatatgggagacattttccttgaagtaactgacagtgagaacatcctggaagatgatactgcaaacaatcctgggaaagttttaattggaatggatggacccatttattggagaaagtagcgtgggccatttgggaacttcagagaatttacttggatggggggaaaattttatttgaactttccccggaatgacccccaccccccaggaatggcttcccgaaa

SEQ ID NO: 91980 - protein, 56 aa, Zea mays
  misc_feature: Ceres CLONE 1580517
MNLMDMFLGRSFNTLLMNMGDIFLEVTDSENILEDDTANNPGKVLIGMDGPIYWRK

SEQ ID NO: 91981 - DNA, 956 bp, Zea mays
  misc_feature: Ceres CLONE 1580520
  misc_feature: Encodes the peptide sequence at SEQ ID NO. 91982
ctccccgcggtggcggccgctctagaactagtggatcccccgggctgctggaattcgtctcacccctagaaaaaaaatgtaagacacgtggtatgggagttgggcgcaagctcaagacccacataaggaactagaggtgggctgacaaagcctgcaagaagagccatctcggcaacgagtggaagaaaccctttgctgggtcatctcacgcaaagggaatcgtccttgagaagatcgacattgaggctaagcagcctaactctactatccgtaagtgcgctcgtgtccagctggtgaagaacgggaagaagattgctgcctttgtgccaaacgatggttgcctgaactacatcgaggagaaccataaggtgcgagagcggggaagggacccaccgaggtgcatggtgaataagcaggtatcttcctctagaatgctttgaccacagcaaaacataatttatttcatctaagataattatatcaagcaattgttctacctgttaatggcgctaactgatgaaaatttatttggcttagagggttgggcggactctcgggcatggaccaaccaaaagggggaaatccctttttaataaaaaatttttgtatgccagggtttgggattctgggatccttgaaatataaaaaatagcccgtgcccccttgggccctgtgttccacaaatttggggaaggggggggaaaaaaagcccccgcagagccccaaaaaagaaatttgggggacccccttttggaaccctttcccctctggggtcttttgaggcgccataaaaatatacccgaacgaattcccatattggggggggcgccccccccgggaagcggggggcggaaaaaaatgggtgggggtttatattgcccacaatatttttttcctcttaaaaatcttcgctcccccgtgggggttattattgtttccctctttttgtttgtttt

SEQ ID NO: 91982 - protein, 43 aa, Zea mays
  misc_feature: Ceres CLONE 1580520
PRGGGRSRTSGSPGLLEFVSPLEKKCKTRGMGVGRKLKTHIRN

SEQ ID NO: 91983 - DNA, 919 bp, Zea mays
  misc_feature: Ceres CLONE 1580521
  misc_feature: Encodes the peptide sequence at SEQ ID NO. 91984
ctggagctccccgcggtggcggccgctctagaactagtggatcccccgggctgcaggaattcgtctcacccctagaaaaaacgccctccgccgctcttcctctgcaccccagtcctctcccacaaccacttccggcggccacgccctcggcttctccgtacttgctgctcgcccgtcccaccaccataattttccaccagcgattgtaaatttgtgggaggcacattcgccgaggatggctgtaaccctacttcgagggatgagaacgccgataccattcagatcgaactccggcttcttctccactgtcctacggcctcggttgtcccgcttcacgactagggcggagagtgcgcaggccacagaacccaaagcggcgcccaggtcaattcagctggcgaccaaggaggcggctgagcagaaacacaaggcttcgaaagcatcatcgggattgagaaccatgtccagctctcgaacgtcacgaaaggcgttctgcttctgcccttacagcttatggttcccagcccaaaggcacttttttgcccccacctggatggggccccccggggaaccctgcccggttccaaaataaaaaagggggccaaaagccccccggaaaatggggggcccccccccaaaccgggaaaaattcaaagagacccccaagtttgtatccccaaaggtttttttttccccgagccccccccagggggggaacaaatttcccccgtgtgtaacccccccttcccaaaaaaaggggttggtgtttttttacccccccccaaaaaaatattggggggggagaaaaaaaaaatatggggcgacaaagattttttttaaaaaaaaaaaaagggggggggcctttctttttttaaaaaaaaccacctccctcctggaggaaaaaaacaaaaaaagaaaa

SEQ ID NO: 91984 - protein, 118 aa, Zea mays
  misc_feature: Ceres CLONE 1580521
MAVTLLRGMRTPIPFRSNSGFFSTVLRPRLSRFTTRAESAQATEPKAAPRSIQLATKEAAEQKHKASKASSGLRTMSSSRTSRKAFCFCPYSLWFPAQRHFFAPTWMGPPGEPCPVPK

SEQ ID NO: 91985 - DNA, 1101 bp, Zea mays
  misc_feature: Ceres CLONE 1580526
  misc_feature: Encodes the peptide sequence at SEQ ID NO. 91986
gtttgtgttttgttttttttgtgtttattttatctctaatttcttcacgccgagtcaaaacgtgtgattttttttaagtgggactccccgcggtggcggccgctcttcaatagtggatcccccgggctgctttaattcgtctcacccctagaaaaagtttccaacacagcgaggcccacgttgtatggttttttgcttgcttcgaccggcggtaaagctgagcgcggcgagagccggataccgaagaagcgccacccgccgcgcgcccggacatggatatcggacagtaccccgcgagcggctgctccaaggagcaccacaatatctaccacgagtggttcgcgctcgcggacgcatatggggatggccgcatcacgggacccgatgcaatcaagttttttagcatgcccaagctatcccgacctgatctcaagcaagtctgggctatcgcggaaaccaaaaaggggggggtatcctccctctctctgaatttggttaccgagatgccacctgagactcttctgggaccagccaggcaactgagaattacttcaaaaataacctcttaggccaacgttgaatttgaaggaaacttttggaaaacccaccctgttataaagggaaagggttttatggaatgcgcccctaaccgtggcggtaaaacccccacagtgatttttggggtgcaaaagattattggaatagggaaaacccctctaacaaaatggggaaataggggattaattccccttttgaaggcgaaaacaaaaggtgttcgccctccctttaatccgagattctaaaatgggatttttaacgccccccacccaattattatccccccacagtgaaacaattaccccctccctgaaataagaccggcgcttcaactatcccggccctacaattgaaaaggcgctttttccaaataaaaaatctttaacatttcggaaaaaaaatttgagacccctcctctttgtaaagatttataacccaacaacaccttattaagggggaattaacgccgctcgcccgccttgtgagtgaaaaagggagagatagtttttgtggatagtccataggccatagggggcaattgcc

SEQ ID NO: 91986 - protein, 98 aa, Zea mays
  misc_feature: Ceres CLONE 1580526
MDIGQYPASGCSKEHHNIYHEWFALADAYGDGRITGPDAIKFFSMPKLSRPDLKQVWAIAETKKGGVSSLSLNLVTEMPPETLLGPARQLRITSKITS

SEQ ID NO: 91987 - DNA, 909 bp, Zea mays
  misc_feature: Ceres CLONE 1580527
  misc_feature: Encodes the peptide sequence at SEQ ID NO. 91988
  misc_feature (813)..(813): n is a, c, t, g, unknown, or other
  misc_feature (859)..(859): n is a, c, t, g, unknown, or other
ctggagctccccgcggtggcggccgctctagaactagtggatcccccgggctgcaggaattcgtctcacccctagaaaaaaaaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggaggaccctgtggaaaacattggagctaaattggtcaggcaagctgcagctaagaccaacgatcttgctggagatgggacaaccacctctgtggtccttgctcaggggctgattgctgagggtgttaaggtcgtagcagctggtgctaatcctgttcagattactcgtggtattgagaaacagctaaagcactagttgaagaactacggaagttgtctaaggaggttgaagatagtgagcttgcagatgttgctgcagttagtgctggcaacaactatgaaaatggtaacatgatagcagaagcatgnagcaaggtcggtcggaagggcgttgtcaccctttgaagaggggaangagtctgagaaacttctctaggtttggggagggatgccattttgacgtgt

SEQ ID NO: 91988 - protein, 160 aa, Zea mays; identical to SEQ ID NO: 85623
  misc_feature: Ceres CLONE 1580527

SEQ ID NO: 91989 - DNA, 974 bp, Zea mays
  misc_feature: Ceres CLONE 1580533
  misc_feature: Encodes the peptide sequence at SEQ ID NO. 91990
  misc_feature (835)..(835): n is a, c, t, g, unknown, or other
tggagctccccgcggtggcggccgctctagaactagtggatcccccgggctgcaggaattcgtctcacccctagaaaaaaccgttccttttcctctctcctgatctcagccgtgtagcctctccaccgcgcccacttcttatactgccagcgtctgctccctctcgcggaggcctcgctctggttggaaggtttggagaaactccccggctcgaggagatcgtgacattgagaggacgatgggagggcgcgcgctcctcctcctcctcctggtctcggcgttggtctttcagatccacgcctccgacccgctgctgtacgagccgttcgatgaggactttgaggggagatgggtcgtctccaagaaggatgaataccaaggtgtgtggaggcatgccaagagtgatggtcatgaggactatggcctccttgttagtgagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatccttaagcacaagaatcctaagactggaaagtatgttgagccatctcatattcccaccatctgtcccatatgacaagctctctcatgtctacacggctatcttgtagccagacaatgaggtcaaaattttggtagatggggaagaaaagaagaagcngaacttcttttctgctgatgattttgagccagccttatcccatccaagacattcttgaccctgatgaaagaagcgggaagactgggatgagaaagctaaatcccgatccctatgcattatacctgatgactggtatgag

SEQ ID NO: 91990 - protein, 170 aa, Zea mays
  misc_feature: Ceres CLONE 1580533
  misc_feature (24)..(171): Pfam Name: Calreticulin Pfam Description: Calreticulin family
MGGRALLLLLLVSALVFQIHASDPLLYEPFDEDFEGRWVVSKKDEYQGVWRHAKSDGHEDYGLLVSEKARKYAIIKELDEPVTLKDGTVVLQFEVRLQNGLECGGAYIKYIRPQDAGWDAKEFDNETPYTIMFGPDKCGSTNKVHFILKHKNPKTGKYVEPSHIPTICPI

SEQ ID NO: 91991 - DNA, 1002 bp, Zea mays
  misc_feature: Ceres CLONE 1580539
  misc_feature: Encodes the peptide sequence at SEQ ID NO. 91992
aagctggagctccccgcggtggcggccgctctagaactatggaagaccccgggctgctggagttcatctcatccctagaaaagctctggatggtagcttgtcactcgctgtttcactgtctcgactgcgtctcgatgacgcatctccggggatttcggggagttcagccaagaacaggctcgtctcttcgtcaacagctaccgtaggtgtagactccgcaacgtactgtagcaggacctgtcctgatgtccgacgacgccgcgtccgactctgacctgcgtggcctcaaccctaacactcagaagcactggcgagaaggccgtttgtgggctgcttcaggcgggttgatgcagaggtgggaggagacgctccaaccgaagccaaaacagtggctccagagaccccccccccccgacaccggtgcttgcgctttgtcaggtcgtcttctgtcctctatatgccaatgtctgagactcgggaaccggggaatctgtcgggggcaaagggatactggtggacgcgtttccttcggacaataaagcccaaacaatgggaaaaaagaactttggccacggtattttaggctccacgggggggccaaaggggtgcgacaaattggggaaaagggctttatgggaatttcctccggggtgtttccccccccccatgggagcggggggttccctttggggggggtacctccttccccttaaaaaccccttattataataaaccccgaggaccccgggagagggcccccctatttttgggggccccgggtccaccaagaggaggcccggaaggcccctctttttttttttggggggggagaaggggtctctttttgggaagtgggtgggtggccaaaaacggggggggaaaaaagtggggatgcgccgccccctccacccccaatttctcgtctggggggagccccccagagaaataatccctaaagagtgtttttttttgcactacccccccaaaaaagttgggtgattg

SEQ ID NO: 91992 - protein, 97 aa, Zea mays
  misc_feature: Ceres CLONE 1580539
MSDDAASDSDLRGLNPNTQKHWREGRLWAASGGLMQRWEETLQPKPKQWLQRPPPPDTGACALSGRLLSSICQCLRLGNRGICRGQRDTGGRVSFGQ

SEQ ID NO: 91993 - DNA, 913 bp, Zea mays
  misc_feature: Ceres CLONE 1580542
  misc_feature: Encodes the peptide sequence at SEQ ID NO. 91994
  misc_feature (620)..(620): n is a, c, t, g, unknown, or other
ctggagctccccgcggtggcggccgctctagaactagtggatcccccgggctgcaggaattcgtctcacccctagaaaaatttccatttgcctcgctcgccttcctcctccccactccactccattccaacgcaacggcctcgccccgctttataggccgccgcccgcgccacatcgccaccgtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaactatctttcggaagaaatatgctgatcctaatgaagtcgctgccgtcatttttggtgggtgtaccgggactcagctttttcctctcacaagcacaagggccacccctgctgttcctaatggnaggatgtaacaggctattgaaaatcccatgaacaaatggtttaacagtggcataaacaagaattttgttaagaacccgttcaaatcaaattttccctaaacggccaatttatcgaaccaattgggggggggggggacacccttcccggagggatccgttaagggccggggcgcaaccaaatctctgggaggcgcctcttgtgtgtttccgggaaaacaaacccctataaaaaatttctggggccgttgggggtttttcccgccaaagcttttaaaacccttttgttttttgga

SEQ ID NO: 91994 - protein, 116 aa, Zea mays
  misc_feature: Ceres CLONE 1580542
  misc_feature: SWISSPROT Homolog: EC 2.7.7.27 Glucose-1-phosphate adenylyltransferase
MQFSSVLPLEGKACMSPVRRGSGGYGSERMRINCCSIRRNKALRRMCFSARGAVSSTQCVLTSDAGPDTLVVRTIFRKKYADPNEVAAVIFGGCTGTQLFPLTSTRATPAVPNGRM

SEQ ID NO: 91995 - DNA, 969 bp, Zea mays
  misc_feature: Ceres CLONE 1580543
aaagctggagctccccgcggtggcggccgctctagaactagtggatcccccgggctgcaggaattcgtctcacccctagaaaaaaaaaggagtacacacttctccttagaattggagctgtacgagccacccagcaactttcttcatcatcttcttcagccctcgctctgtccgtcgacacagcagctttgcttgccaccaagctagccatgcaggaggagtaagagtacaaccgtaggagagagagagagagagagagagagagagagagagagagagagagagagagagagagagagctaacaccaccccgattccacccaccactgtccctagctagcttatttacaggcgttcgtgatcgccaacagcttctcgtcagaaagagtgcaacgggccgccccggcagaagaggtagctgggagctagagagaaaaaaaaggtgcaccgagcaacccaagccagggaggaagggaaggattaacccttcatccaaccgtttccggggaaacccacaataaggaaaaggcagggcggcggaattcttgggaggacctgaaactgtatgggggggagcagagcccccccggagggaaaattggggggaaccttttttaaacaaatcagacgaaccttctgggattttccccaaaagaagaaatatcgccccccgctggtggtcccttcctgaaaaaatcaggcgccccggggaaacccccttttgtgaggcctaaatattaaaacttgtggcgcgacaaggaaaattccttgacccctctattgatggcccccccccaaataaaaagaaattcctaaatagcgccttttttaccacccgcgggagaaaacagaggttttaccacacgaagaattcattggggtaatacatcgccggtctggcgagaaaattatagtataggagagggccccatggtatggtgataggggggtgcaagacaaagaagacag

SEQ ID NO: 91996 - DNA, 948 bp, Zea mays
  misc_feature: Ceres CLONE 1580544
  misc_feature: Encodes the peptide sequence at SEQ ID NO. 91997
ctccccgcggtggcggccgctctagaactagtggatcccccgggctgcaggaattcgtctcacccctagaaaaatccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggagggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactccactagtggggagtttgccctacgcacagtgctatggaggacatcagtttggtgtatgggctggtcagttgggggatggaagagcgatagctcttggagaggttgtcaactctcgaggtgagagatgggagttgcagctcaaaggttgtggaaagactccatacagcagatttgctgatggtcttgctgtcctacgcagcagcatccgtgaattctatgcagcgaagccatgcacggcctaggcattcctacaactcgtgctctttgtcctagtgaaactggaaaatcagtttgtccagaatatgtctatgatggcaatggaaaggaagacccgggtgcattagttggcctgtaagaccgtctgttttatcgttttgggtcgtatagataaccgcttcagggggcaagaggacttgaaattgttcctccctttggcaaataccgcataaatcc

SEQ ID NO: 91997 - protein, 189 aa, Zea mays
  misc_feature: Ceres CLONE 1580544
MASAAAPGSHAAAEAPPVDVGGGGAGAPRRLVLEELPWDHSFVRELPGDPRSDTIPREVLHACYSRVSPSAKVDNPKLVAWSDSVADLLDLDHKEFERPDFPQFFSGATPLVGSLPYAQCYGGHQFGVWAGQLGDGRAIALGEVVNSRGERWELQLKGCGKTPYSRFADGLAVLRSSIREFYAAKPCTA

SEQ ID NO: 91998 - DNA, 847 bp, Zea mays
  misc_feature: Ceres CLONE 1580546
  misc_feature: Encodes the peptide sequence at SEQ ID NO. 91999
ctccccgcggtggcggccgctctagaactagtggatcccccgggctgcaggaattcgtctcacccctagaaaaatttaccacaagtttctctacgctgtcgttcatgctgctgatcccgtcgatatgttgttagagttgcttgtatcaaagtacttcaaatacactgatattcgttacttcacttacactagcttagacaagattgccaacagtctgggcagtaaaaccactggctctggaaaagatgctttgcaaaatggaagtgacgagtcaaaaaacaggagtagtatttttatacacaacatatacaatcttttggcacatgttcctttgatggattttcaaaaggaatcaacatttgatatgtggagtactgttggtctatcttctaaaggagaaaatgactcttccaaggacacttctacgtacatcaataagaaactaaaattgaagttcaccaaagcatggctgtcttttctcaagttaccactaccacttgatgtgtacaaggaggtccttgcttcaattcatcaaaatgtcattccttcaatgtcaaacccttccatcttatgtgatttcttgactagatcatatgatattggtggtgttatcagtgtgatggccttaagtggccttttcattcttatgacacaacacggtctggagtatccaaaattttatgaaaagctttatgcactactgactccggctgttttcatggcaaaacaccgatcagtgtttttgcaacttcttgacacatgcctgaaatcttcttatcttcctgcctatcttgctgctgcgtttgcaaaaagattgagtagactttgctctttcagttccctcagc

SEQ ID NO: 91999 - protein, 241 aa, Zea mays
  misc_feature: Ceres CLONE 1580546
  misc_feature (163)..(239): Pfam Name: CBF Pfam Description: CBF/Mak21 family
MLLELLVSKYFKYTDIRYFTYTSLDKIANSLGSKTTGSGKDALQNGSDESKNRSSIFIHNIYNLLAHVPLMDFQKESTFDMWSTVGLSSKGENDSSKDTSTYINKKLKLKFTKAWLSFLKLPLPLDVYKEVLASIHQNVIPSMSNPSILCDFLTRSYDIGGVISVMALSGLFILMTQHGLEYPKFYEKLYALLTPAVFMAKHRSVFLQLLDTCLKSSYLPAYLAAAFAKRLSRLCSFSSLS

SEQ ID NO: 92000 - DNA, 1333 bp, Zea mays
  misc_feature: Ceres CLONE 1580547
  misc_feature: Encodes the peptide sequence at SEQ ID NO. 92001
  misc_feature (1031)..(1031): n is a, c, t, g, unknown, or other
  misc_feature (1072)..(1072): n is a, c, t, g, unknown, or other
  misc_feature (1077)..(1077): n is a, c, t, g, unknown, or other
  misc_feature (1200)..(1200): n is a, c, t, g, unknown, or other
  misc_feature (1276)..(1276): n is a, c, t, g, unknown, or other
  misc_feature (1287)..(1287): n is a, c, t, g, unknown, or other
tcgggtggtgcctccttactttcccctcccctccttttttatgaattttaaaaatctcttttttaatatttggactcaccgcggtggcggccgctctagaactgtggatcccccgggctgcttgaattcgtctcacccctagaaaaaatccccagtccccatccctctcctcgcaaaaggccaccgcgacgcgaccgcgtactgggggcaagacgcctgtgcatgctggcagaagatgagtctcctcgaacctaccgtgatggagctgcaagcgagcacagccagcagcgcatataaatatttccggaacacacttttcttccctttggcccccgtgaggtttctggtgtagcactcgactttgccttgagctctttagcgatcccgccccgtccaggtaatggcccctgattacacattcttcctggatgctgttgtgggggaccggtcgagaagagtaacttttcccgtggttggtttcccccccgcgtggggtgctaaccccccgttacctaaaacggtaaatattcttatccctatatcgccacttgcttttttacttactccccgggggaaacccagtgggcaggttacactgcttctttggcaagtagacccgagcgaccaatggtcgggatctggtttccttattgattttttccgcaatctggaggcgatcccgctattgtgtttcccttggccacgccgcctttttattgtggataaaacccaggcccaccacaagaattccggtaatcccaccacacggttctcacatcgtatataccttggtaggtaacgacccaatcaaataccgattatttaagaatacagctcaacacccagtcgatattttcctcatcattagtacaaatcctatcatctatgtcgtgactctcgttactacagttttactaatcaagtagacgatacactctgcatctcaaattgtccacgctttactcactattatactaaccgcattgttcgcatataatctccctctctatagtaatagcagcaaggacttnacatatgactacacacgagtcagccactggtgtgaataccnaattnagtatgtggcgatttgcacatcgctcctcatctatctccagcgcgtacgcaatataatggagtgatcgttgtcaccacaaagtaactcttctctctagaccgctctgcgcacacctatggtgnagtgatgtattgaagaactctctacagagtatgagtgcacggtattcgactctcctaatcgttcactgactatacncgacgttgttnctgatcgaccgagcaaaatatgcactctctcttcgcaatgtgacta

SEQ ID NO: 92001 - protein, 132 aa, Zea mays
  misc_feature: Ceres CLONE 1580547
MAPDYTFFLDAVVGDRSRRVTFPVVGFPPAWGANPPLPKTVNILIPISPLAFLLTPRGKPSGQVTLLLWQVDPSDQWSGSGFLIDFFRNLEAIPLLCFPWPRRLFIVDKTQAHHKNSGNPTTRFSHRIYLGR

SEQ ID NO: 92002 - DNA, 926 bp, Zea mays
  misc_feature: Ceres CLONE 1580548
ggagctccccgcggtggcggccgctctagaactagtggatcccccgggctgcaggaattcgtctcacccctagaaaaaaatatcaacacggtcaccaagtcctctccggatggcaaggccttgtgaccttccgccggtgcggcaagcagcggctcttctcctggcatgcgcgcttgctctgctcgcggtgcagctgcggccgtgcagagcccagcagcagcagcagcctccgtcgccgggatactaccccagcggcatggccaaccccccaaacaaaaccctaggccaccattctgaccaccaggcacaagcagagcagaagcagacatggccaccattccgaccaccgattctggcctcgtcctcagttcctccgctctcctccggaggactaggacccccccctcatccgtcaccgccaggctgccagccgtcgcccgccgtcgcccgcagctcctcgtgcgtgcctccgccaaggagatcgcctttgaccagggctccagagccgcccttcaggccggcgtcgagaaagctcgccgccgcggtcggcgtcaccctcggacccagaggaaagaatgttgtcttggatgagtttggaacccccaaagtggtcaatgatggaattaccattgccccgccctattgaagctggctaatcccatggaagaagccgggtgcttccttggaatcgtgaaagttgctaacaaagacaaaatgaactcggctgggtgatggaaaccacaactgcccttggtttctcgcttggggaaaacaatcaaaattgggccttgtttgaacaaattcttttcggggggcaaaaacccagtgtccccttaaaaagagggctatttataaaaaaagtttttcaaaaaatttgggcgggagagacacttttaaaaaaaaaataaaggccggcacaaaaggaa

SEQ ID NO: 92003 - DNA, 976 bp, Zea mays
  misc_feature: Ceres CLONE 1580549
  misc_feature: Encodes the peptide sequence at SEQ ID NO. 92004
  misc_feature (976)..(976): n is a, c, t, g, unknown, or other
ctccccgcggtggcggccgctctagaactagtggatcccccgggctgcaggaattcgtctcacccctagaaaaagcccaaaacaacccaatccggaaccccaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccagggcctcctccgccaccagctcgacatgtgctcccgcaacgccgacctcaccaccgcgctccgcctctacgacgacgccctctccccggacaaccccatcccgctctccctccaccactacaactgcctgctctacctctgctccaacgccgccgctaccgactctgacagccatatctccgccaccgccgctcagcgcggcttcgacatcttcgccaggatggaggccgacggcgtccagcccaacgaggccaccctcaccagcgtcgcgcgcctcgccgccgccacccgcgaccctgccatggccttctccgtcgtccgccgcatggccgctgcgggcacccagccgcgcctccgcacatactgccccgccctcttcgcttactgcgatgccaaagacgccgaccgcgccaagcaggtcgaggctcaaatgaacgcatctggcgtcgggcccgaagagcccgaactcgcaacgttgccccccggtcataccggaaacggggcaagtgcgaagaagttttaaaggttccgtcaaagaaccccgtcccccttcagggaggtttggagaacaacttgcccaagtcctcaaggcctggtcccggtcggaaacaagtgtccn

SEQ ID NO: 92004 - protein, 244 aa, Zea mays
  misc_feature: Ceres CLONE 1580549
MAAAVLRPTAATLRFLSTPPHQRRRVLVGHLPFARRRRHSSTATAPALEDSSPRSGEGKAVRRRRARESPQGLLRHQLDMCSRNADLTTALRLYDDALSPDNPIPLSLHHYNCLLYLCSNAAATDSDSHISATAAQRGFDIFARMEADGVQPNEATLTSVARLAAATRDPAMAFSVVRRMAAAGTQPRLRTYCPALFAYCDAKDADRAKQVEAQMNASGVGPEEPELATLPPGHTGNGASAKKF

SEQ ID NO: 92005 - DNA, 845 bp, Zea mays
  misc_feature: Ceres CLONE 1580550
  misc_feature: Encodes the peptide sequence at SEQ ID NO. 92006
  misc_feature (473)..(473): n is a, c, t, g, unknown, or other
  misc_feature (548)..(548): n is a, c, t, g, unknown, or other
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacngggagctcgccgcgcggtggcgggaggtccacggcagcacaaactgggagggtctgctggaccccatcgacggcntgctccttcagaagctcattcgttacggcaagttcgcccaggccacctacgaagcttcgactacgaccgtttctccccctaatgggggagttgcaagtacccggggaaaaccttttttcacgaagttggccttggggggatcgggtaacaaaggtccccggtacctttacgccacctggaaaaaacctcaagttccccaattttggggataaaaaggccgcaaagcccaaaattggggagcgagaccgggccctttttttgtgggaaggggggcgggtccccccacaagggaaaagg

SEQ ID NO: 92006 - protein, 168 aa, Zea mays
  misc_feature: Ceres CLONE 1580550
  misc_feature (74)..(74): Xaa is any aa, unknown, or other
  misc_feature (99)..(99): Xaa is any aa, unknown, or other
MAATVSSCLSLVPTVHHRAGGFPSSVALTNTLQRRRRSRRYLVVASATRAEQEAAPVTIEDVDLSSHQAAADDXELAARWREVHGSTNWEGLLDPIDGXLLQKLIRYGKFAQATYEASTTTVSPPNGGVASTRGKPFFTKLALGGSGNKGPRYLYATWKKPQVPQFWG

SEQ ID NO: 92007 - DNA, 943 bp, Zea mays
  misc_feature: Ceres CLONE 1580551
  misc_feature: Translation starting site: 249
  misc_feature: SWISSPROT Homolog: EC 1.1.1.22 UDP-glucose 6-dehydrogenase
ctctagaactagtggatcccccgggctgcaggaattcgtctcacccctagaaaaagacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctggctatgtcggtggcccaaccatggctgtcattgccctaaagtgcccagacattgaggttgtcgttgttgacatctccaagccccgcattgacgcatggaacagcgacaccctcccgatctacgagcccggcctcgatgatgtttgtgaagcattgcaggggcaggatactcttcttcagcactgaagttgagaagcacatccctgaggctgacatcatcttcgtctccgggaacacccccacctatacccgtggggcttggagctggctaaggctgccgacctcacctactgggagagcgctcgctcgtagtatcgcccaagttctccatagtctgaccaagatcgtttgtccaagaagtccaaccgtcccctgtccatgaaccccttaaggcttattgagaagattcgtgaacccacaaccgcaagggcattaagctaccagatccttctccaacccggagtttcttggcgagggcactgccctttgaggaccggttcagacccggaagattgctcatcgtggggccgggagacccccgagggtatgataaccgccaggctcccaagaatgggattgctccggggtccccaagaaaggttccccacccaacttgggtccctgattctcaagtccctgcaatggtttgtgccaagagatcctcttga

SEQ ID NO: 92008 - DNA, 839 bp, Zea mays
  misc_feature: Ceres CLONE 1580553
  misc_feature: Encodes the peptide sequence at SEQ ID NO. 92009
tggagctccccgcggtggcggccgctctagaactagtggatcccccgggctgcaggaattcgtctcacccctagaaaaagagcacgcgcccatggcgacgccgccggcggcggcgacggcgtccgcgcttcccaagtctggggcggtatccaagggctacaactttgcatccacttgggaacagagcgcgccgctcacggagcagcagaaggccgcgatcgccgcgctctcccacgccgtggcggagcggccattcccgcccaacctggaaaaaagttcagggaaggatgaaggcgtggctgttcccgagaaagaatctgctttggaggaggccggtgcaatagatgcagtcttggtgaatacacatcagttctacaagtggttttcagaactggagtcagctatgaaatctgagactgaggaaaaatatcgactttatgagaatacattacaggagcgtgttaacacatgtgacgtaatcctaaagcaggtttgatgatacattggagcttatttgaagaactgcagtctttgcactcaagcgttgcacgaagacaaaactttgcatgaggcttgcgaccaacttttggttgaaaaacaaagctgaatcaggttgcaaagggccttctaaacggggctaatttctttgtggaaattaaaaagggtttcaggcccctttttcttcccaaaaattaaacatggaaaaagaaaaattttctcccccttttaaaaaccccctagaaaaaaggacccccccgggtttaaaaaaaccccccaaaaagtggaaaaaccgcgggttttttttgggaaaaaaatttcgcccaataaaaaattggggg

SEQ ID NO: 92009 - protein, 134 aa, Zea mays
  misc_feature: Ceres CLONE 1580553
MATPPAAATASALPKSGAVSKGYNFASTWEQSAPLTEQQKAAIAALSHAVAERPFPPNLEKSSGKDEGVAVPEKESALEEAGAIDAVLVNTHQFYKWFSELESAMKSETEEKYRLYENTLQERVNTCDVILKQV

SEQ ID NO: 92010 - DNA, 1333 bp, Zea mays
  misc_feature: Ceres CLONE 1580554
  misc_feature (62)..(62): n is a, c, t, g, unknown, or other
  misc_feature (64)..(64): n is a, c, t, g, unknown, or other
  misc_feature (65)..(65): n is a, c, t, g, unknown, or other
  misc_feature (1035)..(1035): n is a, c, t, g, unknown, or other
tgcgtctttttgtcctcgtgcggccccacaccgcccattttttttcaccatataaaaaaatncnnccaaaagtggtactccccgcggtggcggccgctctacaatagtggatcccccgggctgcaggaattcgtctcacccctagaaaaaaggaagatccgcatctccagactacttgctgcgtgcgaacttcctgggtcgttcaatcttcctccagcaatcgcagtggcagcgcagggactcggacaggatgctggagtcaactgctaagtctgcaacttcgatcaatgactgcgctgctcccgcccatacgcagtgacccgtgctctccttctgcctggtgattgacatctcttttttgctcctttcggctatcgcacaactgaggtacgggactatgcttaacgcacattataatatgaaggcccggcgtgaattgtggatggcgtgcctccacgacggaggaccccccccccgtgctgtaggtgcagttctttagtttgcatacgcctccaggtaaagaaagtcatgggtcagcgtataaaccattactttctatgcactctcactgtccaggtttcgcatagacgagtctactgctacaattcagccacgtcgccaatgactctcgacggggatcagatttttaatccctctgtaagtgaatacatatcatgatttcgtttttacgggatggcttattattggacaacagtctctcggcttaaattataaaaattttattatagagtacacattgtggcggggcacttattttaccctcgttgcgactactctctcttatttttcgctctcttatagacataacgcagctcagtctccgcgttatatatgtccaccatacaggtagggcgcgctgtgtgactctcgtaacaaattaggatcccatcatcgcctgggaacacgtagatacggatgaaaatatttcgcccacgtggcctcccaatgtccctgtagcgcgcactctcatgctctctggcaggttgtgtccgcattatattggtctcactctcnattgtaaaccggcgacgacatcgattggtccatgctcccacgtgctctctgtatattaccatattactattcgtatgttcacccgtgttctgtatatataattcactctccaaccgcggcgtgaatattggagcttgaaaactcgaatattatgtccagcagctcttatacacctattgtaatccaataaggatcgagtatccgtgtcgtgagccgactgcgattaggtatctaccgcttgtacaccctttaaaattagatccgcaactattaactggctcttgtcacaacactctct

SEQ ID NO: 92011 - DNA, 1175 bp, Zea mays
  misc_feature: Ceres CLONE 1580555
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (61)..(61): n is a, c, t, g, unknown, or other
  misc_feature (243)..(243): n is a, c, t, g, unknown, or other
  misc_feature (1030)..(1030): n is a, c, t, g, unknown, or other
ttgaggttaancannnnttntcttttcccccaaatctcccttcctctcttctaaaaaaaanaccattctttaaaatatatacttaactccccacggtggcggccgctctataactaatgaatcccccgggctgtatgaattcgtctcacccctagaaaaaaccactgcggactgcaccacctgcccgtcgactactccgtttctcttcctagtacattgccgcctcaaacgcgatgtcctctncagcacctgcggattcctctcgcacgccatactcagcctactacgtcttcccctgtctagcagacaccctcttcccctctccactcccaatctgtatcatcccctccctctacgtctctgctgcctccacttcaccatggcgcttcattccccggtcctcattctgaaggactcactgaatcctggattctggcgcgaatgttcaccaatccaacatccatgccgccaatgctgtcactcacctcatacgcaccacatctgcgtcccagatccattgttgaaaatgcttctaatatcccaatggcaagtatttggggtttactaaatgaatcgtaccttgccattttccagagcaaaaaagatccttggcacaccgggtgggtgtcccaattccttaatgatccggaacctaacgatcagtaacatccctggcaatgcacaaaaaatgtttggggtgtgaaagggcctacttaaccattcattaagtcctatattgagttaggcgttagccctctcaaaacaggtatagtggtctacaccactatatcttatatccaagctccaggtcactggattccaatatgcgacccctaatggaaaagcgttacgcactagtcgcaaagcggttcttagattatctctccttggagcctctatttatttgctcaactatttattttttatcaaaggtaacagggcgttagatgggtgagggctaagcccttggacagtcaatagacttgggctccttggtgggcgggttcatggagagtggaacttagatctnttttacaggagcgggctcttaactcagttatgaacgtagtgtgtctgaccgctgagttgctttatttgtgcgttatccacaagatgattcttcgtggtcacacaacgtcataacatggcgtatgctatacaagtgtgccgacagg

SEQ ID NO: 92012 - DNA, 880 bp, Zea mays
  misc_feature: Ceres CLONE 1580557
  misc_feature: Encodes the peptide sequence at SEQ ID NO. 92013
  misc_feature (880)..(880): n is a, c, t, g, unknown, or other
ccccgcggtggcggccgctctagaactagtggatcccccgggctgcaggaattcgtctcacccctagaaaaacttcgcttccgctgtctccccgcgcctcccggatcgcctcggcgcgcgaaagatggcgtcccatattgttggataccctcgcatgggccccaagagggagctcaagtttgccttggagtctttctgggatgggaagagcagcgccgaggatttggagaaagttgccactgacctgaggtctagcatctggaagcaaatgtcagaagctgggatcaagtacattcccagcaataccttctcgtactacgaccaggttcttgataccacggccatgcttggcgctgtcccagagcgctactcttggactggaggcgagattggcttgagcacctacttctctatggccaggggaaatgccactgtccctgccatggagatgaccaagtggtttgatacaaactaccactttattgtccctgaacttggtccaagcaccaagttcacatacgcttctcacaagggctgtttctgagtacaaggaggcaaaggcgctcggcattgatacagtcccagtgcttgttgggaccagtctcatacttgctcctctcttagcctgccaagggtggtggagaaatcttttctctcttcttttcactttctgggtagcatttcttcccattctacaaagaaggtttgttggctgaacctgaaaggcagcctgggtggcttccatggaattcccggctttgagtgaaccctacccccttggttaaaagaacctttgaatgcctccacgaaatttggcccgccaatttctctcttcaagccctaatgcgcttgaaacctgggaaggtccattcctctcctn

SEQ ID NO: 92013 - protein, 139 aa, Zea mays
  misc_feature: Ceres CLONE 1580557
  misc_feature (2)..(140): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSSAEDLEKVATDLRSSIWKQMSEAGIKYIPSNTFSYYDQVLDTTAMLGAVPERYSWTGGEIGLSTYFSMARGNATVPAMEMTKWFDTNYHFIVPELGPSTKFTYASHKGCF

SEQ ID NO: 92014 - DNA, 841 bp, Zea mays
  misc_feature: Ceres CLONE 1580563
  misc_feature: SWISSPROT Homolog: EC 3.6.3.14 H(+)-transporting two-sector ATPase
  misc_feature (310)..(310): n is a, c, t, g, unknown, or other
  misc_feature (314)..(314): n is a, c, t, g, unknown, or other
  misc_feature (338)..(338): n is a, c, t, g, unknown, or other
  misc_feature (339)..(339): n is a, c, t, g, unknown, or other
  misc_feature (348)..(348): n is a, c, t, g, unknown, or other
  misc_feature (353)..(353): n is a, c, t, g, unknown, or other
  misc_feature (354)..(354): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (373)..(373): n is a, c, t, g, unknown, or other
  misc_feature (374)..(374): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (697)..(697): n is a, c, t, g, unknown, or other
  misc_feature (726)..(726): n is a, c, t, g, unknown, or other
  misc_feature (727)..(727): n is a, c, t, g, unknown, or other
  misc_feature (729)..(729): n is a, c, t, g, unknown, or other
  misc_feature (730)..(730): n is a, c, t, g, unknown, or other
ctccccgcggtggcggccgctctagaactagtggatcccccgggctgcaggaattcgtctcacccctagaaaaagcaaacacgcaaaacgtgcttctgtccctctcctgttataatttcgtcttcttccctctcccaccggtgtcctcgcctcgcctatccgatctgccacctcgccgtctcgcacgttcctttccccaactccccagcgcctctccgcgccgcgatccagatccaggttgttcagcatgggtctggtgaaggaaggcgtcgacatggaggagggaaccctagagatcggcatggagtancagngactggtatctggtgtggccgggnncctctgggnttttnnannnnnnnnnnnnnnnttnnggggggggnnnnttttttaaaaaaaaagggtttttaaaaaaaaagagggggggcccacaaagttccccaaaaaaaattggtaaaacatcccgaaacttggaaaaaaggggcccccccccccccccgggggggcaaaaacccctcttgaaatttttaaggggaaaaaaaaaaccgggtttggtggaagggggtttttgtaagagaaaaaaaactcctgggggggaatttgcaaacacacaatttttccccccccccccgggggcggggggtttgttttcaaagcgggcggggggaggggttttttttaaaaaaaaaaaaaaaanaccccccggggggtgggtgttccacccanntnncccccataaaaaatatattttttgggggggggggcggccctttttttttttatataaagaaggggggccccggggaggaaaaaaacaaaaacctctttttgtgtggggggg

SEQ ID NO: 92015 - DNA, 763 bp, Zea mays
  misc_feature: Ceres CLONE 1580564
  misc_feature: Encodes the peptide sequence at SEQ ID NO. 92016
  misc_feature (307)..(307): n is a, c, t, g, unknown, or other
  misc_feature (371)..(371): n is a, c, t, g, unknown, or other
  misc_feature (398)..(398): n is a, c, t, g, unknown, or other
gagctccccgcggtggcggccgctctagaactagtggatcccccgggctgcaggaattcgtctcacccctagaaaaaaacctgttggaagagctttggataaatatcttgagcagctgcctcactgggtttggctttcatggatacctcagttgttgttgtcgttacagagaagtgaagcccaacactgtaaattggttttgatgaagatagctcaagtttacccgcaggcattgtattattggcttcgtacatacttgatggaacgccgtgatgttgctactaaaactgaaataggaagaaacatngttgctcagcagcgcatgcagcaagctatgatggcaaacaatgcggccaataacttacctgacngaagtgcaagggcatctaatcatgcangtagtaacatgacttctgacaaccagtctcatcaagccttccatcagttgggggctgcagggtcccatgaaggggggaaaagtccaaggaaaaaatccggaaacaatttaccccctgaaggggggccaaatacccagcccttattcaagggcaaaaaaaatttttcaaggggtgcctaagggggccccaaaaattcccccctttaaaccaaaaataccgccaaaaaaggggggggggggaaaaattttccccccccccaaagggggatattttttgaggcgccccgcaaaaaaaaaaattaataggggggggggggctcttttttataaaaaaaaaacaaccatttttttttattttttctcgcg

SEQ ID NO: 92016 - protein, 124 aa, Zea mays
  misc_feature: Ceres CLONE 1580564
  misc_feature (35)..(35): Xaa is any aa, unknown, or other
  misc_feature (57)..(57): Xaa is any aa, unknown, or other
  misc_feature (66)..(66): Xaa is any aa, unknown, or other
MKIAQVYPQALYYWLRTYLMERRDVATKTEIGRNXVAQQRMQQAMMANNAANNLPDXSARASNHAXSNMTSDNQSHQAFHQLGAAGSHEGGKSPRKKSGNNLPPEGGPNTQPLFKGKKNFSRGA

SEQ ID NO: 92017 - DNA, 826 bp, Zea mays
  misc_feature: Ceres CLONE 1580567
  misc_feature: Encodes the peptide sequence at SEQ ID NO. 92018
ggagctccccgcggtggcggccgctctagaactagtggatcccccgggctgcaggaattcgtctcacccctagaaaaactcgtccacccattcctccgctcttccttaattcctcatttcctccacgtacgcgtgcatactctgcgagtccaggagatttttttccccttcttcacgatactctcgacgagagtgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacacgtctgtgcagagtgacgccaagctatggcctttcaaagtgatcccgggctccggcgacaagcccatgatcggggtgcagttcaggggcgaggagaaacagttctcggccgaggagatcagctccatgatcctgaacaagatgaaggagacggccgaggcttacctcggcaccaccatcaagaacgctgtcgtcacccgtccggccctacttcaacgactccccagcggccagggcaccaagggaaccccgggggtaatttcccgggccccaaaaggttgggggggttttttaaaaaaaagcccccccccgcgcggggggaacaaaataaaggggggggccaaaaaaaatttacccccccgcggcgaaaaaaaact

SEQ ID NO: 92018 - protein, 208 aa, Zea mays
  misc_feature: Ceres CLONE 1580567
  misc_feature (9)..(208): Pfam Name: HSP70 Pfam Description: Hsp70 protein
MAGKGDGPAIGIDLGTTYSCVGVWQHDRVEIIANDQGNRTTPSYVAFTDSERLVGDAAKNQVAMNPINTVFDAKRLIGRRFSDTSVQSDAKLWPFKVIPGSGDKPMIGVQFRGEEKQFSAEEISSMILNKMKETAEAYLGTTIKNAVVTRPALLQRLPSGQGTKGTPGVISRAPKGWGGFLKKSPPPRGGNKIKGGAKKNLPPRGEKK

SEQ ID NO: 92019 - DNA, 969 bp, Zea mays
  misc_feature: Ceres CLONE 1580570
  misc_feature: Encodes the peptide sequence at SEQ ID NO. 92020
  misc_feature (713)..(713): n is a, c, t, g, unknown, or other
  misc_feature (737)..(737): n is a, c, t, g, unknown, or other
  misc_feature (843)..(843): n is a, c, t, g, unknown, or other
  misc_feature (865)..(865): n is a, c, t, g, unknown, or other
  misc_feature (888)..(888): n is a, c, t, g, unknown, or other
  misc_feature (926)..(926): n is a, c, t, g, unknown, or other
  misc_feature (927)..(927): n is a, c, t, g, unknown, or other
ctccccgcggtggcggccgctctagaactagtggatcccccgggctgcaggaattcgtctcacccctagaaaaaaaacaaaacaccaacctttagcaccaggcaaaccaaacactaggccaacgcaattctctagagcactgtaggctctagttctccagaggcccgccacaaccacaagccaaggccacagccagtgccctcgccatggctcccaacctcagcaagaagacgcctgctggcctcctcggcgacgaggtggccccggtggagggactcaagccgtcgcggttcacccttaagggcaaggacctggccgtggacgggcacccggtcctgctggacgtgccggccaacatccgtctcaccccggcgtcgacgctcgtgcccgccgcggacgtccccgcagcgggcggcggcagcttcctcggcttcgacgcggcggcggccgagagccggcacgtggtgcccgtcggaaagctccgtgacattcggttcatgagcatcttccgtttcaaggtgtggtggacgacgcactgggtgggggacagcggcagggacgtggagaacgagacgcagatgatggtgctcgaccgctccgccggcgagcccgtcggcggcggccgaccctacgtgctgctgctccccatcatcgagggctcgttccgggcctgcctcgaggccgggaaggtggaagactacgtggacctgtgncgtgagagcgggtcgtctgcggtngcgcgcgccgcgttccggagctcgctgtacctgcacgcgggcgacgacccgttcgagctcgtcgcggagcccgtcagggtgtccgcgcgcacctggtcacgttccngaccatggtagagatacgccgncgcccatcgtggacaagtcgggntgtgcacgtgggacgcctctactcagtgcacgaagggnntcttttgagaagggtggccccccctgggggagggggctgccc

SEQ ID NO: 92020 - protein, 215 aa, Zea mays
  misc_feature: Ceres CLONE 1580570
  misc_feature: SWISSPROT Homolog: EC 2.4.1.67 Galactinol--raffinose galactosyltransferase
  misc_feature (169)..(169): Xaa is any aa, unknown, or other
  misc_feature (213)..(213): Xaa is any aa, unknown, or other
MAPNLSKKTPAGLLGDEVAPVEGLKPSRFTLKGKDLAVDGHPVLLDVPANIRLTPASTLVPAADVPAAGGGSFLGFDAAAAESRHVVPVGKLRDIRFMSIFRFKVWWTTHWVGDSGRDVENETQMMVLDRSAGEPVGGGRPYVLLLPIIEGSFRACLEAGKVEDYVDLXRESGSSAVARAAFRSSLYLHAGDDPFELVAEPVRVSARTWSRSXPW

SEQ ID NO: 92021 - DNA, 960 bp, Zea mays
  misc_feature: Ceres CLONE 1580573
  misc_feature: Encodes the peptide sequence at SEQ ID NO. 92022
  misc_feature (771)..(771): n is a, c, t, g, unknown, or other
  misc_feature (836)..(836): n is a, c, t, g, unknown, or other
  misc_feature (845)..(845): n is a, c, t, g, unknown, or other
  misc_feature (848)..(848): n is a, c, t, g, unknown, or other
  misc_feature (858)..(858): n is a, c, t, g, unknown, or other
  misc_feature (862)..(862): n is a, c, t, g, unknown, or other
  misc_feature (883)..(883): n is a, c, t, g, unknown, or other
ctccccgcggtggcggccgctctagaactagtggatcccccgggctgcaggaattcgtctcacccctagaaaaatctcggcctgccggcgcggcggcctcacctccacccgccccgtcccgttttgacggccctttctcccctctcctccgcgagcgccgccgcagtagaacccggtggtaacccactgccgcaagcatcccaccgcgccgagctacgcgacggacgcggcgcgcggcccacaacccaaccgcagcggcaacaaccgctctataaagcaatccccccacctaccggctccgcggcctcgctcgcttcgctttcccccaaatccaccgcgggctcgagctcggaggagaggagacgagacgacccaagactttctcacccccctttgcttcctgcgcaattcctgcggcagcgcctttctctctttcaatggacagcgactacgttgccagcctgctcatgggcatgggctcatccgcccctgcgctcgacttcgccgcgctggacgccgggttcctcgaaacgctctgcggcggcggcggcggcctcttcggggtgtccggggtcgccgcgggggccgggtgtggcggcgtgtccccggaggggtcgtcggtgtccgacccggcgtgggcgcgcgccagggacgatgacaatgtcaggaagcgcaaggagccgcccacggggtccgccggcggcaatgaagcctgcccgggcaaggtgcggaaacgaccagcgcagactggattctgcagataccgagcgnctcgaatttagcttgctgggtcttgatgcgctggtgccgttctgaatattggtttgcaggctgcngaagccaanggntccggacggnaatnaagtgcatagtgggccggcancaacagcccgttgaatcctaaagtataagaagtgggcggtaaccaacccctcggttgtactcaaagggcagaagaag

SEQ ID NO: 92022 - protein, 114 aa, Zea mays
  misc_feature: Ceres CLONE 1580573
  misc_feature (112)..(112): Xaa is any aa, unknown, or other
MDSDYVASLLMGMGSSAPALDFAALDAGFLETLCGGGGGLFGVSGVAAGAGCGGVSPEGSSVSDPAWARARDDDNVRKRKEPPTGSAGGNEACPGKVRKRPAQTGFCRYRAXRI

SEQ ID NO: 92023 - DNA, 835 bp, Zea mays
  misc_feature: Ceres CLONE 1580575
  misc_feature: Encodes the peptide sequence at SEQ ID NO. 92024
ctccccgcggtggcggccgctctagaactagtggatcccccgggctgcaggaattcgtctcacccctagaaaaaatcaagctaggcaggcctggtcccgaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggccgggcagctcttcttcggctggctgggcgacaagctggggcgcaagagcgtgtacgggatgacgctcatggtcatggtcatctgctccgtcgcgtcgggtctctcgttcggcacacccccacggggggtatggccacgctctggctcttcgccttctggttcggctccgggatcggcgggaaatacccgcttgtcggccccattcagtgtcgagtacccccacaaaaggaccgggggggcctttatgcccccggttttcgccatgggaggggttggggatccctcccccgggggatttgttacgcttttttttccccccgcccttcccccgggggggaccccttcccccgggggttaggggaaaacactatttcccccccccgggtgccgaggggcaaaaatgggggggggggggggtatctaatatttttgctcccc

SEQ ID NO: 92024 - protein, 203 aa, Zea mays
  misc_feature: Ceres CLONE 1580575
MARGGDGLQVLSALDAAKTQWYHFTAIIVAGMGFFTDAYDLFCISLVTKLLGRIYYTDTSKDSPGSLPPNVAAAVNGVAFCGTLAGQLFFGWLGDKLGRKSVYGMTLMVMVICSVASGLSFGTPPRGVWPRSGSSPSGSAPGSAGNTRLSAPFSVEYPHKRTGGAFMPPVFAMGGVGDPSPGGFVTLFFPPALPPGGTPSPGG

SEQ ID NO: 92025 - DNA, 877 bp, Zea mays
  misc_feature: Ceres CLONE 1580576
  misc_feature (772)..(772): n is a, c, t, g, unknown, or other
  misc_feature (858)..(858): n is a, c, t, g, unknown, or other
  misc_feature (863)..(863): n is a, c, t, g, unknown, or other
ctggagctccccgcggtggcggccgctctagaactagtggatcccccgggctgcaggaattcgtctcacccctagaaaaaaccgaacacaatctcatccgtcttcctcttccccatcggccgccctaccgagtcttcgcacgcacgacgcttcgtcaggatcgattcgcgagacctctcctgtccggatcgaggttcatggtttacatatgcgcgtttgtttactgatgcataccacaaccacctgatccggatgtcacgacagatctcctgctttaatccagtccacttcatgtatgaactctcccttttcctggcacattgctagatgtaaaagggtgttccgggatttaacataaccacccacgcatccatgtctgaccagcagaggcactacagcagctacgagctcctcccggctcacccagatttagcggtgcctggtctgcacgcggccgttcactcttgacgccgaggtcaccgacagcttggaagctttagccatatgcagggagtgcaagactactgtgcttagtgacagcaacagggacgacactccccgagccaaccgacagagagatggcgaacgcagcaaagctccatcacgggggtctcggtgttctcgcagctgatcaacctagctagacaacagggtcatgaggcggacactgattctgcgacggttccccgccgccacacatcctatagttctacgccgagccggacccagagggggcacacttccgactacgagagcgatggtctgagctacnccgattcgatgtctggtcagatcgagtcacacatcagttctggtgattaagagtagcgtatctgacacttctcttgatcgccacancatgnttggggagggaatt

SEQ ID NO: 92026 - DNA, 895 bp, Zea mays
  misc_feature: Ceres CLONE 1580577
  misc_feature (588)..(588): n is a, c, t, g, unknown, or other
  misc_feature (895)..(895): n is a, c, t, g, unknown, or other
aaagctggagctccccgcggtggcggccgctctatactagtgtatcccccggctgcgggagttcttctcacccctagagatatttgacagctaagttgaggcggcaagggcttatgacaaggctgcccttcgcttcaatgggagggaagctgttactaactttgagcctagctcctacaatgcaggagataataacctgcgtgacacccaaaccgacgcaattgatgatggtgatgccattgatttggatttgcgcatttcacagcctaatgtgcaagaccccaaaagggacaataccttagctggcctccagccaacatgtgattcccctgaatctgcaaatacgatggcttctcagccaatgagctcatcatccccatggcccgggtatcaccaaaacccagcagtgtcatttcaccatcagcgcttgtactcctcaacttgtcatggcttctttccgaaccaccaggtccaggaaaggccggtggagccaaagcctgagctggggcgcccagccattcccctcatgggcatggcaagcgcagggctcccctcacgtgctgttgcaccactctgcagcatcaatanggatctctaccgccgccgggggccaacgcggcatgcccctgcccgtctcacccgtcgggcgcagtttccccactactgcaaaccccgtttcttcttccccctaaaaccgctttttgacatgaacaactttgctggttcccgggctacaacctcttcgggcgccttgggagatgggcaacttgggccctttgccttgttgggcgatcttagccaagctcctctggggggatggggaagaataaaggcgaattttgtggcgtttctcaaaagttgggttgtgtgcgtattttggaaaaaaaaaagaagn

SEQ ID NO: 92027 - DNA, 823 bp, Zea mays
  misc_feature: Ceres CLONE 1580581
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
ctggagctcaccgcggtggcggccgctctagaactagtggatcccccgggctgcaggaattcgtctcacccctagaaaaattccaaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcaaatcccgtcaaaaggccaatgcactttccgtacccctggagacgactctggatttcgggccatggaagtgctcttttcccatgactgggggaaagaaatccctccttttttgaaagcaggctgtgaaaagaaacgaaatcactttgacctgtgatttggttactctaggcctctctaccatttactctgctacctgagtgatgatgcaactgcgcagactgttcgtgttgctgtgaagctccaaaggatcagagttctgtcaagatggcatgcccaagaggaaggacaccatttcccctttgtttctttctgatgatttgcctcatggctcagctgggagcttccagtgactggaacctgtgagagatcagataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 92028 - DNA, 1241 bp, Zea mays
  misc_feature: Ceres CLONE 1580585
  misc_feature (18)..(18): n is a, c, t, g, unknown, or other
  misc_feature (72)..(72): n is a, c, t, g, unknown, or other
  misc_feature (1241)..(1241): n is a, c, t, g, unknown, or other
gccgctttcggcttcccnttcttcctattatgtgtgttttatcccttgccgcgtttttttgtgccccccggnaatataaaaagctggagctccccgcggtggcggccgctctagaactagtggatcccccgggctgcaggaattcgtctcaccctaaaaaaagtgcacccgtacgtctccatacctccctccttccctcccccctcttcttttcttcggctcttccgccgcctccactcggcctacgccacctccccctcacctcccgccgtgcgccccgatccctcgccgcgacctcatctcgccgaggactggatcgcctgagggacatcatgggtgggtgggtgtgtccttcgcacccatgcggtattagctgatgacaaactcgcctgaaaagggagaaggagcacctgctccgccacgctaattcccgtgcaatgaacccgctccatctgcggccggtcgatagcctctaacctcccccccgcgtcccaatcacaaagaaaaaagggttgtctcccgggctaggccaaaaggcatcctgttcccggtttcagaaggtcttacaacccccccctagctgaaaaaaaaattaattagaggggccatctcaaatagcgagctccctaacacagaaacattgagcgaaggtcacatggttttcgaaaaaaaaataacaatccccttgtggggggatacaacaaaggactctctgggttgcccaaggaaatatttaccccaaaaggaaacgagggttttatattaggtggactcccactttgtagtcgcgcagccacacgacagagtgggatgagatgcacatcattctagaaaggggtctatctcttgaatcttatcagagagcggtctgcccctgagaatttcctcccgcccacatctattatcgctttttttccgatcttcttctcctcctggaggttatatataggttcctctctccactggggggcgcaattcttgtattcttctgagagtacaaaaatataacaacctcccccttggacagtaatcttccccgccacccttctttatacaccacccacctttccccgctgcgtcgggcagactgtatatagtggggaaacgaatatattacatgcgttacacaccagaaaaaacaatgggaaaatacaatacttcttgcgtcccccaccaggaggtttgttggaaagtgacaaaaacctctcgtacgagacggacgagcgaaccccttcagtggn

SEQ ID NO: 92029 - DNA, 881 bp, Zea mays
  misc_feature: Ceres CLONE 1580586
  misc_feature: Encodes the peptide sequence at SEQ ID NO. 92030
ctcaccgcggtggcggccgctctagaactagtggatcccccgggctgcaggaattcgtctcacccctagaaaaaattccaaatcctcctctgcaattttctcatggcagctgacgtttccatcccaactcgatccgcgtcaaccgcccgctaattcctcctagttctagtcccctctctcctgcgccgactcatctttttcctcgtgtcactcccctgctgctgctgctgccgggaagatcaaatcccgtcaaaaggccaatgcactttccgtacccctggagacgactctggatttcgggccatggaagtgctcttttcccatgactgggggaaagaaatccctccttttttgaaagcaggctgtgaaaagaaacgaaatcactttgacctgtgatttggttactctaggcctctctaccatttactctgctacctgagtgatgatgcaactgcgcagactgttcgtgttgctgtgaagctccaaaggatcagagttctgtcaagatggcattgcccaagaggaaggacacccatttcccctttgtttctttctgatggatttgcctcatgggctcagctggggagcttccaatgttggtactcatggcgaacaaacactacctttgtcctttggatgaaggccaagggcaacttttttactcccgccaatgggaaagggtcaaggggtaagggggcggttcctttttgcttggggaaacctaaagagatcactgggaggccctttgtggaagcgaaaatcgcaattccaaggggtctttgtccccaccctttttggcggttgagatttaaaaagaaggggggtgtgcccaaatttttggaggtgccacaatatttttgaaataagggccccgcgaatgt

SEQ ID NO: 92030 - protein, 30 aa, Zea mays
  misc_feature: Ceres CLONE 1580586
MEVLFSHDWGKEIPPFLKAGCEKKRNHFDL

SEQ ID NO: 92031 - DNA, 837 bp, Zea mays
  misc_feature: Ceres CLONE 1580589
  misc_feature: Encodes the peptide sequence at SEQ ID NO. 92032
ctggagctcaccgcggtggcggccgctctagaactagtggatcccccgggctgcaggaattcgtctcaccctagaaaaagatgcacccgtacgtctccatccctccctccctccctcccccctcttcttttcttcggctcttccgccgcctccacgcggcctacgccacctccccctcacctcccgccgtgcgccccgatccctcgccgcgacctcatctcgccgaggactggatcgccggagggacatcgtgggtgggtgggtgtgtccttcgcacccatgcggcgttagctgatgacgacctcgcctgagaggggagaagcaccacctgcgccgccacgcgattcaccgtgcgaggacgccgccccagctgccgccgtcgttgcctcttcctcctctggctccgagcgcgaggaagacggcggctccaggcagcccaaggcatctgtcctgtccggcgtcttcgcgccccctctcgccatattcgaggggcagcagcaggtctcctcgacgccgtgcgacgccagctcgacaaagccgccctcggggtcctatgcttggtccaggattctgaggaggttcgtgggcagcggctccatgtggcgtcttctgggctgcgccagggtcctgacctccggtgacgtgtggttccttggtaaatgctacagggtgtcgcccgaggaagaggagtctggcggctcggattctgacagcggccatgctgcgtttctggaagatttctcttccaggatatggatcactttacggaaagggtttgatgcaatacctgggttccagctcactagtgatgtgaactggggatgcatgggtaagaac

SEQ ID NO: 92032 - protein, 181 aa, Zea mays
  misc_feature: Ceres CLONE 1580589
MTTSPERGEAPPAPPRDSPCEDAAPAAAVVASSSSGSEREEDGGSRQPKASVLSGVFAPPLAIFEGQQQVSSTPCDASSTKPPSGSYAWSRILRRFVGSGSMWRLLGCARVLTSGDVWFLGKCYRVSPEEEESGGSDSDSGHAAFLEDFSSRIWITLRKGFDAIPGFQLTSDVNWGCMGKN

SEQ ID NO: 92033 - DNA, 937 bp, Zea mays
  misc_feature: Ceres CLONE 1580594
  misc_feature: Encodes the peptide sequence at SEQ ID NO. 92034
  misc_feature (657)..(657): n is a, c, t, g, unknown, or other
ctccccgcggtggcggccgctctagaactagtggatcccccgggctgcaggaattcgtctcacccctagaaaaagttaaaccctcgcctttccgccgcccgtcgcttcccccaaactatcgtgttcaccaccgacggcggcggcgaaacaccttgtcgccctctaccgaaatcccagcccaagcgtgagcgcccgctccccaccagtcaccatggcgccgcgctcccgcaagcgggcttcgcgccccaagccccgcccaggctcccgacgtggtggcggcggaggggacgacgaccccttcttcgagtccgcgcccaagcgccgccgcggggaccgtgacgaggacatagagagcgaggacagcgacgacgacggcgtggctgcgcttggccgcggatttgatgaggatggggacgagggcggtaaggaggatgaggacgaggaaacggtgggggagaagaagatgcggatagcgaaggagtggctgaagaaggtcactgaagtcgctaagagggggcaggaggatgacgatgaggatgagaacgtgtcgggagggagacgggtggcggagatcctgcagagaaagcagctcgaggagagcggcaggaagcggcgggagattgccgcgagggtattaccaccagccctcaggagggntttaagttcttgtgagcaccggcaacctgttactgctgttgctttatccaggatagggataaggggtttccggatcaaaagaggaatcttaggcatggggatgtgaaacgggaaaagtgagaataatatgcccaatgaaaaagtgtggtttccctccgctaaccgccgtttagctaaagaacaaacagtgcgggcttactgcaattcgaaggtcgttactgggaaagggggttggacggccattcctttagggaatatggcagaggacaaaaggcttttg

SEQ ID NO: 92034 - protein, 183 aa, Zea mays
  misc_feature: Ceres CLONE 1580594
  misc_feature (149)..(149): Xaa is any aa, unknown, or other
MAPRSRKRASRPKPRPGSRRGGGGGDDDPFFESAPKRRRGDRDEDIESEDSDDDGVAALGRGFDEDGDEGGKEDEDEETVGEKKMRIAKEWLKKVTEVAKRGQEDDDEDENVSGGRRVAEILQRKQLEESGRKRREIAARVLPPALRRXLSSCEHRQPVTAVALSRIGIRGFRIKRGILGMGM

SEQ ID NO: 92035 - DNA, 900 bp, Zea mays
  misc_feature: Ceres CLONE 1580595
  misc_feature: Encodes the peptide sequence at SEQ ID NO. 92036
ctcaccgcggtggcggccgctctagaactagtggatcccccgggctgctggaattcgtctcacccctagaaaaactcacggtcctcacctcactccaccaagttcgccgcctcgctgccgcgtcaggccagcgcgtgcgggcgggcgtgagtgactggctctcctcggcgcgcggacccaggggcggcggcgatggggaagaatatgcgcatgaagacggcgcccaaagcgaaccgtgtccccctcctcggcgacggggagacgtcgagggcgctctcggacctggaagagggcagcgacgtccagccagcgaacgtcggcttctgtcgggtcatcaaacttgcgaagcatgacgccgcgaaagctggtcctcggcaccgcggagctgctctacccccccgtgcagtaaccttctcgttccccaatatggtggcaagataactgacattggggccaagagatgttcgggcgcccacaagataaggggcaaaccctgcagggatgtcaaggggcacatttttgtaccattgtgaacaaccccctttagacggggtacattttgcaagggctccttcggggcatgggctatttccaaattcgtgcgaagggagaataactcgttccccccggattttagggaagaggcttgggtttacacacttcagcttaagaacaggggaaatttagcgttgttccagaaaattggagttccacccgagcaagaaacatctttaagactggcgttttccttgaggaacaacagggggcctccccagggatgcgcccgccctaacacccagactttatttcttagtggccttctgccaaatgtttgatcctccccgtggggccttttgtgggtgtcgagggtgaaaccggttttttaaagatgttacggag

SEQ ID NO: 92036 - protein, 82 aa, Zea mays
  misc_feature: Ceres CLONE 1580595
MGKNMRMKTAPKANRVPLLGDGETSRALSDLEEGSDVQPANVGFCRVIKLAKHDAAKAGPRHRGAALPPRAVTFSFPNMVAR

SEQ ID NO: 92037 - DNA, 1268 bp, Zea mays
  misc_feature: Ceres CLONE 1580596
  misc_feature: Encodes the peptide sequence at SEQ ID NO. 92038
  misc_feature (67)..(67): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
cccggctgggataccctggacaatatatttttaaattattcattgaacccttggcggcggcgccttnttnnnnnnngnnnccaaagctggaactccccgcggtggcggccgctctagaatagtggatcccccgggctgcttgaattcgtctcacccctagaaaaaacaagcgcaagcatggcatgaaaactccgcaagccactctgctcgagttggatggccttcttcttggaccgcgtgtgcatcctcatcttgctagccatccgctcctacgtcccgtacactcgctggaacaaggcgaaaggccgctccgaccgccatgcgaggtctgctcccttgaacctgcctcctggactccatgggctgcccttaacttagaaagactctctagctttactcgcaggaccccagcgtcttcttcacttccaagcagaacagggacggccgagatcttcaagactcgcctttctgtggctgcccgttacgatgaccctcgtctagccctgtagggcagcgcgagttccgtgactcgccgaccccgattcgccatcctgattacacgccctatcctaacccgcacgtattcaagggtttcgccaattattcacgcgccccggtcgggcatcttcctttccttcacaacaccggctccagaccttatcaaaccatggcgaccaatgcgcgcaaaagatccttcactctccagggggtgcgttcgccctcccgagtttctctccggaaaccggcggggtctgtccccgccctatctagttatggcgcggttttcgcgctggcgaaattgtttggaagaaagagggcctccgtcgcccccgcgattatagactggatattcccccacccatttcacgtctcggccttccgcccaccactagatagataacaccatctcgatgcgaccccaaatcagtcttctgtgcctcccattattttatactgtgttactcacagagcgaaaactctcgcgtgttatatatgtaccgcgcccgtgaagttagaattacttccggcaaccacagtgggtatatgcaaactccccgcgcgcgaatatgattgccccgccctctcacacagcgcgtctcgtttcactccgcacataatgaactcgggatctggcgatagagggccgacccaatgttcttgcagacggtatcgcgaaactttttttttgcattggagtcgggttttatggaaatgtgggaagaacgcaaactaatgcgcgctggccgtaattaccgtgcaccttacgt

SEQ ID NO: 92038 - protein, 53 aa, Zea mays
  misc_feature: Ceres CLONE 1580596
MAFFLDRVCILILLAIRSYVPYTRWNKAKGRSDRHARSAPLNLPPGLHGLPLT

SEQ ID NO: 92039 - DNA, 806 bp, Zea mays
  misc_feature: Ceres CLONE 1580602
  misc_feature: Encodes the peptide sequence at SEQ ID NO. 92040
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
ctccccgcggtggcggccgctctagaatagtggatcccccgggctgcaggaattcgtctcacccctagaaaaactcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacaagcctatccgggtgatgtattcaaaccgtgatccaagcagccgcaggagtggatctgctaacattttcataaaaaatcttgacaagacaatagacaataaaacccttcatgagaccttttcttcatttggtaccattctctcgtgtaaggtagccgtggatgaagcagggcatcaaaaggctttggtttttgtcagtatgacaaagagaagctgcggcgannnnnnnnnnnn

SEQ ID NO: 92040 - protein, 175 aa, Zea mays
  misc_feature: Ceres CLONE 1580602
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNKPIRVMYSNRDPSSRRSGSANIFIKNLDKTIDNKTLHETFSSFGTILSCKVAVDEAGHQKALVFVSMTKRSCG

SEQ ID NO: 92041 - DNA, 1164 bp, Zea mays
  misc_feature: Ceres CLONE 1580607
  misc_feature (58)..(58): n is a, c, t, g, unknown, or other
tttgttattgtggttttgcaaatgacggaggaacagcaacccgccgagacccaaaaanttttaaaaaggggggaaaactggaactccccgcggtggcggccgctctagaactagtggatcccccgggctgcaggaattcgtctcacccctagaaaaattcaaggcttcaagcttcatgctttgtcggccccggcccgcccccctatggctcagccaactgctggagtggtagtggttgcttcctctctcttctcacgtcaccatgatcgataagactagctagaatataggtggctggcattggcagtggcagtggcagcgctatccaatatagtgccccccggccggtgtgctcgcgtcgggagctagccttggaagaagaagcatagagcagagacgccgttgcgtatagggaggaggagtgcttcttcgttcatcgttgcccaaagcagcagcagccacttggaattggaccacacccgcacctagagctgccggccggccggccagacctctgttttgtaacggcaggcagcactcagctctcaatctgttccaagccaaacccaatttaaaaagcagcccatcagttctggttcacaacttcaaaacagaccagggcctgaaacccgaaacccggcccaaaaggtaaatcctgtccatccgaacccggcccttgggacaaagaaagccgaagttgaaagcaaaacccctattgaagccaagggaaagccccaccttaccctttttggggcaattttttgcccaggacctggggcggcggccaaaggcaagaggtttttctccaaacaaatggaaaccgggcacgcggttaaaaatctcttacctcaagagaaaacacccccgactatatttgtaaatgggtctgtaacccgcgagggaataccctaacctgggtataccggttgggtgccccccttaattctcacttcggaaatgatagggcacctcgggtgatgtcctcccatggagaaaattggatttgtacctccattacacagagctttttcttaccttatcaccccgcacaccacccatgatttgagaacaaaaactaccgacccccacccgtgcgcttataaaaaactatacaacgccaagaaagggtttcccgggctccccggacataaataaaatctctca

SEQ ID NO: 92042 - DNA, 927 bp, Zea mays
  misc_feature: Ceres CLONE 1580608
aagctggagctccccgcggtggcggccgctctagaactagtggatcccccgggctgcaggaattcgtctcacccctagaaaaattccctgcccccggtgagctgccactgccagcttccccgtgcgcgagctgtgctgctgctcggcggcgcgcccactccccggccgctctctcgtcaccccgcctgccggtaatcggtctctatatatataggtggttcgaggtgatcggcagaaccacacaggcaaagatggcgagcgtgcacaaggccaccacccttgttctcatgttctgcctgctagcgctggggagagcggagtacctcaagtacaaggaccccgaagcagccccgtccgctgtttcgccattcaaaggaaccccggcccgggggccccgaaaaaaaaacccctccgcctgtaaaaaaaaaaatcccccccccaaaaaatttaccccaaaataaattggcggggggggggggaaaaaaagggcctccccctgggggccccaaaaacaccccctgggggaaaaaaaaaaaaaatttctttctttaagaaaagaatatccaccggtgcttttcttattaaaaaaggcggggggagagaaaaaaaaaaaaaaaaatcgctgccacctccgcctctcccttttcccccccccaccaccagagcgaagggttcttttcttccctctccctctcagaaattgggttgtgggggggggcggccccccccccctttttggtgtgggggcagccccctcaaacgtatttatgtaaaaaaggagaggggggggcgggccctaccctctttttttatttaacaacaaaacgaggacaaaaagtgggggggggggggataaccacaaaaaagggagattatccttctcatataaagatttaaggatcgtatatataatggtgggggggagaa

SEQ ID NO: 92043 - DNA, 841 bp, Zea mays
  misc_feature: Ceres CLONE 1580612
  misc_feature: Encodes the peptide sequence at SEQ ID NO. 92044
ctccccgcggtggcggccgctctagaactagtggatcccccgggctgcaggaattcgtctcacccctagaaaaaacacagccgccgccgttttttcgccatccaccttcgtctttctcgcactgcgcaaccgcatctaggcgatctgcgcccgcacgacggtgttccgcgccgccgcaggctcctactacgatgagttcatctgcctccgccgacccctcctcccgcctccactatggcagcacgtccctcaaagccgacaatatgatggcgagctcacctgggcgctcgcgaaccgcttctagggcatcggttccttctttgctccggcgacgcttggaggcagaggtgttctgtgtcggccagatctgggcgagatcggggcgagatggccctgcacatgatttagcgacggtcgtggacgacacgcccgcgtgtgcctcgcttgctttgctgtaacaggggcaatggggtctcgcccatcggcttcccgtgatgctgctaggggtggaaaagcgtcccagggggcaggaccgtggcccccttggaggaaaagaaccgcgtggggggcaactacaaacctggggttaaaggccccccctaattccggtgggcgggaaaataagggcccctggcttaaaggcccgcccttaatccggggcccccccaacgggggggccccaaaaattgcctttcccctgtttaaaaggggggggggaaggccccctgtggaaaaaaaaaaaacaaaaatgtgtgttgtgggggagacacccccttccaaagatttccccctccccccctgggaaaaaacacaaggggggcccttggcgggggggggaaca

SEQ ID NO: 92044 - protein, 88 aa, Zea mays
  misc_feature: Ceres CLONE 1580612
MSSSASADPSSRLHYGSTSLKADNMMASSPGRSRTASRASVPSLLRRRLEAEVFCVGQIWARSGRDGPAHDLATVVDDTPACASLALL

SEQ ID NO: 92045 - DNA, 845 bp, Zea mays
  misc_feature: Ceres CLONE 1580615
  misc_feature: Translation starting site: 352
ctggagctcaccgcggtggcggccgctctataactagtggatcccccgggctgcaggaattcgtctcacccctagaaaaaagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccgggtcaccacatcggcgacgagctgcatcactctgggctggaactcctgcagctcctgccacggtgacccatcggccaagcgccgcttcctgatcctgccttccttgctgtcaaggcggggtgtatgttcgtcgacacagcgacagaacccaagggcgcccatccttggattaaggggggttgaaacctgaaggaaatgtggctgagaaaaactggggccttggggtttcccca

SEQ ID NO: 92046 - DNA, 924 bp, Zea mays
  misc_feature: Ceres CLONE 1580619
  misc_feature: Encodes the peptide sequence at SEQ ID NO. 92047
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctggcggccaccgtatcttcctgcctgagcctcgtccccaccgtggaccaccgggccggcggggttcccagcagtgttgcactgacgaacacgctttagcggcgtcgtcgttctcgccgctatctttgtggttcgcctcgggacaaaaacccaaaaagagggcgccccccgggtgacaatcagggaaattgggacccctcctcttctttcaggggccggggccaaaaaacggggagtttccccccccccggggggggggggggggggcccccgggggccaaacaacctggggagggggtttttttggaaacccaccctcaaagggggggggcccctcccccggagaagagaaattccccctcccgggggggggtggttccccccgggcccccctctccaaaaagaggttttttaataataaaaaaagggttttttccccccctccctgggggggggggggtgggaagaaaaacccccgcggaaaaaaaaaacttttttcctcacaaaataaaacgagcccccccggcggggggggggggttttaataaaaaaaaaaaaaaaactctttttctttttttagtcctcccgggggagaaaaaacaccaaaagatttccctccacctcttctgggtataaaagaagagagggccgcccccccccccaagtatgggggggggggg

SEQ ID NO: 92047 - protein, 40 aa, Zea mays
  misc_feature: Ceres CLONE 1580619
PRGGGRSRTSGSPGLQEFVSPLEKTELKHTSRKQERKDCS

SEQ ID NO: 92048 - DNA, 1051 bp, Zea mays
  misc_feature: Ceres CLONE 1580627
  misc_feature: Translation starting site: 263
  misc_feature (11)..(11): n is a, c, t, g, unknown, or other
  misc_feature (33)..(33): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (69)..(69): n is a, c, t, g, unknown, or other
  misc_feature (71)..(71): n is a, c, t, g, unknown, or other
  misc_feature (72)..(72): n is a, c, t, g, unknown, or other
  misc_feature (488)..(488): n is a, c, t, g, unknown, or other
ggaggggaganttggggggagccgccacaaaanaaaaactaaaagtttgggagggggggnnnanaaaantnncccaaactggagctccccgcggtggcggccgctctagaatagtggatcccccgggctgcatgaattcgtctcacccctagaaaaaccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgtgtcctccccanagcaagtatggttctcctaaaattgttaacgatggtgttacagttgcccagagaggttggagctggagagaccctgtaggagaacattgggtgctaaaattggtcaaggcaaggcagcaggctaagaacccaatgaatctagcttgggaagatggggacaaacccacctcctggtgggtcctttgcctcaaggggggctgaactcgacttgagggggggtttaaaaggtttggtgggccaggccagggttggcttaaatcccctgggtgtcaagaaatttaactccggtggggttaatcggaaggaaaaaaccgggcggcaaaggcccactaaggttgggagagaaaactaacgcgaaagggtctgtcctccaagggaggggcccgaagaaattagaggaagcatctggccaaaaggtttgtcttgcctggaataagtggcgcgggaaaacacaacttaccgaacaattgtgggaaactgtgaattagcccgaaagggccctgggagacaaggggtccgggtccgtaaaaggggagggagtttaaccccctccgataaaaaga

SEQ ID NO: 92049 - DNA, 787 bp, Zea mays
  misc_feature: Ceres CLONE 1580629
  misc_feature: Encodes the peptide sequence at SEQ ID NO. 92050
ctggagctcaccgcggtggcggccgctctagaactagtggatcccccgggctgcaggaattcgtctcacccctagaaaaacatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtctccgagggcgagtcggcgggcccgggcggcttcgtcgccttcgtcggcaacctcctcttcccttttatcgcgttcgctggcctcttcttcctcttccgccgcgcgcagggcgggcccggcgccgggcctggtggcctcggcgggcccatggacttcggccgctccaagagcaagttccaggaggtgcctgagacgggtgtcaccttcctcgacgttgccggcgcggaccaggccaagctcgagctgcaggaggtcgtcgatttcctcaagaaccccgacaagtacaccgcgctcggagccaagatccccaaggggtgtctcctcgtc

SEQ ID NO: 92050 - protein, 60 aa, Zea mays
  misc_feature: Ceres CLONE 1580629
MDFGRSKSKFQEVPETGVTFLDVAGADQAKLELQEVVDFLKNPDKYTALGAKIPKGCLLV

SEQ ID NO: 92051 - DNA, 1310 bp, Zea mays
  misc_feature: Ceres CLONE 1580630
  misc_feature: Encodes the peptide sequence at SEQ ID NO. 92052
  misc_feature (18)..(18): n is a, c, t, g, unknown, or other
  misc_feature (1073)..(1073): n is a, c, t, g, unknown, or other
  misc_feature (1270)..(1270): n is a, c, t, g, unknown, or other
  misc_feature (1275)..(1275): n is a, c, t, g, unknown, or other
atatactttgaaaaaaantaacaattatttttttctttcttttttggtcccctccacctaaaaagcattcggtcaaaactggagctcccctcggtggcggccgctcttaaactagtggatcccccgggctgcattgaatacgtctcacccctagaaaagatctcccctggttgggcctgtgctgtgtggccgctctccctcctcccaacccaaccaagaaacagatgcccccctcaaggctcctcagagagacagagaactccatggccgccatggacctcctctcaggaaagctccaacgctccctgcgtgtccattcctcactcctcccctctgctccttcctcatcacgcgccgtcgccacatcccgacgtctccggcgccgcacggcatgcccgcctgtactgacgccttacctaccaccttttactctttcatctgcctcaagccatcacaagcacaggggtggaggaagacggttacaaaccaggaaccttttttcctacccgtacttaacatgattccgaaccctatcttggcgcgacccgccccgtggggaacccaaaaaacaaatcgggtaaggaacggggcaattaccccgggcgcccgccataagcattctccttttccaggagggtgcccgtcttagggaggggcaaattctttcaaaagtatactttaccccctggagctgcttgaataaggattggcctcacaaaagggccaagaatggttctcactccaggataacgaggagggaacaaacccacacctgttcctcataaaaaaataggctgagggaggtgacactacatagaacacagacgctcgcgcgtgtaaaaacaagccggatacgtatataccccggggttccaacgaaaagatacttaaaacgatgctatctttcactttcccgggactttcatttttgtgtgctctctagtcggggtgggaggttttatagcagagaaacaaaatatacctcccttgaaatagcgatcgtggggaggcctcctcgtttctacaatatttttaagtgctgcgtatcagaggtggggataaaacacaccggntgcaaaaggaccaataaattttcttttttatcttctcctcatacacccgagagagagtttaatctgacatctggttttctgtttaatatcaaatacccagactctgtattttggtccaaaggggggaaagaaaacaacatcatgatttaacagtaatcatcctcttctctagcgtggcgcgtctactataggtagangggtncaatatagagagaggaggggacactttatatataa

SEQ ID NO: 92052 - protein, 85 aa, Zea mays
  misc_feature: Ceres CLONE 1580630
MAAMDLLSGKLQRSLRVHSSLLPSAPSSSRAVATSRRLRRRTACPPVLTPYLPPFTLSSASSHHKHRGGGRRLQTRNLFSYPYLT

SEQ ID NO: 92053 - DNA, 1142 bp, Zea mays
  misc_feature: Ceres CLONE 1580633
  misc_feature (29)..(29): n is a, c, t, g, unknown, or other
  misc_feature (683)..(683): n is a, c, t, g, unknown, or other
  misc_feature (747)..(747): n is a, c, t, g, unknown, or other
  misc_feature (961)..(961): n is a, c, t, g, unknown, or other
cgcccaaaaaaaactacgaccccccctgnccgaggggagggagggaggtcccgcctcctttttgtgttaagaccaaagtgggggctcccgcggtggcggccgctctttaatagtggatcccccgggctgcttgattcgtctcacccctagaaaaatcccgttccccaattcgaaatcgagtcgggtcgagtcttgccgtgcgtgcgtggctgcgcgaaccagcccacgctcccactccccgcccgccagcgccgggtccctctagaggttttgccacgatgtcgctccggccgagcgagcgggagcagatgcggaagggcaactacaagcacacggtggacgcctaggatagccgccgccgcctccagggccagatggtcgacatccgcgaggccaagcgagaggaaagcctccataagaagcgccgcgatgggttttacgccgccggccccgtgccctccgatgggccaactcaacccccccccagtagaagcacgaatggccttgccaggcgaatggtacaggaccgttcaactccgaacgagtcccaactggggccaggattggagggcccacctacatcaagtttaagggaaagactggctgcgtcccttataaggcggctagttccccccccaaatttggaaagacagtgccggaataccaggccaccaagtgtaagnttcgatttgtccacccccggaacatcccgctatggaaaggttgtgccgccatttcacccggcgnataggaaagggggaagagccgtgttctccctgccaaaccacctctcctccgggtttcttttgtgaagcgagccctagcccacttgtgcgggagagttcttttacacccccgaaaaacagactgtgtttacaataccagaaggacaaacatattttaaaaacatattatcacccttacacagcgacggaggtttgctgtctgcacacacaaatgngaatgctacctatggtacccgaactcttctttggtacatcgaacctgccccatttaagagtccgcaagaagggtgaagggggaaatgtttcctcttgcattagaaggggctggttacatgggagcgcctttggggtagaatgagcgggcttgcggacacaccccccctacgagtgccactc

SEQ ID NO: 92054 - DNA, 959 bp, Zea mays
  misc_feature: Ceres CLONE 1580640
  misc_feature: Encodes the peptide sequence at SEQ ID NO. 92055
  misc_feature (904)..(904): n is a, c, t, g, unknown, or other
  misc_feature (929)..(929): n is a, c, t, g, unknown, or other
aaagctggagctccccgcggtggcggccgctctagaactagtggatcccccgggctgcaggaattcgtctcacccctagaaaaagatatgcacgtcgtggtggaaaaatatgggtgcgtatatttcccgacaaaccggttacaataagacccacagaaacacgtatgggctcgggaaagggatcccccgaatattgggtagccgttgttaaaccaggtcgaatactttatgaaatgagcggagtatccgaaactgtagctagagcagctatctctatagctgccagtaaaatgcccatacgaagtcaatttcttcgattagagatatagaaccccaaaaaggaatattgaagataaaaaacccctggtttttctttctggaaagacaatatttctttcatccttttgcattgaaataacaaatggaaatccaaataatatgattcaaactcagacccttttaaatgtagcagataacagtggagctcgaaaaatgatgtgtattcgagtcattaggagccgctggtaatcagcgatatgctcgtattggtgaagttaattattgccgttaaccaagaaccagtgcccccaaaggcccctaaaaagaaccgaaagtaattcaagctgtaattgttcgctaccctaaaagaattccaagggcaaacaacggtttaataaaacccttttgatgaaaaaggcgccagtttttctttgatccaaaagggaaacccaaaggagaacccagttttttggcccggttccccaaaaaattaaaaaaatggaatttgaccaaaaaaagtttccttaacccccggagagtttttaaattccttgggaacgaaaatttgcttcaaaaaaatattcttgtatttttgtccccgcgtatgtctttaaaaatctcaaantttaaaaagggggacaacgtgtgtntttttaaaaaattgggggagacccttgtat

SEQ ID NO: 92055 - protein, 54 aa, Zea mays
  misc_feature: Ceres CLONE 1580640
MGSGKGSPEYWVAVVKPGRILYEMSGVSETVARAAISIAASKMPIRSQFLRLEI

SEQ ID NO: 92056 - DNA, 891 bp, Zea mays
  misc_feature: Ceres CLONE 1580642
  misc_feature: Encodes the peptide sequence at SEQ ID NO. 92057
  misc_feature (629)..(629): n is a, c, t, g, unknown, or other
agctccccgcggtggcggccgctctagaactagtggatcccccgggctgcaggaattcgtctcacccctagaaaaaactcttaagaccaaaaaaagaaacgagaaaaaaagaagagagctgctctgatggatcgctccacctccctgctccggctcatcttgcttgctcttggcgcagccctggtgctcctcgtcgtccgctccgccttccgcctcccacgtggaatcgacacacccaccacctcactcttcgatgacgaagccaccgcgggcagcagctgcacccggttcgcgccgtgggggtgccggcaagccgaccggattaagcagaagccgccgtcgcacgagaacgacgtgccgcggcacccgctcgacccactgacgatcagcgaggtaaaccgtgcgcgcgagctcctccgcgcgcacccgccgttcgcatcgtcgccgtcgtccatgttcgtgcactcgctcgcgctcgacgagccggacaagcccgtcgtcctgagctggcggaagggcgtcgacccgctgcccccgctgcgcgcggtggcggtggtccggttccgcggtgatgccttcgtcctgggcattgaccctcgcagcggcgccgtgactcctctgcctgtccnagctttcgggttacccgaccatgacccatggacgaagcagtgctcctctgctacacgcctttcagggtacccgcggttcacggcgacatccagcggcacgggggtccccctgtccaatgtcccctgcctgccatttttgttccgttggtacggcccccgcgagaaaaccggggggtgatcaaaatccgggccttcccccggagggacccccaatttttaatggccccctttaaggcccccccggggggggaaaagggacaaa

SEQ ID NO: 92057 - protein, 226 aa, Zea mays
  misc_feature: Ceres CLONE 1580642
  misc_feature (80)..(168): Pfam Name: Cu_amine_oxidN2 Pfam Description: Copper amine oxidase, N2 domain
  misc_feature: SWISSPROT Homolog: EC 1.4.3.6 Amine oxidase (copper-containing)
  misc_feature (168)..(168): Xaa is any aa, unknown, or other
MDRSTSLLRLILLALGAALVLLVVRSAFRLPRGIDTPTTSLFDDEATAGSSCTRFAPWGCRQADRIKQKPPSHENDVPRHPLDPLTISEVNRARELLRAHPPFASSPSSMFVHSLALDEPDKPVVLSWRKGVDPLPPLRAVAVVRFRGDAFVLGIDPRSGAVTPLPVXAFGLPDHDPWTKQCSSATRLSGYPRFTATSSGTGVPLSNVPCLPFLFRWYGPREKTGG

SEQ ID NO: 92058 - DNA, 961 bp, Zea mays
  misc_feature: Ceres CLONE 1580651
  misc_feature: Encodes the peptide sequence at SEQ ID NO. 92059
ctccccgcggtggcggccgctctagaactagtggatcccccgggctgcaggaattcgtctcacccctagaaaaaacgcccacgcctccacggccaagcgcctcgaaggcaaagcttccactagccacaggccaacgaaatcgcaacgcgaagctacggccaccgaccgacgttccaagaagcgaaacgaaacgaaaatgatgatgatgatgggagagagagcgcacgcgccgccgtggcagcactcgccggcggccagcggcgtcacggacgcggacgacgcgtctccgtacgccctcctagcggcgctgcagcattacctgccgtcgaacgaggtggcggcgttcgacgaagacgacgaggaggcggccctggcggcggcgaccgccgccgtcgacgcgtacgcctgcgacgagttccggatgtacgagttcaaggtgcggcggtgctcgcgagggcggaaccacgactggacggcctgcccctacgcgcacccgggggagaaggcccggcggcgcgaccccaggcggtaccactactccggcgccgcgtgcccggacttccgcaagggcgggtgcaagcgcggcgacgcgtgcgagctcgcgcacggggtgttcgagtgctggctccacccgtcgcgctaccggacgcagccctgcaaggacggcaccggctgccgccgccgcgtctgcttcttcgcgcacacgccggaccagctccgcgtgcctccgccgcggcagtcagcctagggggggcgggcggcggcgtcgccgctgggccgagtcgtacgacggctcgccgctccgccgccaagcgttcgagagctacctcccaagagcgggatcgtgtcgtcgccgccgacagaacgctcgtctcccgcccaagtcgccgccgtcggagtccccgccatgtcgccagaaggccccgccgcgttccccctggttcttggccgggcgtaggtt

SEQ ID NO: 92059 - protein, 183 aa, Zea mays
  misc_feature: Ceres CLONE 1580651
  misc_feature (114)..(139): Pfam Name: zf-CCCH Pfam Description: Zinc finger C-x8-C-x5-C-x3-H type (and similar)
MMMMMGERAHAPPWQHSPAASGVTDADDASPYALLAALQHYLPSNEVAAFDEDDEEAALAAATAAVDAYACDEFRMYEFKVRRCSRGRNHDWTACPYAHPGEKARRRDPRRYHYSGAACPDFRKGGCKRGDACELAHGVFECWLHPSRYRTQPCKDGTGCRRRVCFFAHTPDQLRVPPPRQSA

SEQ ID NO: 92060 - DNA, 1065 bp, Zea mays
  misc_feature: Ceres CLONE 1580652
  misc_feature: Encodes the peptide sequence at SEQ ID NO. 92061
  misc_feature (829)..(829): n is a, c, t, g, unknown, or other
  misc_feature (830)..(830): n is a, c, t, g, unknown, or other
  misc_feature (833)..(833): n is a, c, t, g, unknown, or other
  misc_feature (836)..(836): n is a, c, t, g, unknown, or other
  misc_feature (880)..(880): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (888)..(888): n is a, c, t, g, unknown, or other
  misc_feature (889)..(889): n is a, c, t, g, unknown, or other
  misc_feature (893)..(893): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (1028)..(1028): n is a, c, t, g, unknown, or other
  misc_feature (1030)..(1030): n is a, c, t, g, unknown, or other
  misc_feature (1032)..(1032): n is a, c, t, g, unknown, or other
  misc_feature (1033)..(1033): n is a, c, t, g, unknown, or other
  misc_feature (1034)..(1034): n is a, c, t, g, unknown, or other
  misc_feature (1035)..(1035): n is a, c, t, g, unknown, or other
  misc_feature (1036)..(1036): n is a, c, t, g, unknown, or other
  misc_feature (1037)..(1037): n is a, c, t, g, unknown, or other
  misc_feature (1044)..(1044): n is a, c, t, g, unknown, or other
  misc_feature (1045)..(1045): n is a, c, t, g, unknown, or other
  misc_feature (1046)..(1046): n is a, c, t, g, unknown, or other
  misc_feature (1047)..(1047): n is a, c, t, g, unknown, or other
  misc_feature (1048)..(1048): n is a, c, t, g, unknown, or other
  misc_feature (1049)..(1049): n is a, c, t, g, unknown, or other
  misc_feature (1050)..(1050): n is a, c, t, g, unknown, or other
  misc_feature (1051)..(1051): n is a, c, t, g, unknown, or other
  misc_feature (1052)..(1052): n is a, c, t, g, unknown, or other
  misc_feature (1062)..(1062): n is a, c, t, g, unknown, or other
ctccccgcggtggcggccgctctagaactagtggatcccccgggctgcaggaattcgtctcacccctagaaaaaaggtcccaccacgtagggaggggattggagacgccgagctccaccggaggcgaaagcggaggcgcgtggcgcgccctctgactcctcgctgtcttgtttttcaggacaaaatggaccttgcacctcagggtttgataacacagcaacaaaaggcaaatgagcgaaggccagttggtagctcacaaatttggacacagtatggtgttctgcttcctagcccgcagactcgaaagcttaaagaatggattctgactgatgagcagccacagcttgtttatgttacacgacttgtgaatcttgtgcttttccccggggttaccacttaacgatcttttctgaaaacttttttttggagaagggggaaaatggaaaccaattccgcacccctttcctggggatttgaaaattggccccctccccctcccggaagagtttcctattattcttgggcatttccactgaactcggcccctttggtggaccccccaaaaaccaaaattggggatagaaaacctgtttaagaaggaagaaggggctggccccccttttttttcttaaaaaaaacccccccccaaacaaagaaagaaaacaaccaccgggtgggctccttctttttttcctttctaaacctcgcactccgcgctgtctgggtgttgtgcctcctttccctgtttttatttttttttctccgctcgcgaaaaacctcaaggcgcccccctcataaaaaaatctaaattgggtttttttcctgtctnnctnttntttaagttcccacacccccacttctctcctcctcggtggcccanannnnngnngttngggtcttnnnnaaatgccctcttcccaccggaggtttcccaaatcccctgcgagattggaaacaccctttttcttggggggcggcgcgccccccccccttctttaaaaggaaaatatctttttccaacaaaacgntntnnnnnnaggcgcnnnnnnnnnggtttatctngag

SEQ ID NO: 92061 - protein, 71 aa, Zea mays
  misc_feature: Ceres CLONE 1580652
MDLAPQGLITQQQKANERRPVGSSQIWTQYGVLLPSPQTRKLKEWILTDEQPQLVYVTRLVNLVLFPGVTT

SEQ ID NO: 92062 - DNA, 1041 bp, Zea mays
  misc_feature: Ceres CLONE 1580656
  misc_feature: Encodes the peptide sequence at SEQ ID NO. 92063
  misc_feature (1041)..(1041): n is a, c, t, g, unknown, or other
ggagctccccgcggtggcggccgctctagaactagtggatcccccgggctgcaggaattcgtctcacccctagaaaaaagcccaaacacgatatataacggtccgcgccttccgaagacgccaagaacagcctcaggttactcgcagaaaagattattagctcgccgcgggggtcgaaccgagactcctagctagctgatcgcgcgcgcacaaggcgagcggacaagaaagcttgctttgtgctcaccggcgggcggcggcacggaccccctgcgatggaagccgtcggcgtcactcctgcccccgtggcggcgccggagaagaagaagctgcttgacctcaaggaccccttccccgccgccgcgaacggcggcaccaaggcgtccccggcgagtaagtgggcgatgaagaagaagctggtgggcggcgacgccggctacgtgctcgaagacgtaccgcacctcacggattacatggcccagctcccgacttacccgaatcctctcccagacaacccggggtattccggcgtcaaagaattatttcgttaaccacgaaaaacccggtccccaaaaaaattggttgtttaaaaaaaccggggccgggggccccccttttccggggggccggggccccggaaaacgggggtttctctccccccccataaagggggaaaccccccccttttttccccgtggggggggcccctcccccccgagaataataacaggggttctcccccaaaatttttttttggcgccttttaaaaaatttttgggggcctccccccacccctcccccctatagggggggggaaaagggggtttctttttaaaaaaaaatggtgggtggtgccccacggggggggaacacccccttaataggggggggggtctctccccccccccgggggaggggggtcccccccctttctttttttttctcgagcgttggttttatttcttttttttgggggggccctaaaggggttcttttttttataaagaacacagccccccttgttgggtggccacacaaaan

SEQ ID NO: 92063 - protein, 91 aa, Zea mays
  misc_feature: Ceres CLONE 1580656
MEAVGVTPAPVAAPEKKKLLDLKDPFPAAANGGTKASPASKWAMKKKLVGGDAGYVLEDVPHLTDYMAQLPTYPNPLPDNPGYSGVKELFR

SEQ ID NO: 92064 - DNA, 1009 bp, Zea mays
  misc_feature: Ceres CLONE 1580657
  misc_feature: Encodes the peptide sequence at SEQ ID NO. 92065
  misc_feature (436)..(436): n is a, c, t, g, unknown, or other
  misc_feature (467)..(467): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
  misc_feature (983)..(983): n is a, c, t, g, unknown, or other
  misc_feature (984)..(984): n is a, c, t, g, unknown, or other
  misc_feature (985)..(985): n is a, c, t, g, unknown, or other
  misc_feature (986)..(986): n is a, c, t, g, unknown, or other
  misc_feature (987)..(987): n is a, c, t, g, unknown, or other
  misc_feature (988)..(988): n is a, c, t, g, unknown, or other
  misc_feature (989)..(989): n is a, c, t, g, unknown, or other
  misc_feature (990)..(990): n is a, c, t, g, unknown, or other
  misc_feature (991)..(991): n is a, c, t, g, unknown, or other
  misc_feature (992)..(992): n is a, c, t, g, unknown, or other
  misc_feature (993)..(993): n is a, c, t, g, unknown, or other
  misc_feature (994)..(994): n is a, c, t, g, unknown, or other
  misc_feature (995)..(995): n is a, c, t, g, unknown, or other
  misc_feature (996)..(996): n is a, c, t, g, unknown, or other
  misc_feature (997)..(997): n is a, c, t, g, unknown, or other
  misc_feature (998)..(998): n is a, c, t, g, unknown, or other
  misc_feature (999)..(999): n is a, c, t, g, unknown, or other
  misc_feature (1000)..(1000): n is a, c, t, g, unknown, or other
  misc_feature (1001)..(1001): n is a, c, t, g, unknown, or other
  misc_feature (1002)..(1002): n is a, c, t, g, unknown, or other
  misc_feature (1003)..(1003): n is a, c, t, g, unknown, or other
  misc_feature (1004)..(1004): n is a, c, t, g, unknown, or other
  misc_feature (1005)..(1005): n is a, c, t, g, unknown, or other
  misc_feature (1006)..(1006): n is a, c, t, g, unknown, or other
  misc_feature (1007)..(1007): n is a, c, t, g, unknown, or other
  misc_feature (1008)..(1008): n is a, c, t, g, unknown, or other
agctccccgcggtggcggccgctctagaactagtggatcccccgggctgcaggaattcgtctcacccctagaaaaaatctcccccccgcctctgctctcctttctcccgtccccgcacaaaaacatttgcaccccctcccgactgctactgccgctgcctcctctccctttccgcctgccttcgctctcctcgtcgtctcctccgtctagggttctccaccccacccgccccgccgccgcccgatccgaggcagatgccgcccgcagccatggcgctgccgtcccaggccccgtctaactcaggggatccgctgtacccggagctctggcgcgcctgcgccggcccgctcgtcaccgtcccccgcgtcggcgacctcgtcttctacttcccccagggacacatcgagcaggtggaagcgtccatgaaccaggttgncgggaacccgatgcgtctctacgatctgccnttcaagctgctctgccgcgtgctcaacgtcgagctgaagggcggaaaccgacccccgacgaagtgtaccccgcagatcatgctcatgccggagcccgagccaaacgaatggggctgcccaaaaaaaaaacctctggggctgctggcccccccgaggccagggtccaggtcctttctgcaaaaaagctacccgccccccaaacccgaaaaaaaggggggttttctttttcctggccccccccccttaaaaaaggcccccccgcccctggaaattccccaaatcccccccccctcaaaaaagggggggaaaaaactcctcccggggtggaaggggggattccccccccttttttggggggaaacaaaggggggcccccccaggagggggggagggtttttttaccccaaaaagggttggtggggaaacccttttttcttccaaaaaaaaaaaaagcatcccctggttgcccgnnnnnnnnnnnnnnnnnnnnnnnnnnnnnnnnnnnnnnnnnnnnnnnnnnnnnnnnnnnnnnnnnnnnnnnt

SEQ ID NO: 92065 - protein, 223 aa, Zea mays
  misc_feature: Ceres CLONE 1580657
  misc_feature (56)..(56): Xaa is any aa, unknown, or other
MALPSQAPSNSGDPLYPELWRACAGPLVTVPRVGDLVFYFPQGHIEQVEASMNQVXGNPMRLYDLPFKLLCRVLNVELKGGNRPPTKCTPQIMLMPEPEPNEWGCPKKKPLGLLAPPRPGSRSFLQKSYPPPKPEKKGGFLFPGPPPLKKAPPPLEIPQIPPPSKKGGKKLLPGWKGGFPPLFWGETKGGPPRRGGGFFYPKKGWWGNPFFFQKKKKHPLVAR

SEQ ID NO: 92066 - DNA, 848 bp, Zea mays
  misc_feature: Ceres CLONE 1580660
  misc_feature: Encodes the peptide sequence at SEQ ID NO. 92067
  misc_feature (722)..(722): n is a, c, t, g, unknown, or other
ctggagctccccgcggtggcggccgctctagaactagtggatcccccgggctgcaggaattcgtctcacccctagaaaaagtatcatcagtcaccacacatctcataccacatatcatcacacaccataccacatcgacgacttgagcgcgtgcgtgcgtgccctgatcgagcaccgattgccatggactcgacgacgacgacgacagcgccgctgctgcagccggccgccgccgcctcgagcaaggaggagccggcaccggcgtccccgcacggcgcgggcagctgggagctggaggcggtcctggccgacgcgtcgtcgccggtcttgcggcgggcctgggaaggcgcccgcctggagctgccgctgctgctgcgtgtggcgctgccggcggtgggcgtctacgtgatcaacttcgtcatgtccatgtccacgcagatcttctgcgggcagctcggcaacctggagctcgccgccgcgtcgctcggcaacaccggcatccagttcctcgcctacggcctcatgctggggatgggcagcgcggtggagacgctgtgcgggcaggcgtacggcgcgcacaagcacggcatgctgggggtgtacctgcagcggtcgacggtgctgctgatggccacagccgtgcctctgaccgtggtgtacgccatctcggcgcgcatcctggatgctctgggcgagtcggagcgcatcttccgggccgccgncctgttctgtaccggctcatcctgaaaattttgcgtacccggccagtttcccatccagaattcctgggggggcaaaaatctgggccccaaggtcctaaatttcgggggcccccctgggctccaccg

SEQ ID NO: 92067 - protein, 187 aa, Zea mays
  misc_feature: Ceres CLONE 1580660
  misc_feature (69)..(188): Pfam Name: MatE Pfam Description: MatE
  misc_feature (180)..(180): Xaa is any aa, unknown, or other
MDSTTTTTAPLLQPAAAASSKEEPAPASPHGAGSWELEAVLADASSPVLRRAWEGARLELPLLLRVALPAVGVYVINFVMSMSTQIFCGQLGNLELAAASLGNTGIQFLAYGLMLGMGSAVETLCGQAYGAHKHGMLGVYLQRSTVLLMATAVPLTVVYAISARILDALGESERIFRAAXLFCTGSS

SEQ ID NO: 92068 - DNA, 1259 bp, Zea mays
  misc_feature: Ceres CLONE 1580661
  misc_feature: Encodes the peptide sequence at SEQ ID NO. 92069
  misc_feature (67)..(67): n is a, c, t, g, unknown, or other
  misc_feature (390)..(390): n is a, c, t, g, unknown, or other
  misc_feature (1122)..(1122): n is a, c, t, g, unknown, or other
  misc_feature (1259)..(1259): n is a, c, t, g, unknown, or other
tcgccccgttttctcttcgcccacttagcgtccttcttgtatcgcgttcccctgaactacacctatntattattgaactcacgtcggtggcggccgctctagaatagtggatcccccgggctgcaggaattcgtctcacccctagaaaagtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacnccgactccctcatcgaggaggaggaggggctcaacgaccacaacgtcgtcgtcaagtgcgccgagatccagaacgccatctcccaaggagcaacatcgtttcttttcaccgagtaccaatatgttggtatcttcatggctatcttcgctggtgggatcctccctcttccttggttcggttgagggattcagcacgaagagccagccctggcacatataggcaaggacaagtactgcatggcctgcttctgtttcactgcaactcttaagcactggtggtcccttcttgcttgggagcccatcaccctctcctgggtcctctgggttttcccttgggcctgtgaaaaattgtccaccactattgtctcaagtggccagaaaacttaccccctgtgaaaaccttatgtaaagggggctgttttggctcaaaaggcctttctttaatgaaattgtgcgctttttctcggcttccccggggcggccttggtataatgaggggtcttccctatggcctctgggcaattataggttgggaacttttgtgggggcttcccggtatacacccctcacaattttattgaggcaacatcttatactctgctgtttttatcccgctgtatttgaatctcggagtgaggaggccctttttttgtgaaagacacaactctacgtggtggctaagggcgctctctggcgtggagagcctcttccacatggggtgttctctctctantaacaagacacgctcgctggtaagggttctcttcagccacaaatgggcctcctctcagtctatttatgagccgccaaactccgggtttgagaaaaagcgccacaaaagagaaacatcccccgaagcgaacagatacn

SEQ ID NO: 92069 - protein, 110 aa, Zea mays
  misc_feature: Ceres CLONE 1580661
  misc_feature: SWISSPROT Homolog: EC 3.6.1.1 Inorganic diphosphatase
  misc_feature (51)..(51): Xaa is any aa, unknown, or other
MAILSALATEVLIPVAAVIGIAFAVVQWVVVSRVKLSPAASGGSGGKAGYXDSLIEEEEGLNDHNVVVKCAEIQNAISQGATSFLFTEYQYVGIFMAIFAGGILPLPWFG

SEQ ID NO: 92070 - DNA, 1172 bp, Zea mays
  misc_feature: Ceres CLONE 1580662
  misc_feature: Encodes the peptide sequence at SEQ ID NO. 92071
  misc_feature (61)..(61): n is a, c, t, g, unknown, or other
  misc_feature (62)..(62): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (1143)..(1143): n is a, c, t, g, unknown, or other
gtgtggtgggggggggggggggggagaggggggggacacaaaaaacaaagcggcgcagccnncnnnntnnnnnnntnnaaaaactggaactccccgcggtggcggccgctctagaatagtggatcccccgggctgcttgaattcgtctcacccctagaaaaattttcaggaaaagaaactcgacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggaactgagtttgccaagaacaacaacctggaggccctgttccatgtggatgaccccgggccgagggtccccatcaagaagggcaagttcctaggacgtgcagcgaggcatctcgaggtaggtccgtttttgacctccagcaactgcgaactggaaagggcgcgggcatgaactctttctcaacgaaacagtgggttcctcccaacaaacaagggtggggtaaaaaagggtcccttcaaaacccccccctaaggcggagggggaaggctttcaaagagctccgcgattccggggggagacccctcttggtaaggggaaaaaaaagagaggcctcgtggtccccggtaaagaacctgtaaacaccggcgccctagcggaaagagcctctgggggggggaaaaaaaaaaagttctctgcaagcctcaaatctccagaggggggttgttccaaatttccttacccttgcgcgggaaaaaaaaacctccaggaaaaggatgccgtcccaattctcgtggggccgcgcgctcccgagaacaaaaaaggcgttaagaacggctcaattatttgtgggaacgaaaaccccctgtgggattgggaaaaccgcaaaaagggggcgttggttaaacgccccaccccgcgaaatggcggaggccccccccataaatataccgatttaggagcggggggcacaacccccccaacattgtcctgtgggngttccccaagagcacacttccgctacccc

SEQ ID NO: 92071 - protein, 98 aa, Zea mays
  misc_feature: Ceres CLONE 1580662
  misc_feature: SWISSPROT Homolog: EC 1.13.12.14 Chlorophyllide-a oxygenase
MNTVALLSLAPQLLIKPSLTCFSRKGVGRYGGIKVYAVLRDDGTEFAKNNNLEALFHVDDPGPRVPIKKGKFLGRAARHLEVGPFLTSSNCELERARA

SEQ ID NO: 92072 - DNA, 1272 bp, Zea mays
  misc_feature: Ceres CLONE 1580664
  misc_feature: Encodes the peptide sequence at SEQ ID NO. 92073
  misc_feature (46)..(46): n is a, c, t, g, unknown, or other
  misc_feature (71)..(71): n is a, c, t, g, unknown, or other
  misc_feature (73)..(73): n is a, c, t, g, unknown, or other
  misc_feature (661)..(661): n is a, c, t, g, unknown, or other
  misc_feature (964)..(964): n is a, c, t, g, unknown, or other
tttttttctcccgatagaaatcccctttgagcgctgacaccctggnccaaaatcaaaagaaaaacccaccntnaaaagctggagctccccgcggtggcggacgctctagaactagtggatcccccgggctgcaggaattcgtctcacccctagaaaaagagaactccccttctccgccactaccgaagcccttgtacccctcaccgccgccgctgctgctagggagcttccacccgcgcgcgcctacaacgagagctagcagcagtagcggccgttatcttgtcgctccggctccgttcgtgtacccaagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggatttcgtgccgcgggggccgccggccgcccgccgccggcgggttgtgcctgccgcctccgcccgcaggggaattccgcaatggtttggcggggcctttcccccgcccgccgcggtgggggggcttttttttttccggcggccggaagacccccgggccggtgttggaagtaactatggggccccttattgcggtggaaaacccccaggggaanttttttgcttcccacaaggggagccacaaccgggggccctccccggagaaacttgggggaaaacgcggggaaaatatggttttcccccgggcacacccggatctcgggtggggtgttgaaaaaaaaacagcggaggaccccccccccgcggggggtggggagagaaaaaggggaggtccttctcgaaaaaaataaaaaaaagagggaggtggggggttgggtcacaccacaaaagaattctcccccccacagacgcgggggagagtggggagaaacatctcactatatattcttttatggggnggggaggaatatattaaaccgctcttgttgtgtctgttctctacaacgaggaaaacaaaccgtcgcgaggaggggagagatttgctttgtatccccccaagggggatatcctgtgcgaggaggagaaaaatttctcgcgccaaatataataacaagagagaattgtttaggtggtgttatatataaaaaaaaaaataagagaatcttttgttggggcgcggagaaaataaggagtagattgtgttgggtgtgggggggtttgccgcaaaaaacacgtagagaaagagtgatttttattacaaaagcga

SEQ ID NO: 92073 - protein, 152 aa, Zea mays
  misc_feature: Ceres CLONE 1580664
  misc_feature (114)..(114): Xaa is any aa, unknown, or other
MPQMEGSTDQIAAGWFAKEPASERPVGLPRTGSSSRLNAQAPDFVPRGPPAARRRRVVPAASARRGIPQWFGGAFPPPAAVGGLFFFRRPEDPRAGVGSNYGAPYCGGKPPGEXFCFPQGEPQPGALPGETWGKTRGKYGFPPGTPGSRVGC

SEQ ID NO: 92074 - DNA, 1113 bp, Zea mays
  misc_feature: Ceres CLONE 1580667
  misc_feature: Encodes the peptide sequence at SEQ ID NO. 92075
  misc_feature (13)..(13): n is a, c, t, g, unknown, or other
  misc_feature (17)..(17): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (822)..(822): n is a, c, t, g, unknown, or other
  misc_feature (823)..(823): n is a, c, t, g, unknown, or other
ttcttgtggggcnttgngttccgctgtaacaactggaccagtactcaaccaataggaggggcgnnnngtttnnnnnnaaaaactggagctcccctcggtggcggccgctctataatagtggatcccccgggctgcatgtattcgtctcacccctagaaaaaaagtccctccccaaggccgcagctcactcgtgtcgtgcacccgtcccctcccggctcccacccgccaagaactagcattgccgccgccggtgccagggggcggaggagaggccgcggcggcgagggagcggcaccaggcgcaggggggaggagaagcaggagagccgccggcaggatgttcgggcgggacccctggggcgggccgctggagatctccaacgccgactcggcgacagatgacgaccggagccgggacctggaccgggcggcgctgatgcggcagctggacgagacgcaacagagctggctcctggccgggccccgcgaaccaggcgtggcaagaaagaagaaagagggtacgttcgacctggggctgcgttcgtcgtccgacccgcaagaattcttcatgttgggaccgttccgggcacccattccttcggaccttcgagcggtcttttcaatcggggttttccatccatgggaaagaaatcgggttcaaaagcctttcggtttccccggcaaacaaaaaggtggccccccgatcccaggccgctgcccggccccgggcgtcccggaaaaccaaggggattacacacccgcccacgtaggcgggcgccttggccacaccaaaagggaggggggctccacaaagggtttcccnnccctcacaacccccccaacaaaccccaaaatcacaagggtttcccatattttcctgaaaagcgctccataacgggcggctttttgagccttgggtggggggggcacaaaatttcctgtggtcagtgaaaagaaaagggggcctcttcttccgaaaaagaaccacccgttccgcccacggaaaactttcgttctggaaagggttttttttcaaaagtagggggggaaacacctctttcaaatttcaaaaatccccccaagggcccgggccccgagaaaaagtggcaaacgt

SEQ ID NO: 92075 - protein, 185 aa, Zea mays
  misc_feature: Ceres CLONE 1580667
  misc_feature: SWISSPROT Homolog: EC 3.2.1.4 Cellulase
  misc_feature (163)..(163): Xaa is any aa, unknown, or other
MFGRDPWGGPLEISNADSATDDDRSRDLDRAALMRQLDETQQSWLLAGPREPGVARKKKEGTFDLGLRSSSDPQEFFMLGPFRAPIPSDLRAVFSIGVFHPWERNRVQKPFGFPGKQKGGPPIPGRCPAPGVPENQGDYTPAHVGGRLGHTKREGGSTKGFPXLTTPPTNPKITRVSHIFLKSAP

SEQ ID NO: 92076 - DNA, 1101 bp, Zea mays
  misc_feature: Ceres CLONE 1580668
  misc_feature: Encodes the peptide sequence at SEQ ID NO. 92077
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (60)..(60): n is a, c, t, g, unknown, or other
gggtgggtgggcnttnntctttccgtttgccatcgttatccaacgcctcagcgctccatntacgcatttttttttggggggggtaaaagctggagctcccctcggtggcggccgctttccaacagtggatcccccgggctgtttgtattcgtctcacccctagaaaaaagggatagcacgccgaggaaggtcgacatgtcgtctccgccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggccttcgacgggccgccgctgctccccgccgacccctacgcgcgcgccgcggcccgcttctgggccgacttcatcgagaccaggctcaccaagcccttcttcatgggcgatctggggtggagggagcgccaaagcgcgccctgccggttccgagggaaggaggcccaagggaagcttctgtgggcggctgcctgggagggcgccaagcttcgaaggggaaaaagaagggtttctttccgccccgggccgaaccaggagccgggggggttaaccttccccaccgtgggggcccggccggttccccgcccgccctttcgggggggccccctggtggaccgcccagacccgtttccatttcgagagggggagagcctttctaaaacccggattgtttgtggaccgcctcagccctcccaccccggagggggagacgtaacccaccccccccaaaaccctgggtggcccccggggtggggaaacccaggggggaacttatcgtggtgggccccttttggacagaggcctccttctcacaggcccccgggcacctggccgcggggaatccggggagaagaaaaaacctccccttccccccctaattttccacctaagaaagaaaccctttcccaccagggggacccaggggggcggggcccggttcac

SEQ ID NO: 92077 - protein, 302 aa, Zea mays
  misc_feature: Ceres CLONE 1580668
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
MSSPPPPVKLIGFFGSPYAFRAEAALCLKGVPYELILEDLFGSKSELLLHHNPVHKKVPVLLHGDGRAISESLVIAEYVDEAFDGPPLLPADPYARAAARFWADFIETRLTKPFFMGDLGWRERQSAPCRFRGKEAQGKLLWAAAWEGAKLRRGKRRVSFRPGPNQEPGGLTFPTVGARPVPRPPFRGGPLVDRPDPFPFREGESLSKTRIVCGPPQPSHPGGGDVTHPPQNPGWPPGWGNPGGNLSWWAPFGQRPPSHRPPGTWPRGIRGEEKTSPSPPNFPPKKETLSHQGDPGGRGPVH

SEQ ID NO: 92078 - DNA, 808 bp, Zea mays
  misc_feature: Ceres CLONE 1580673
  misc_feature: Encodes the peptide sequence at SEQ ID NO. 92079
ctccccgcggtggcggccgctctagaactagtggatcccccgggctgcaggaattcgtctcacccctagaaaaaatcaacagatatttcacgagcaggaacagcccggcaggaggcggggacgagatggcgccggcggaccgcgaccacctgtgcctgcctggctgcgtgcccgtgcgcgccaagcgggccgcctccacagcggcggccacggtcaccaccacagcgagggcgtcgcggcacaacttcgtcaaggccgcggcgtccggcctgctcgcgggggcgcactttaccaaccactagtcgctgcctccgctgccggacgcctatgccatagttcgtcgcggcgttcccgcagtacgaccatggcgcgcttgcgcgggccgacaccatccggggcgaggagtaccagcacctggaccgccacgtgtgcgtggagtacaccggcatctacctcttctcgcacgcccagatgaactcctccctgccatccatctcgtcagcgccgccgccctcgtcaggctgggagccgcccttcttcaacatcgcgtagaagtccacgagcctgcgcacgcaggtgcaatgcggggactccccagcgggcggcatcggcgccttcgtcaccaggcgcatcatggcgtcgctcaagatccccgaggaggattactccatggtgtgcacccggcacaagatcaccgcgtttcggctcctcaatggagtgctaaccattacaggcccgcaaggagctgctcccccgtgtaccaataaaaaaaaaaaggccttgggcgacatgggcccaaggcccgacg

SEQ ID NO: 92079 - protein, 99 aa, Zea mays
  misc_feature: Ceres CLONE 1580673
PRGGGRSRTSGSPGLQEFVSPLEKINRYFTSRNSPAGGGDEMAPADRDHLCLPGCVPVRAKRAASTAAATVTTTARASRHNFVKAAASGLLAGAHFTNH

SEQ ID NO: 92080 - DNA, 826 bp, Zea mays
  misc_feature: Ceres CLONE 1580676
  misc_feature: Encodes the peptide sequence at SEQ ID NO. 92081
ctccccgcggtggcggccgctctagaactagtggatcccccgggctgctggaattcgtctcacccctagaaaaactccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaacaatgatctagctggagatgggacaaccacctctgtggttcttgctcaagggctgatcgctgaaggtgttaagttgtggcagctgggtggctaatctggtcagattaacccgggtatcgagaaaacagcgaaagcaccagtttgaaaaactacggaatttgtcctaagaaggtccaaaaaaattgagcttgcaaaaagttgctggctgttaatggcgggcaaaaactacgaaatttggtaattatgataagccgaggcccttgaacaaaggttgggtcgggaaagggggttgggttacccc

SEQ ID NO: 92081 - protein, 145 aa, Zea mays
  misc_feature: Ceres CLONE 1580676
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKNNDLAGDGTTTSVVLAQGLIAEGVKLWQLGG

SEQ ID NO: 92082 - DNA, 819 bp, Zea mays
  misc_feature: Ceres CLONE 1580682
  misc_feature: Encodes the peptide sequence at SEQ ID NO. 92083
ctccccgcggtggcggccgctctagaactagtggatcccccgggctgcaggaattcgtctcacccctagaaaaaatctaacgtactccaggctccagctgatttgtccacgcggcatggcgacggccagcgccgcttcaagcttcctcgtcccggcgactgctatcgccccgacaccctctgcatgcccatccacggttcccaagaacaagaagaatgctgccggccggcggcggcgcacattgcagtgcagggccagcggccggcggggcgacgacgaagacagccgcctcctctggctgccccggcgggaagtgctgaccggtctgggcggcgtggccgccagcttcgtcgggtacccggatctggcttccatcgccctggaagcgaaccccgtggagagctgccggcggggcgagaaggtgacggagaagctggtggagtgctcggacccgaacagagacttcccgtgcccgccggcgtcacgggtccccatcgtggacttcacgccggaggcgagggtgacgcgcgtccgcatgccggcgcacctcctgggaccggagtaccagggagagtacagggaggcggtgggggaatatgcgggcgcctggacgggtcgaacccgctgaacttcgcgggcgcaggcgggcgtcaaccagtcctactgcgaacgggcactacccgggtgggacccaacggaaaagaaccgggcccctttgaggtgaaccttttcgttggaatttcccgccccggggcccccgcatgtgacatccttctttctaagaagggggcccctttcgggcaagcctaattggggggt

SEQ ID NO: 92083 - protein, 170 aa, Zea mays
  misc_feature: Ceres CLONE 1580682
  misc_feature: SWISSPROT Homolog: EC 1.10.3.1 Catechol oxidase
MATASAASSFLVPATAIAPTPSACPSTVPKNKKNAAGRRRRTLQCRASGRRGDDEDSRLLWLPRREVLTGLGGVAASFVGYPDLASIALEANPVESCRRGEKVTEKLVECSDPNRDFPCPPASRVPIVDFTPEARVTRVRMPAHLLGPEYQGEYREAVGEYAGAWTGRTR

SEQ ID NO: 92084 - DNA, 874 bp, Zea mays
  misc_feature: Ceres CLONE 1580683
  misc_feature: Encodes the peptide sequence at SEQ ID NO. 92085
  misc_feature (174)..(174): n is a, c, t, g, unknown, or other
  misc_feature (557)..(557): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
ctccccgcggtggcggccgctctagaactagtggatcccccgggctgcaggaattcgtctcacccctagaaaaaactagagagatcccaacagttcgctgccgtcgcctactcgcctccgccagaccgccgccgcgacactacacaccagcgcccccgcagaaggagcaagggngggagaaggaaagcggcacccgccgcacatacgccgcgcggcggagccatagccgagctgcggcacgccacggcggcggcggcggcgacgcgcgccactggctccccttccaagcgcgacgccgaggccgcgtcctcgcccttggtcgcgtctccccgcgtcggcggcggcaaggacgggctccgcccccaccagaggtggccgctcccgccccccgtccgcgccctcctcgcgtgcgaggaccccaggtcccccaccgcctccgcctcctaccggatcctggtcgcggccatcgcctgcttcgccctcgctgcgctcttctccgcggcttccctctgggcacgcctcaacgcgccgtacctgtgccgcaaggaagggattcngctccactgccccaaggtcagccagccagactctctgtgggaagatcctcatgccaatcgacggacacagcactgaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 92085 - protein, 10 aa, Zea mays
  misc_feature: Ceres CLONE 1580683
MPIDGHSTEG

SEQ ID NO: 92086 - DNA, 1010 bp, Zea mays
  misc_feature: Ceres CLONE 1580685
  misc_feature (1010)..(1010): n is a, c, t, g, unknown, or other
ccgctctagaaagggtggatcccccgggctgcaggaattcgtctcacccctagaaaaaagggcagattcgttgtatatgcacgtacgcgtgtgcgattccaggatggacgtttgtccattgggcccgcaatttcggctgcgacagaaatggacgggataaagattccgtcacgtcacgtccccgtcgtccggcaccacccagagcttgtccctctcgcgtgttgcttcctcggttcctccccagttccaacttccaagaacccgtgaagtgaagtgaggaggtcggcggaaccggaacccaggcgatacgagatgatcagaaacggcctccgcaaatccagtgctgcctcctcccaggttagcaagctggtgaaatacattgctagtgctggaagctagcaaggggggcacagtttatcagagccgtttgccagaactttaaagcttctgaaactttcccttcggccgaaagaaaaaaaagggttttaagggggcacagcccaggcgggcctcccatttcaagcgggtagggtcagagccttggatgttccacccctttggcctatagagagaaccgtaggggtccctaattgtcaagtaacagccatggggtaagaaattataattggaagccttcctggcaggaaatgcggggggcaaaaggccttatagggggataaaggaaccccccctcgtaccccaaagcgggcaaactgaggaatttataaaaaaattaccgctttcaacaccttcctttttaggaaccgctaaaaccaataacctctatttggacctcggaaaaggatattttccagcctgttccaccccaggggtaaatgggaaagggggttctttcacaaaatggtgtttcaaagacaaatgaacccccggggttaccagggtggcggtttaattaattgaccgcgaaagcccaaaataaaacatttttttctctttccccatttttacccggtactacactttatgccgctcttattacagtgttcgcn

SEQ ID NO: 92087 - DNA, 839 bp, Zea mays
  misc_feature: Ceres CLONE 1580686
  misc_feature: Encodes the peptide sequence at SEQ ID NO. 92088
ctccccgcggtggcggccgctctagaactagtggatcccccgggctgcttgtattcgtctcacccctagaaaaaaacctcatcttctctccttttgctcggatctcacacacagcccggtccccgatctgcgatcccctcgtcgatccaagatgcagatcttcgtccagaccctcactggaaagactatcaccctcaaggtggagtcttctgacaccattgacaactgcgaggccaagatccaggacaaggagggcattcccccggaccagcagcggctcatcttcgctggcaagcagctcgaggacgggcgcactcttgccgactacgacatccagaaggagagcaccctccaccttgttctccgcctcaggggaggcatgcagatcttcgtcaagaccctcactggaaagactatcaccctcgaggtggagtcttctgacaccatcgactacgtcgaggccaagatccaggacaaagagggcatccctcccggacagcagaggatcatttttgctggcaagcaactcgaggacgggcgctcgctggccgactacaacattcagaaggagagcatcctccacttggtgttgcgtctcaggggacgcacgcagatatttgtgaagactctgactggcaagactatcacccttgaggtcgagtcttctgattccatcgaccaggtctaggccaagattcaggacaaggaggggcatcctccgggaccggaaacggctcatttttgcccgcaagcaactagaggaccggccctcgctgggccgactacaacctttcagaaggagaacacccccccacttggaggctggcatctcagggggg

SEQ ID NO: 92088 - protein, 178 aa, Zea mays
  misc_feature: Ceres CLONE 1580686
  misc_feature (6)..(74): Pfam Name: ubiquitin Pfam Description: Ubiquitin family
  misc_feature (82)..(150): Pfam Name: ubiquitin Pfam Description: Ubiquitin family
MQIFVQTLTGKTITLKVESSDTIDNCEAKIQDKEGIPPDQQRLIFAGKQLEDGRTLADYDIQKESTLHLVLRLRGGMQIFVKTLTGKTITLEVESSDTIDYVEAKIQDKEGIPPGQQRIIFAGKQLEDGRSLADYNIQKESILHLVLRLRGRTQIFVKTLTGKTITLEVESSDSIDQV

SEQ ID NO: 92089 - DNA, 823 bp, Zea mays
  misc_feature: Ceres CLONE 1580687
  misc_feature: Encodes the peptide sequence at SEQ ID NO. 92090
ctccccgcggtggcggccgctctagaactagtggatcccccgggctgcaggaattcgtctcacccctagaaaaaacacacaacccaaagcagccacagcagcctccttcctggcttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgacgcttgtggggtggggaggcaacaacgggtccacgctgacggctggggtcattgccaacagggaggggatctcatgggcgaccaagggacaagtgcagcaaggcaactactacggctccctcacccagggcctccaccatcagagtcggcagctataacgggggaagaaattcttgcgccgtttcaaagccctcctttcccctgggggaacccccgaccaaccttttgtttccggaagggcgggggaaattttagcaaacagggaacctggggccaaaatcccctggaccccggggcccaaaggggggcccgggaaatttttgaacccccgccaaaaaagaaagaccttcaggggcccccctaaacaagggggggagggcccacaggggggggggggcccaaattttttccccgggggtgatatcttt

SEQ ID NO: 92090 - protein, 116 aa, Zea mays
  misc_feature: Ceres CLONE 1580687
  misc_feature: SWISSPROT Homolog: EC 5.5.1.4 Inositol-3-phosphate synthase
MFIESFRVESPHVRYGPTEIESEYRYDTTELVHEGKDGASRWVVRPKSVKYNFRTRTAVPKLGVTLVGWGGNNGSTLTAGVIANREGISWATKGQVQQGNYYGSLTQGLHHQSRQL

SEQ ID NO: 92091 - DNA, 909 bp, Zea mays
  misc_feature: Ceres CLONE 1580697
ggccgctctagaactagtggatcccccgggctgtaggaattcgtctcacccctagaaaaaacgctaccgctcgtttgtacggcagcgacgcctccgcggctcgcctccgctctcctcctcaaggctacaagcgaacgcgagcgcgatagaaagcttaaggcacttcccaatgcgctccccccctcgccgcgatttacacacatggcagcgctgctccacctcaagtcactctagagaaacaccccctgctcctgctactccgacccctgtccctgcgccaccaacatgcgccgcccccgtcccgatctcggcgaccccgccgacgggaccttctcgtccctccgcagtccatcgcccctgctcctgatccggctcacccccccggcccttatcacgccgtagattgcagccgcggctctgattctgctcccgccgcttgtctcgaggacgcgggttcttgggagcttctgggttctggctccggacctaaccggcgttgccatggggaagagcaagaagagcaaggcccgcggctgcggggacgaccagatccacagcagcggacccgacagcgtcggcacgtcgtccaacgcgctggtcagatctctccatctcgtacgcaaccgggcacattcaatcagaagaattttggcctcgaacaagacatcgactccgctctactatatgaagggatctacaaatagagtcggcaatggggtaaacctcctttgaaggcctttaaaaggttaaaggcctccacggtacctattggaacaacaagtctcgccacgtttgtctgagtgcaatttcaaaaatttcttgctaaaaaagggattttaccaaggggaatttcttatttgggcgatcctaggaccaatttagcgtgtaaagagctatattacaactgtg

SEQ ID NO: 92092 - DNA, 843 bp, Zea mays
  misc_feature: Ceres CLONE 1580700
  misc_feature: Encodes the peptide sequence at SEQ ID NO. 92093
ctggagctccccgcggtggcggccgctctagaactagtggatcccccgggctgcaggaattcgtctcacccctagaaaaaggaacctgtctgtatgcggcaccacggcgcccgtggggcccaccacggcgccgccggcagcgtcaccaacccccacccccacctccgccctcccaccggcactcccctcgcctgctccacgacgcttatgcgctcgcgccccgctctcgccgcccacctccggcgcctgctcctcctctctccctccgcccacctcatcatcatccgccgcgccatagcatccgccgccgccgcgcaggcgcagccaggtggcgccccgccggcgaccgcggagtacgaggaggtgctggggcggctctcctcgctcatcacgcagaaggtgcgcgcgaacagcgccaaccgcggcaaccagtgggacctcatggagcactacgtcaagattctggagctggaggagtcgatcgcgcggatgaaagtgattcacgtcgcggggaccaaggggaagggttccacatgcacattcaccgagtcaatcctgcgatcgtgtggcttccatactgggctgttcacctcacacatttgatgggatgtagagagcgatttcagctagatggggttaatatttcttgagaagaaattttggaaggaccttcttggggtggcctggaacaaattttaagggaaaaaaaactgttgatgaaaattccccaggcccagcccaaatttgagggttcccccggggtgggccgccctttcaaaaaatttttttcccccaaaaaaggaaaaaattttttctgttttccaaggggtgggccccaaagaa

SEQ ID NO: 92093 - protein, 131 aa, Zea mays
  misc_feature: Ceres CLONE 1580700
  misc_feature: SWISSPROT Homolog: EC 6.3.2.17 Tetrahydrofolate synthase
MRSRPALAAHLRRLLLLSPSAHLIIIRRAIASAAAAQAQPGGAPPATAEYEEVLGRLSSLITQKVRANSANRGNQWDLMEHYVKILELEESIARMKVIHVAGTKGKGSTCTFTESILRSCGFHTGLFTSHI

SEQ ID NO: 92094 - DNA, 1033 bp, Zea mays
  misc_feature: Ceres CLONE 1580701
  misc_feature: Encodes the peptide sequence at SEQ ID NO. 92095
  misc_feature (357)..(357): n is a, c, t, g, unknown, or other
  misc_feature (361)..(361): n is a, c, t, g, unknown, or other
ccgcggtggcggccgctctagaactagtggatcccccgggctgcatgaattcgtctcacccctagaaaaaaccaagcatcaccacgcatttgacgcggacgcgcgaggaagcaagcaccgccagagtcggagggaaaaagaaaaaagagcacggacgattcgcagctgcagcctgcacaggcggaggcgaggaggaagagagagccccccacgatcggctcgccgggacggccgagggtgcggtggtagtgcgggcgcgtggccccgcgcgtggagtcgggatccgtattgctctctagcagccggccggtggcggcgctcggcgtccgaggccagagcccagagggtgactgacanatanacaatcgtccatccatgggaggatccgggcgcggcgcgcatttcttggacgcgtgcttcctctgccggaagccgctcgccggcaaccgcgacatcttcatgtacaggggcgacacggcgtttctgcagcgactagtgcaggagcgcgcttatggcggcggacgatgcggcggcggcgaacgccaaggccaaggccaaggccagggttggtgtcacgcggggggccctgctttatcgccgggaaatctgaaagcccccagaagggcgtggcaatggtccggggccggcctccctcctgggcccggtgaccccgaagggggggtctccccactcaagggacagccttgtggtcttgcccgcgcatgggcatcttttcttttgttgctttttttcctctgccgctttacaatgactcgccacccggaagggcattctacctcctcgtttaccgtctagagcttgcgttgttttcctctataataaaacgctcggacacctcttcgttggcggccttctgtgtcccctttattggtcggtctttgtgtaccgacgactcgctgggtatcttttatattactcgcccccgctttgatctctacaaaattgttgtaacgctctattatgtcttttgcccctgcctatgtgttctcttcctctttctctctttgtcccc

SEQ ID NO: 92095 - protein, 146 aa, Zea mays
  misc_feature: Ceres CLONE 1580701
  misc_feature (1)..(46): Pfam Name: DUF581 Pfam Description: Protein of unknown function (DUF581)
MGGSGRGAHFLDACFLCRKPLAGNRDIFMYRGDTAFLQRLVQERAYGGGRCGGGERQGQGQGQGWCHAGGPALSPGNLKAPRRAWQWSGAGLPPGPGDPEGGVSPLKGQPCGLARAWASFLLLLFFLCRFTMTRHPEGHSTSSFTV

SEQ ID NO: 92096 - DNA, 1086 bp, Zea mays
  misc_feature: Ceres CLONE 1580702
  misc_feature: Encodes the peptide sequence at SEQ ID NO. 92097
  misc_feature (67)..(67): n is a, c, t, g, unknown, or other
  misc_feature (1086)..(1086): n is a, c, t, g, unknown, or other
atcttttgctgtaagaaaatatacaccacaccaccgatcgttctgcggcgtctatattttccccaanccccccaaactgggactccccacggtggcggccgctctagaactagtggatcccccgggctgcaggaattcgtctcacccctagaaaaaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtgcactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgaacaagaatgacaaagtcagttcaaggaatctccgtgatggctgcctgtttcgaagaactggcttctccttggaccttccgggctttcagagcctgggtaaggaaacccccaaacacccttgtctgggcaaacaccgggaattcccccccgctattgctttcaaaaaccttcgggttcttgaagccatccggattaaaggaacggaatcctctgtttgaaaggaacaaaggtcttgaaagaaggccctccaaccttttgaaggggaatgccttggttgggaagggccggatattagtgggaaaagaaaaatataaatttctccgtggttggggtttttctggttcccctcagaacagcagtgtctgtcaatagggcagaaaccggaaaattctgttatctgagaaaaacttgaaaaaaggggggcggatttaaatttn

SEQ ID NO: 92097 - protein, 135 aa, Zea mays
  misc_feature: Ceres CLONE 1580702
  misc_feature (1)..(136): Pfam Name: HSP90 Pfam Description: Hsp90 protein
MVDAIDEYAVGQLKEFEGKKLVSATKEGLKLDETEDEKKRKEELKEKFEGLCKVIKEVLGDKVEKVVVSDRVVHSPCCLVTGEYGWTANMERIMKAQALRDSSMAGYMSSKKTMEINPENPIMDELRKRAEAEQE

SEQ ID NO: 92098 - DNA, 991 bp, Zea mays
  misc_feature: Ceres CLONE 1580705
  misc_feature: Encodes the peptide sequence at SEQ ID NO. 92099
cgcggccgctctagaactagtggatcccccgggctgcaggaattcgtctcacccctagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttgtttgggattgttgggagagtactctcgtgcaactaggaaaaggcacaaggttccgtcccactgcatgcgtcaagagaaggtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagaacaatgttgtgaacctggttgacatagcaaatgcacttgccaggccagcttccttcacaaccaagtactttgggatgtgagcttggtgcaccatcccaaatttgatgagaagacaggaatttccctgggttaccggggctcttgatactgcaaagcctggctggtccccctttaaggtattcttcaaaaactttgtcccaaggttttggggggtggaaatccctcgaaaagagatttctcttcgccaaaaacccgatgatcttccctgtaaatgtgccaccccgttgggtttcttctccaaatgttgttattgtagggaaaaacctctaatccctgcttctgtaaaaacccctatcagacttataaagggcgtgcaaaacaaccgtaggcccttgaaggaagatcccctaataggacacagtcgtaatat

SEQ ID NO: 92099 - protein, 68 aa, Zea mays
  misc_feature: Ceres CLONE 1580705
MSEQSLLCLGLLGEYSRATRKRHKVPSHCMRQEKVWFSCSDLSFAGAQSRLGFLEGSASTLDCGLCRI

SEQ ID NO: 92100 - DNA, 871 bp, Zea mays
  misc_feature: Ceres CLONE 1580706
  misc_feature: Translation starting site: 352
  misc_feature: SWISSPROT Homolog: EC 2.3.1.119 Icosanoyl-CoA synthase
ctccccgcggtggcggccgctctagaactagtggatcccccgggctgcaggaattcgtctcacccctagaaaaagcaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaaccccaccacgtcaagctggggtaccagtacctggtgaaccacttcctgacgctgctgctggtgccggtgatggccgccacggcgctggagctggcgcgcctcggccccggcgagctgctctcgctgtggcgctcgctggagctggacctggtccacatcctctgctccgcgttcctggtcgtcttcgtcggcaccgtgtacgtgatgtcgcgccccaggccggtgtacctggtggactacgcctgctacaagccccccgccagctgccgcgtgcccttcgccaccttcatggagcacacgcgcctcatcagcgacgacgacaagagcgtgcgcttccagaccaggatcctggagcgctcggggctcggcgaagacacgtgcctcccgcccgctatcactacatcccgcctaatctcagcatggaggcctcgcgcgccgaggcgcagctcgtcatcttctccgcatcgacgacctcgtccgccgcacggggctcaagccaagacatcgacatcctcgtcggcaactgcagcctctttctcacgaagccctcgctcttcgccatgatcatcaccagtacaagctccggagc

SEQ ID NO: 92101 - DNA, 989 bp, Zea mays
  misc_feature: Ceres CLONE 1580708
  misc_feature: Encodes the peptide sequence at SEQ ID NO. 92102
  misc_feature (408)..(408): n is a, c, t, g, unknown, or other
aaagctggagctccccgcggtggcggccgctctagaactagtggatcccccgggctgcaggaattcgtctcacccctagaaaaaaaaggccggcgaacagaggagaggagaggagagactagacccgctagctgaggtcgggcggcgcgctggacacgaacatgatggggagaaaggcgctcggctgtgctcctcttctcctcctcatggccgcctccgtcgctccggccgagctcaacgtcggggcggcgggtgactcgcgcgcggtcacccgggccgacttccccgcgaggttcgtcttcggcgtcggctcctccgcataccaggtcaaaggtgcagatgctgaggacggaaggaagccttgcatctgggacacattgacatatgaaggctattcccccgacaacnccacatgcgatgtaactgcggatcagcttcataagtacaaggacgacgtaaagcttctgcatgagatcggtgtcgatgcctaccgcatgatgattgcctgccctccacttatcccagatggtctggggaggctagaaatccgaaggggcttggagtacttaccacattcctcataaaatgaggatctttaagctaccgaaattcaggccctcaccatgacgattgtacctttttcccaatatcccaacaggcttttttccgggaacggaggtccggcggaggtgaattaggcctcccaatctctttagaaggaattttcacgggcggtccgaaccaacatgtttggtttacaccaactttcggcgaaaggggggcccaaattaactggagtcccccggcccaacgaaacccaaccctttcagaaccaaattggggggtgataaaacccaggggaaattccggctcccctcgggggggagttctcttcccccttttgacatttcaggttcctgggaaaagggacccctccccctccgggaacactataataggcgggggaaacacatctccgtgttttgaac

SEQ ID NO: 92102 - protein, 140 aa, Zea mays
  misc_feature: Ceres CLONE 1580708
  misc_feature: SWISSPROT Homolog: EC 3.2.1.21 Beta-glucosidase
  misc_feature (83)..(83): Xaa is any aa, unknown, or other
MMGRKALGCAPLLLLMAASVAPAELNVGAAGDSRAVTRADFPARFVFGVGSSAYQVKGADAEDGRKPCIWDTLTYEGYSPDNXTCDVTADQLHKYKDDVKLLHEIGVDAYRMMIACPPLIPDGLGRLEIRRGLEYLPHSS

SEQ ID NO: 92103 - DNA, 1070 bp, Zea mays
  misc_feature: Ceres CLONE 1580710
  misc_feature: Encodes the peptide sequence at SEQ ID NO. 92104
  misc_feature (71)..(71): n is a, c, t, g, unknown, or other
  misc_feature (72)..(72): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
ttttttggggttttttttttaatttacaaggaatgttctaattgggagggtaaattaattaccctcccccnngnnnnnccaaaactggagctccccgcggtggcggccgctctagaactagtggatcccccgggctgcaggaattcgtctcacccctagaaaaaagtctcggggttttcttctcgcgggcacctccggctgcttcctttgccaccgcagcaccagcgctgtccatggagcccccgccgctctcctcgttgcaggaggagggggaggaggggcctaccgtcgaggactcgtccgtcttctccgcagccgttgtgccgcctcgccccgccacgcaccactcgctccacaagtacgcgccgctggactggtccgcctacttcgacgaggagcgccgcgtagccatccccgacaccgacaacgttttcaatgcgtacacgaccggatcagacgggcccgtcgtgttctgcctgcaccgaggcggttattcggggctttcagttgctctagcagcaagtcaaatgaaggacaaggctcgtgttgttggccatggaattttaaggggggatggtaaaaatccataaaccaaaggatggaacctgaaatttgttcccatgtggaaacgtcctaaaccaacaggaaggttccccagcccggttttagatcgtttaccaaaccgttaaggggagagaaatttggccccacgcgcagtccatattttaaaaaacttctgggttggggggggcacctaaatcacgtgggtggcgcggggtttcacgattggggcttaatcaacaatgaggggggctgtgtcgaggaaaatagcgaaaaaatttaggaaaaattccttccaatgatgggcctttggtttggtccgcattggaacggtttgtttcctaagaggaaaaccaggcaaagaggcgtttcccattaatgtttcactaatggccgggaaagaattcttttattccaaaaaaccgggggccacccggcctatttttccctctagcccattggtaaacaaacgcaaattctgaaatggggaagtggtctcaaaaaggggg

SEQ ID NO: 92104 - protein, 118 aa, Zea mays
  misc_feature: Ceres CLONE 1580710
MEPPPLSSLQEEGEEGPTVEDSSVFSAAVVPPRPATHHSLHKYAPLDWSAYFDEERRVAIPDTDNVFNAYTTGSDGPVVFCLHRGGYSGLSVALAASQMKDKARVVGHGILRGDGKNP

SEQ ID NO: 92105 - DNA, 915 bp, Zea mays
  misc_feature: Ceres CLONE 1580711
  misc_feature: Encodes the peptide sequence at SEQ ID NO. 92106
  misc_feature (392)..(392): n is a, c, t, g, unknown, or other
gcggtggcggccgctctagaactagtggatcccccgggctgcaggaattcgtctcacccctagaaaaaagcccaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcnctccgcgccatgtgcggcgcgctcatcccctcgctgcccgccgacgccgacgccggccgcggcgacccgcccggcggcaaggacctcgagcgcttctacctcgcctccgcggccgactccaccatccccgacgaggtcgcggagctgatggtgacgcggtgcatccgcgaggcggtggcgctggcgtgggtggtgctttgggcgctgagcacgcgggcgggcacgctgctgctgtgcggccggctcagcctcggcgccggcttcccctacgtgcgcaggttcgccgacatggcgccggaacggccggaaggcggccctgccgcgctggaaccgggtggcgctggcttcttcccggctcggcatcgcctttcgccaatcgtcaaagatcctcttgccactaccgtcttcctacgccatgggggaacgcaaaacttcccaagaaatccatacctgggaaagcggaatgggatacagcggtgggacaaagcccccgggaaggatatcggggtctcggaacgggcaa

SEQ ID NO: 92106 - protein, 233 aa, Zea mays
  misc_feature: Ceres CLONE 1580711
MAVQGGEERESGKGAAPAVVSGGEAGPPGRRTARGHPLLRGGWRRDRYTHGMRPAQMEALRAMCGALIPSLPADADAGRGDPPGGKDLERFYLASAADSTIPDEVAELMVTRCIREAVALAWVVLWALSTRAGTLLLCGRLSLGAGFPYVRRFADMAPERPEGGPAALEPGGAGFFPARHRLSPIVKDPLATTVFLRHGGTQNFPRNPYLGKRNGIQRWDKAPGKDIGVSERA

SEQ ID NO: 92107 - DNA, 1333 bp, Zea mays
  misc_feature: Ceres CLONE 1580712
  misc_feature: Encodes the peptide sequence at SEQ ID NO. 92108
  misc_feature (1213)..(1213): n is a, c, t, g, unknown, or other
ctcccctttttgccctctttctctcctcctccgcttttgttttccccccttttttttgttcggtccaaagctggactccccgcggtggcggccgctctagaactagtggatcccccgggctgttggaattcgtctcacccctagaaaaaaaaaaaagcgcccacttcttatactcccaccttctgctccctctcacggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttctagggtagatggatcatctccaagaaggatgaataccaaggtgtatggaagcacgccatgagtgatgggcatgaggactatggcctccttgttagttgaaaggcaaccaaattctccataatccaggagcttgcatgatcctttaccttaaatgaaggggaatactggtcctgcccttttgaacttggacatttcctaaaagggcccttgaacgttggaggatcccccctacttatagtaccatttccaccccctcagtgaattctggcatgggaaaagcccaaaggtagcaccggattattggaatacctcccatttctcgctattttgcgggcccggggattctcactacattaaatgtggcgcggttccaaatctcttccctacggagtctccaatatttgacttcacccacttatagtcacacactcgagagttcccctcatattactcttgcgcccatatattttaatgtttctcgcgtgtggtactcgtcacctccttatagataaaatgtgtccccacacccccgcgttcttgtcttcctctcactattctccaaaactgaaagcctctcctctctctcaaagtgggatcgctaaataatcacagctcctatagtcgacttttatacacgcgccctaggacgcatattgtgatagtgccccttatagatacctttatataccgcctctcgtctcggggggtgtccacggatcagatgtaagatcacttcgtgtcgaaatctatctcgctgttgttattgcacctgatgtatatacttattgtgcaaccctcgtctcttcttcttaattcccccactcccctcgatatctactatctctttgaaatccngcggatgttattcatgtcagccacgcggtagccacctgtgttatatagaacaatagcacttataaaatccccttgagcccctggaaggtctgctatacatcctcttacagcatccttgtt

SEQ ID NO: 92108 - protein, 34 aa, Zea mays
  misc_feature: Ceres CLONE 1580712
MMGGRALLLLLVSALLVQIRASDPLLYEPFDEDF

SEQ ID NO: 92109 - DNA, 1199 bp, Zea mays
  misc_feature: Ceres CLONE 1580714
  misc_feature: Encodes the peptide sequence at SEQ ID NO. 92110
gtggggttggtttttttttttatggattgtcttttataggtggggagtattcaacaaaatataattttcccaaactggagctcaccgcggtggcggccgctctagaactagtggatcccccgggctgcaggaattcgtctcacccctagaaaaaatataaacagcccccctcccgttccacccggaacacttagcactcttctccccctcttctcttctcgtagacgagcatatctccaggggtgtctccgcctccggccactgcggccagcgctcggagcatccgtggggttccgcgcggaggtgggctgccatgaacaacaaccagctgcaagagctggcgcagcggagctgcttcaacctgacgtctcacacgtgcctgccggaggggccctaccatgcgccgagtgtcaaagcggaagcgaacttcaacggggagcagtccgagagcccaggcttcttcagtacgctccgccactctgagcacgccagcgcgtaggtcgcgcttctccgctctctcgacggagcgggccgtcctactcactggccgcccgcatcctgaatggaaaaagggattttataaataacccttcaacagggagggcagcctcaaaaaaggttaggggctgcccccccgcccatttgtaattaccaacaaaaaacgaatcctggagcggttgggcacacccgggcagggttttttacaaacattgcaaactggttgtgaagccttaaacccgtgggtcattcacccagtgttttagcaaggggggagaagaacattgtccccgagaggctacaaatctgaggaaaaagcacggggccgcttggtaaaagaaaaaaaataggggacacccaaattgcaagggcaatgggcccggggggggttctacaggcatctgtttaacaaagcataaatgtgtgccttttacccggcggataaggcaaaaaggtggaaaattctcaaattcctctaaggtggcgagaaaaccgaggaaaaaaacacggtggggcgttggtgagtctcagggtgaaccaatgtatttaagagggtatgtggcccccccataagacaccctctacctggttaaaagataaattcggggtctggggaacgggagaatatataaatgggacgccaagttgggcccaactttttttttccctcttcttgaggtttgtacccacatttccccgca

SEQ ID NO: 92110 - protein, 61 aa, Zea mays
  misc_feature: Ceres CLONE 1580714
MNNNQLQELAQRSCFNLTSHTCLPEGPYHAPSVKAEANFNGEQSESPGFFSTLRHSEHASA

SEQ ID NO: 92111 - DNA, 832 bp, Zea mays
  misc_feature: Ceres CLONE 1580716
  misc_feature: Encodes the peptide sequence at SEQ ID NO. 92112
  misc_feature (821)..(821): n is a, c, t, g, unknown, or other
ctggagctccccgcggtggcggccgctctagaactagtggatcccccgggctgcaggaattcgtctcacccctagaaaaattccctgcccccggtgagctgccactgccagcttccccgtgcgcgagctgtgctgctgctcggcggcgcgcccactccccggccgctctctcgtcaccccgcctgccggtaatcggtctctatatatataggtggttcgaggtgatcggcagaaccacacaggcaaagatggcgagcgtgcacaaggccaccacccttgttctcatgttctgcctgctagcgctggggagagcggagtacctcaagtacaaagacccgaagcagcccgtcgctgttcgcatcaaggacctgctgggtcggatgactctcgctgaaaagatcggccagatgacgcagatcgagagggaaaacgccacggccgacgcgctggccaaatacttcataggtagcgtgctgagcggcggaggcagcgtgcctgctcctcaggcgtctgctcaggcttgggccgccatggtgaccgagatgcataagggcgctctttctacgcgtctgggtataccgatcatctacggtatcgatgcagtgcatgggcactacaacgtctacaaagctactattttccctcacaacgtcgggcttggagctaccagggaccctgacctcgattagagaattggagaagcaactgctcttggagttagagctactggaattccttacgccctttgctcctgtttagcggtttgtagagaatctagatggggacgctgctatgagagctacagtgaggatccaaagggntgtccagtcac

SEQ ID NO: 92112 - protein, 146 aa, Zea mays
  misc_feature: Ceres CLONE 1580716
MASVHKATTLVLMFCLLALGRAEYLKYKDPKQPVAVRIKDLLGRMTLAEKIGQMTQIERENATADALAKYFIGSVLSGGGSVPAPQASAQAWAAMVTEMHKGALSTRLGIPIIYGIDAVHGHYNVYKATIFPHNVGLGATRDPDLD

SEQ ID NO: 92113 - DNA, 866 bp, Zea mays
  misc_feature: Ceres CLONE 1580724
  misc_feature: Encodes the peptide sequence at SEQ ID NO. 92114
ctccccgcggtggcggccgctctagaactagtggatcccccgggctgcaggaattcgtctcacccctagaaaaagccccccggacgcaaccgcgtccgaccaccgccgccggaaccctacgcccccgcctcgccgcgccatggcggatccgccgcccgtggctgcctccgccttgccggcgcagcccgaccaggtcgccgcctccgtgtccaccccgcagaaccccaaccctaaccccctcctctccccccaaatccccccgtccccgaccgtctccgacctctccgcgcacatctcgtccccgcagcagctcgacccggtggctgcggcagctgccgcttcgggcggcgggggatccatggattaccccccgcgcccgccgcagctgcaagcgccttcgcccacgcaggcggggcccggcgccgccgggtttggccagatcccccgctcggggtcggcctcacgcctctccacggtcagccagctccagcagtacgcggctaggatgtacggcgggcagatgagcttctcgggtggcggaggtctcgtgggccagcagcagcagctggcggggcgcgctctcgtgcttgggcacgcccagctggtgatgctgcaaggccagggtaacgcgggatctgcggcacattttgggcttcagtcccagatgatggcccatgctacgcaaaaggacatggcatcaggcactcaattgaaatatgctaatacagctccagcgctacagggatgcagcacatgggtgtcctgggtctatggggatgaccggatgagaccgaatggaacttttcctatggtgctcaaaaaggttcgtccatctcaaatgaaaccacaacgtttaacacctggaa

SEQ ID NO: 92114 - protein, 242 aa, Zea mays
  misc_feature: Ceres CLONE 1580724
MADPPPVAASALPAQPDQVAASVSTPQNPNPNPLLSPQIPPSPTVSDLSAHISSPQQLDPVAAAAAASGGGGSMDYPPRPPQLQAPSPTQAGPGAAGFGQIPRSGSASRLSTVSQLQQYAARMYGGQMSFSGGGGLVGQQQQLAGRALVLGHAQLVMLQGQGNAGSAAHFGLQSQMMAHATQKDMASGTQLKYANTAPALQGCSTWVSWVYGDDRMRPNGTFPMVLKKVRPSQMKPQRLTPG

SEQ ID NO: 92115 - DNA, 967 bp, Zea mays
  misc_feature: Ceres CLONE 1580725
  misc_feature: Encodes the peptide sequence at SEQ ID NO. 92116
tcccgcggtggcggccgctctagaactagtggatcccccgggctgcaggaattcgtctcacccctagaaaaacccgctggccgctgctctcttcctccctcctcctcggtccactccaaccccaggcctgccgcggccacagacgggccgcgccgccgccgcagcttccgattccgcttccgccggccgttctgccgcgcgcgcgcctgtggcgcttgagcgggcggatttgttcggcccgttctttggccgccgccgttgcgctgcgccgtgttggcttccagttcccatccaggcgtcttgagattccccggccggagatctgcttaattcgtacctctctctggttctgaggcccctccgaggtggaggaggagctcgtgggtcgacgaaagaacaatcgtttctttgcccactcctgcggctgcttctccgtcccaggctttccagccatggaggagggtggaggtggccaacatggccgcggtggagagctgccaccgggtgctggctctgctctcgcagcagcaggacccagccctgctcaagagcgtagcttcagagacggctgaagcctgcgccaagttcaggaaggtagcggccctcctcggcagtgccagtggcggaggtggctgtggccatgctagaggcaggttctccagacgagtccggcctctggggctcgtcaaccagaagagccccttggggatcgccaccggcagcggctacccgctggagatgatgcccagcacagctgctgctgctgggtctccatctccacctcagtcgactagctatgcgcaaatgcgcgctcggctttagcagtgcgcagaatccccacaagggctggatttggcctgcttcacagccagtgtaccctccttcatttggagcccccaagctgtccagacacggtcgggcaagttccagatgggaagggttgccctaggtaaccgttccccaagca

SEQ ID NO: 92116 - protein, 114 aa, Zea mays
  misc_feature: Ceres CLONE 1580725
MAAVESCHRVLALLSQQQDPALLKSVASETAEACAKFRKVAALLGSASGGGGCGHARGRFSRRVRPLGLVNQKSPLGIATGSGYPLEMMPSTAAAAGSPSPPQSTSYAQMRARL

SEQ ID NO: 92117 - DNA, 829 bp, Zea mays
  misc_feature: Ceres CLONE 1580726
  misc_feature: Encodes the peptide sequence at SEQ ID NO. 92118
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
ctggagctccccgcggtggcggccgctctagaactagtggatcccccgggctgcaggaattcgtctcacccccccctagaaaaacagggatagcacgccgaggaaggtcgacatgtcgtctccgccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggccttcgacgggccgccgctgctccccgccgacccctacgcgcgcgccgcggcccgcttctgggccgacttcatcgagaccaggctcaccaagcccttcttcatggcgatctgggtggaggagcgcgaagcgcgcctgcggttcgaggaggaggccaaggagctcgtggcgctgctggaggcgcagctcgagggaaagaggttcttcgccggcgacaggccggggtacctcgacgtggccgcgtccgcgctcgggccctggcgcagcgtcatcgaggagctcaacggtgtggcgctgctcaccgaggacgaccacacggcggcagaccctagccacgtgcacggacctgctctaactagcaggcgagactcatccatagctgactcgctgggtctttcacatcaacgtatgatcgannnnnnnnnnnnnnnnnnnnnnnnnnnnnnnnnnnnnnnnnnnnnnnnnnnnnnnnnt

SEQ ID NO: 92118 - protein, 219 aa, Zea mays
  misc_feature: Ceres CLONE 1580726
  misc_feature (6)..(81): Pfam Name: GST_N Pfam Description: Glutathione S-transferase, N-terminal domain
  misc_feature: SWISSPROT Homolog: EC 2.5.1.18 Glutathione transferase
MSSPPPPVKLIGFFGSPYAFRAEAALCLKGVPYELILEDLFGSKSELLLHHNPVHKKVPVLLHGDGRAISESLVIAEYVDEAFDGPPLLPADPYARAAARFWADFIETRLTKPFFMAIWVEEREARLRFEEEAKELVALLEAQLEGKRFFAGDRPGYLDVAASALGPWRSVIEELNGVALLTEDDHTAADPSHVHGPALTSRRDSSIADSLGLSHQRMI

SEQ ID NO: 92119 - DNA, 920 bp, Zea mays
  misc_feature: Ceres CLONE 1580730
  misc_feature: Encodes the peptide sequence at SEQ ID NO. 92120
  misc_feature (863)..(863): n is a, c, t, g, unknown, or other
ctggagctccccgcggtggcggccgctctagaactagtggatcccccgggctgcaggaattcgtctcacccctagaaaaaatcctcctctttccattccactctctcactctctctctaatcacactttcgacactgatcggtactctagtgtccgactcgtcacaattttagcgagaacgagcgagcgagcgagggagaggatgggttccacaggaccggcgagcgggttcgcggcgccggagcgggacatcgacgatctgccgcggaacgacgcctactacacggcgctcacgccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcggccacggaagcacggttgctgtgatagctcctaatgtcccggctgtctatgaagctcacttcggtgtcccaatgtcaggagctgttgtgaactgcgtcaatattcggctaaacgccgagacaatagcattcctccttgaacactccgtggcagaagttgtgatggtggaccaagaattcttcaccctagccgaagaatcgctgaaaataattggcaagaagaagacgtcggctttcaggcggcctccaatcttgatcgtcatcggcgacccaacctgtgatccccagtctctacagcatgctctgggaaagggagccatagagtatgaagagtttctgaaaactggtgacccggagttcagttggtagccaccgaaagatgaatggcagagcatcgcccttagctacacctccggggactacttccagncccaaaggggcgtcggtgttgcatcaacgcgcgttgcctttatctcttggcactcag

SEQ ID NO: 92120 - protein, 199 aa, Zea mays
  misc_feature: Ceres CLONE 1580730
MGSTGPASGFAAPERDIDDLPRNDAYYTALTPLWFLERAALAHPGRASVVHGPVRYTWADTYRRCRRLASALARLSVGHGSTVAVIAPNVPAVYEAHFGVPMSGAVVNCVNIRLNAETIAFLLEHSVAEVVMVDQEFFTLAEESLKIIGKKKTSAFRRPPILIVIGDPTCDPQSLQHALGKGAIEYEEFLKTGDPEFSW

SEQ ID NO: 92121 - DNA, 901 bp, Zea mays
  misc_feature: Ceres CLONE 1580733
  misc_feature: Encodes the peptide sequence at SEQ ID NO. 92122
  misc_feature (626)..(626): n is a, c, t, g, unknown, or other
gcggtggcggccgctctagaatagtggatcccccgggctgcaggaattcgtctcaccccctagaaaaaacgcgctcctctctcgccgtcgccaaccatcgccgcctcgcgtccggacccgccgttcctccgaggaaatggctgcactgcaaccctcattttcaccagcaatgactttgaagagtagctgcagcgccctgaagttcccaaaaactgcactgttatctggttttggtggcattccacgccttcaagatgcgcaagacaggaacactagcgtcgcttatttgatccccaaggctgcttcagtgactgaccagtcaatagcagagccaccaaaaaccaagcaaaataggcacacagtcgacccaacagctccagaatttctgccactcccatcttttgaagaatgctttccaaggagtaccaaagaatcaagtgaaatcatccacgaggaatcaggtcatgtcctcaaggttccattccggagagtccatttgactggagatcagaagcactttgatacatatgacaccagcggtcctcaaaatataagcccaagggattggactccccaagataaggaaggaatgggattgataggagggaaaaaagctgggtagtccntcggtacacacaaaatgtattatgctaaacaagggaattggtaccagaggagatggttttactgtggccagcccgggaagcacctttagccctgaaatttttccggaacaaaaatttccccctgggaaaaaaccttaatatcccttcccaaaaaaaggggcccccggtaattggaacccaccttgttgtgggggaaaaaaaccccctctgaaaggggggaagaacaaaattggggggaaatcccccgtgggggggcccccccctgggaagaagaa

SEQ ID NO: 92122 - protein, 161 aa, Zea mays
  misc_feature: Ceres CLONE 1580733
MAALQPSFSPAMTLKSSCSALKFPKTALLSGFGGIPRLQDAQDRNTSVAYLIPKAASVTDQSIAEPPKTKQNRHTVDPTAPEFLPLPSFEECFPRSTKESSEIIHEESGHVLKVPFRRVHLTGDQKHFDTYDTSGPQNISPRDWTPQDKEGMGLIGGKKAG

SEQ ID NO: 92123 - DNA, 789 bp, Zea mays
  misc_feature: Ceres CLONE 1580737
  misc_feature: Encodes the peptide sequence at SEQ ID NO. 92124
  misc_feature (297)..(297): n is a, c, t, g, unknown, or other
ctccccgcggtggcggccgctctagaactagtggatcccccgggctgcaggaattcgtctcacccctagaaaaagcaacctttgccgagcggcaggacgacgaagcggaggagttgctgtgcggggtgaaggaagaggagtcggctcaggtacaagaaccggccaagaatccgtcaggccgtcccaccccactaccccaggaaggggtcgaaacagcggccggccccggcctcacttcacctcggcagcactgggttaattccatggagccacgttttctacaagtttcgtgattgngtggtgtggggttgatgaacttgaagcatcactcatccggtcagacgtgtttcgtagaccttgacgctgagctatcggagttgggtttccaaaaaaaggtggagctctgagaagttccgcattcttctaaaggaagtaggagatacccaggaagcagcatggcattttcttacagcaatgggaggacattgccctcgaaatgggaggatgcagagaggtggatcttcagtcccaattccagcgacatgcgtggaagaactacggttgctcatggtcggaggccaaagtctaaaagtggccccctggggcctccaggaagacttggtggacagtattcatctgtttcttcggtgtcattgcttgatagtgggagagttggacctattacatcaaattctcatttttcagcaggagtactaatgccaggacatgtttgtgggagaaaaaatacaaatggggcctattcaggtagaccaattggtgacgaatcaa

SEQ ID NO: 92124 - protein, 111 aa, Zea mays
  misc_feature: Ceres CLONE 1580737
MAFSYSNGRTLPSKWEDAERWIFSPNSSDMRGRTTVAHGRRPKSKSGPLGPPGRLGGQYSSVSSVSLLDSGRVGPITSNSHFSAGVLMPGHVCGRKNTNGAYSGRPIGDES

SEQ ID NO: 92125 - DNA, 868 bp, Zea mays
  misc_feature: Ceres CLONE 1580738
  misc_feature: Encodes the peptide sequence at SEQ ID NO. 92126
  misc_feature (707)..(707): n is a, c, t, g, unknown, or other
ctggagctccccgcggtggcggccgctctagaactagtggatcccccgggctgcaggaattcgtctcacccctagaaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaagaccatgaaggaactgctgggcggcaagggcgcgaacctggcggagatggcgagcatcgggctgtcggtgccgccagggttcacggtgtcgacgggagcgtgccagcagtaccaggacgccgggtgcgccctcccccgcgggctctgggnccgagatcgtcgacggcctgcagtggggtggaaggagtacatggggcgccaccctggggcgaatcggagcgcccggttcctgttcttcgttcgcgtccgggggccgcccttgttcatgccccggcaatgatgaaaacgggggcccaacctgggggctcaac

SEQ ID NO: 92126 - protein, 181 aa, Zea mays
  misc_feature: Ceres CLONE 1580738
  misc_feature: SWISSPROT Homolog: EC 2.7.9.1 Pyruvate, phosphate dikinase
  misc_feature (139)..(139): Xaa is any aa, unknown, or other
MTASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTGACQQYQDAGCALPRGLWXRDRRRPAVGWKEYMGRHPGANRSARFLFFVRVRGPPLFMPRQ

SEQ ID NO: 92127 - DNA, 886 bp, Zea mays
  misc_feature: Ceres CLONE 1580739
  misc_feature: Encodes the peptide sequence at SEQ ID NO. 92128
  misc_feature (760)..(760): n is a, c, t, g, unknown, or other
  misc_feature (852)..(852): n is a, c, t, g, unknown, or other
aaagctggagctccccgcggtggcggccgctctagaactagtggatcccccgggctgcaggaattcgtctcacccctagaaaaaactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacggccttccccggctggcggaacacgcccgtcacgacgcggcagcgcgtcatgttcaagttccaggagctcatccgggctaacatggacaagcttgcagagaacatcactacggagcaggggaagacgctaaaagatgcttggggcgacgtgttccgcggcctagaggtggtggagcatgcttgtggaatgggaacactgcaaatgggcgaatatgtatcaaatgtttctaatgggattgacaccttcagcattcgggagccacttggtgtttgcgctgggatatgccccattaatttttctgctatgatncccctatggatgtttcccatagcaagtacgtggtggcaatacttttgtcttaagccatcgaaaaaggacccggggctgctatgattgctgcngacctgccatgggagctgggtttgcctagggggt

SEQ ID NO: 92128 - protein, 222 aa, Zea mays
  misc_feature: Ceres CLONE 1580739
  misc_feature: SWISSPROT Homolog: EC 1.2.1.27 Methylmalonate-semialdehyde dehydrogenase (acylating)
  misc_feature (195)..(195): Xaa is any aa, unknown, or other
MLRSALFRSAPGLRRSPATAHLSTAAAAAAAWLSNGPASAPSRVRLLIGGEFVESRADEHVDVTNPATQEVVSRIPLTTADEFKAAVDAARTAFPGWRNTPVTTRQRVMFKFQELIRANMDKLAENITTEQGKTLKDAWGDVFRGLEVVEHACGMGTLQMGEYVSNVSNGIDTFSIREPLGVCAGICPINFSAMXPLWMFPIASTWWQYFCLKPSKKDPGLL

SEQ ID NO: 92129 - DNA, 1222 bp, Zea mays
  misc_feature: Ceres CLONE 1580740
  misc_feature (14)..(14): n is a, c, t, g, unknown, or other
  misc_feature (21)..(21): n is a, c, t, g, unknown, or other
  misc_feature (27)..(27): n is a, c, t, g, unknown, or other
  misc_feature (41)..(41): n is a, c, t, g, unknown, or other
  misc_feature (64)..(64): n is a, c, t, g, unknown, or other
  misc_feature (68)..(68): n is a, c, t, g, unknown, or other
  misc_feature (871)..(871): n is a, c, t, g, unknown, or other
tttttttttttttnttttttntttttngtgggggtgtgggnggtgggagggggcggcctgaccncacntattggtgttggtggtcataactgggactccccgcggtggcggccgctctagaatagtggatcccccgggctgctggaattcgtctcacccctagaaaaaatatatcatccggagaactgagaaagcccactcactagtcgttactcccaacaccgggaatccatggagcctgcctatgtcgtcaccctctccttcctcttcctcttattgctccaccatctcctcggccgccaccgcctcaggacctacggcaagaacaaggagaacgcagctgccaccgagccctcccgccatcccgggcttgggtcacctccacctcttacagaagactatccacgcggcgctcgctcgcctcgcagagcgctacagggcggggatcatcatccggctgcgctcgcggcaagccgtgggggacgcactccgcaggttaaccccccgagatgcttcaccgataaaggaccctctgcgttggcgtaaccaacccgcgggattccccacgcttccttgcctggtttttgcttttcggcgggcggtgagggcttccaaaatggtggccggattaaggccctccgtacttggggagacaaacacttccctccctgggttaaaaaccaattggaagaaaaagcttccccgggaatccgtgcgttcgaaaacccagtttctagggcttgtggaagtaccaatcccccgcggtttcacaaatattccccgcgcccccaaaagggggggctcatcacgccacataatgtggaacctccccgcgatagaggaaaagtgtataatacaaaaatatcccgancccccaccccgcagttagatctccccccgagatacaggggcggggcccaacgagagaggggggtcccaagaccccttataaatacacgggaaaagacctatttctcccaaagatctccccccaccacaaagagagcgtcccgctggaataaaaaatgaacccacttcgccgcgcagaaaaaccatattaaggcgcccacacgggggctcagatggggggggttaacaaaaaaaaaccccggaaaactctggtgcctcaagagggagggccccaactcataatttcttatcttaaatgacacgcctggaaaaacgtggtgttcacatataccgcgtgttattccagagggag

SEQ ID NO: 92130 - DNA, 979 bp, Zea mays
  misc_feature: Ceres CLONE 1580742
  misc_feature: Encodes the peptide sequence at SEQ ID NO. 92131
  misc_feature (860)..(860): n is a, c, t, g, unknown, or other
  misc_feature (871)..(871): n is a, c, t, g, unknown, or other
ctccccgcggtggcggccgctctagaactagtggatcccccgggctgcaggaattcgtctcacccctagaaaaaatcgtgctctgctcactctctccaagaccaaatgacatgcgttgcgttgcgttgcttgctagcaacttgatatattcttgctgccatgccaatcgtcggtgctgatcctaatcatcctgtctaagctcagacgacgacacatcgagggatgcccctcgccggagccgcgacggccgcgaacctgccacgactcgccccctacgcccaagtaccagcccgcccaccacgctgtcttcgccactcggcatcgccgacgtggcggccctcgccgacgccgacgccgacgccaagagcgtctccccgcccgcatggccggacgacgacgacgacgacgtcgccgggagggacgactgggtccaccatctcccgccccttgacatgcacatgccgccgctcggcctcggcgccgcagaggcctgggagccccacgcgcaacctccgggtccgggcggcctcaccctctcgcacgcccagcagacccacgacagcaccttcctcggctggtttattgccgacgacgtcgccatgtcgggcgtcatggacgaccacaactcccactcggtacttcatgacctcgaccacataccctcttcctccgtgccgccgccgcagttccagcctctcgcgccccacgtgcactacccgcccaagctgcaccaccacaaaaacccgtggtggccggcgtcgctcccagcacacgctcctgaaaccaagccggagcgccggggaaccgacgacgcttcacggcggtggacagatcgccgagccgccaagcttgccgagccnggaacgttttngggcccgcagaatatggggcggttaactacctggtcccccgggggcgcgacagggaaccacgtttccgtcgcctttattttagaagtttggccgctgcctgtacaagc

SEQ ID NO: 92131 - protein, 175 aa, Zea mays
  misc_feature: Ceres CLONE 1580742
  misc_feature (140)..(140): Xaa is any aa, unknown, or other
MHMPPLGLGAAEAWEPHAQPPGPGGLTLSHAQQTHDSTFLGWFIADDVAMSGVMDDHNSHSVLHDLDHIPSSSVPPPQFQPLAPHVHYPPKLHHHKNPWWPASLPAHAPETKPERRGTDDASRRWTDRRAAKLAEPGTFXGPQNMGRLTTWSPGGATGNHVSVAFILEVWPLPVQ

SEQ ID NO: 92132 - DNA, 845 bp, Zea mays
  misc_feature: Ceres CLONE 1580747
  misc_feature: Translation starting site: 196
  misc_feature: SWISSPROT Homolog: EC 5.3.1.5 Xylose isomerase
  misc_feature (653)..(653): n is a, c, t, g, unknown, or other
tggagctccccgcggtggcggccgctctagaactagtggatcccccgggctgcaggaattcgtctcacccctagaaaaaacccgccgagttcagcagcactctcctccgccctcttccaggtctagcagagattggggacgcgtgggcatcggagattgcctcgggagcgcgtttcctggtcaactaaggccggcatgaagggctgctcagagcgcttgctgtttctgctgctgctgctgctggcatcgtcgtcgttactgtccgctgtgattgccgcgcagcagacttgccccgccgacctcgacagcaaatgcgatggtggcgcgtctgatgatgattgggagggggagttcttccccggcgtcccgaaaatcaagtatgagggtccaacaagcaagaaccctcttgcttataagtggtataacaaggaggaagtgattctcggtaagaagatgaaggattggatgcgcttcagtgttgcgttctggcacacgttccgcggtactggcgctgatcctttcggtgctcctacaaagacttggccttgggaggatggcacaaattcgttggccatggctaagagaagaatgagagctcactttgagttcatggagaagttggggagttgacaaatggtgcttccatgacaggnatattgccccggatgggaagactctttgaagaaacaaattctaacttggatgagatagtccagctggcaaaacaactgcaggggtgagacaaatttaaagccattgtgggggtaaccgcacagctctttaatgcatccccgtttacctgcattggcgctgcctaccaagccccaaaggtttaaagtttattt

SEQ ID NO: 92133 - DNA, 925 bp, Zea mays
  misc_feature: Ceres CLONE 1580748
  misc_feature: Encodes the peptide sequence at SEQ ID NO. 92134
  misc_feature (633)..(633): n is a, c, t, g, unknown, or other
ctccccgcggtggcggccgctctagaatagtggatcccccgggctgcaggaattcgtctcacccctagaaaaatcgcccgcttcctgctctctctttctctttctcccctgcttccccttccattcccgacggacgacgcaacaacccgcctgccctgccctgcctcacgctcgcacccgcggcggcgcggagggccggaacctaaaccctaaccctagcggcccgcccgcgatggggcagtgctacgggaaggcaggcggcgcgtcgtcgcggcgggcggaccacgacgaccacgcccacgcggtcgcgccgccgtccccgctgccggccaacggcgcgccgccgccgcagcccgccacgcccgggcgccgcaagtccggatcggccacgccggtgcaccaccaggcggcgacgaccgcctggcccagcccgtaccccgccggcggggccagcccgctccccgcgggcgtgtcgccgtcgcccgccaggtccacgccccgcaggttcttcaagcggcccttcccgccgccctcgcccgccaagcacatcaaggccactctcgccaagcgcctcggcgggggcaagcccaaggagggcaccatacggatgaaggggcgggccgccgggcgtcnccgccctatctccgccgaggcccgagcgcccgtttggaacaagacggttcggctttcgccaacaactttcgggggccagtaccaacctccggaaaagaagggccgggaaggggaaactttggccaaaccggaccccccccggggcaaaaagggcgaagtaaaaaggccatgccggtccccgtcaaaatctcccccaaagctaaaaggacaacgcgctttccctgtaaataagtcccgagggaaacaaaaatttgaaaaccctatcgggccaatattccgcgcaaattctgga

SEQ ID NO: 92134 - protein, 231 aa, Zea mays
  misc_feature: Ceres CLONE 1580748
  misc_feature (134)..(134): Xaa is any aa, unknown, or other
MGQCYGKAGGASSRRADHDDHAHAVAPPSPLPANGAPPPQPATPGRRKSGSATPVHHQAATTAWPSPYPAGGASPLPAGVSPSPARSTPRRFFKRPFPPPSPAKHIKATLAKRLGGGKPKEGTIRMKGRAAGRXRPISAEARAPVWNKTVRLSPTTFGGQYQPPEKKGREGETLAKPDPPRGKKGEVKRPCRSPSKSPPKLKGQRAFPVNKSRGKQKFENPIGPIFRANSG

SEQ ID NO: 92135 - DNA, 1015 bp, Zea mays
  misc_feature: Ceres CLONE 1580750
  misc_feature: Encodes the peptide sequence at SEQ ID NO. 92136
  misc_feature (68)..(68): n is a, c, t, g, unknown, or other
  misc_feature (69)..(69): n is a, c, t, g, unknown, or other
aaaaaaaaaaaaacaacaagaaaaaaggggaatgggggtgttggaaaacgagggaggtctaggccccnnttcccgcaaactggagctcaccgcggtggcggccgctctacaatagtggatcccccgggctgcatgaattcgtctcaccccctagaaaaaaaacagaccacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagagcaaaataaacccactcatcaaggccgccgtcatcacggccttcgtgggccagttcccgggcgtcaacgggcccccccccactgcggccaggctcgacatcgaggtgggcggcgtcgtgcctctgcacacccacccggccgggctcaaagctcctcttcgtgacccaagagcccggtcgcccgccggacttcatcaagctccgggctccaagcaccgatctaaaaccaagaaagacttgtacggccggcggaacatcatgggaggtttcccagcaggggccctgacctccaactaaccagtgaaaaaacgaccgaggcacccgggcggcctgaccggtggggggccttcaatacggccttttcaggcaaggcccctaaaaccccccggaccctgccagaaatccaaccggaacttttggacggctgcttttgggccagagaaaaaccattcccgcggtcctgccgggtccgtggggaagaaagaggatcaaccgtttcttatggggaagggaacgccggcaggggtggtaaaagaaaagctttataaaaaaattgttggcagtccgggtagcggggcaacaagggtaatctaaacatatgggacttttttcc

SEQ ID NO: 92136 - protein, 158 aa, Zea mays
  misc_feature: Ceres CLONE 1580750
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQSKINPLIKAAVITAFVGQFPGVNGPPPTAARLDIEVGGVVPLHTHPAGLKAPLRDPRARSPAGLHQAPGSKHRSKTKKDLYGRRNIMGGFPAGALTSN

SEQ ID NO: 92137 - DNA, 879 bp, Zea mays
  misc_feature: Ceres CLONE 1580755
  misc_feature: Translation starting site: 474
  misc_feature: SWISSPROT Homolog: EC 1.1.1.95 Phosphoglycerate dehydrogenase
tggagctccccgcggtggcggccgctctagaactagtggatcccccgggctgcaggaattcgtctcacccctagaaaaagtcctgcaaagcacagacacaaaccacgagcgcgaggcacgacctacatcaaatcggccacgaaccaccatggcggcctcacgcgcgctcctccccagcccgcaggtgagccctgcgagcgcgcgaggtccgcctggccgcggccgtgccgtcgtcgctcacgctcgcggcacgcggcggggccggggccggcgcgcgtctccgcgtgcggtgcgcaatcttgtcatccccagcgcccgtggcgcccaccgagtcgaggccggcgcgccggatctcaccatccgcaccggacggcgcgctgcggcccaagccggcggagcccctccccgagaagctgagcgaggccgggctggccgtgctgcggcagttcgcggacgtggagtgcgcctaccgcatgtaccccgcggagctcctcgccaaggcggcgcagttcgacgcgctcatcgtgcgcaacggcaccaaggtgacgcgggaggtgctggacgccgggcagggccggcagcgggtggtgggccgcgcgggcgtcgggatcgacaacgtcgcacctccaggccgccaccgaggtcgggtgactcgtcgtcaacgcgtccaccgccaataccatcaccgcggccgagcacggtatcgcactgctcggctccatggcgcgcaacgtctcgcaggctgacgcggcgcttcaggccggtaaatggcaaaggaacaactacgtggggggtttctctggtgggaaaaagcctgcgccgtcttgggcttccgggaaggttgggtcagaagtagccaaggcccaccaaagggcttgg

SEQ ID NO: 92138 - DNA, 864 bp, Zea mays
  misc_feature: Ceres CLONE 1580756
  misc_feature: Encodes the peptide sequence at SEQ ID NO. 92139
ggagctccccgcggtggcggccgctctagaactagtggatcccccgggctgcaggaattcgtctcacccctagaaaaacccaacctctgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaagcatgcagatcttttgtgaaaaccctgaacgggcaagactatcacgctcgaagtgggagtccctctgacaccatttgacaacgtccaagcccaagatccaggaacaaggaagggcatcccctcacgaacaagaaacggggtcctcctttttggtggggaaacaaccttgaaagaaggggggccaaccctttgccgaattacaaaattcccaaaagggagagagcccccccccacctggggggctggcgcccccaggggggaagggatggcaaatatttcttgggaaaaaaccctgaacccggggaaaaaaatttttcccccccccggggggggggagttttttaaaaaaacctttttaaaaaagggctcggggccccaaaataccccgggaaaaagggggggggggttttcccccccaaaaaaaaagagggggggggtactatttttttttgggggaaaaacaccacttctagggaag

SEQ ID NO: 92139 - protein, 97 aa, Zea mays
  misc_feature: Ceres CLONE 1580756
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGSMQIFCENPERARLSRSKWESL

SEQ ID NO: 92140 - DNA, 847 bp, Zea mays
  misc_feature: Ceres CLONE 1580757
  misc_feature: Encodes the peptide sequence at SEQ ID NO. 92141
aagctggagctccccgcggtggcggccgctctagaactagtggatcccccgggctgcaggaattcgtctcacccctagaaaaagtgacttctgaatccggacaactccagggcctccgctggtccccactgcttccgccatggcggtgcgagccacggtctcccgcttcgcggtcacgccggaggcgctggactcatgcaccgtccagtgtggcgtcgccgtgacaccgcttcccgccgcggacgagcatggaaagccccgaccaccggcgcctgctgggaccgcgtccatgctgcgagcactgcaggtcgcacttcagcaatcgctgccatctatagaactggggttggacatcccattttgtgcacgctcagagattcgacgaccagcccgaccaacgattccacccacccacttttgccccaagttaaggccccctttcgaaaaccccaaaaacctggggataaggcaaaggcgaagaaaaaggggcacggccctccctcctattggccccaggggaatccccgtttttaaaaattccggaacccttcaaaagggggttttttggggccaaaaaacttttttccggggcccccttttggggtttaaaatctccccccaaatgtgggtgtttttccccccccccccattccctttgggaaaaaaattttttttcctccccacaaaaaaaaaaaaatggccctcttttctcccaaaaaaaaaccccccccccctttttttttttttcccccccgcccacccgggggaaaatttttttttcttcttgaaaaaaacccccccctccttttttttggaaaaaagggggttttcttttcaaaaaaaaaaa

SEQ ID NO: 92141 - protein, 29 aa, Zea mays
  misc_feature: Ceres CLONE 1580757
MESPDHRRLLGPRPCCEHCRSHFSNRCHL

SEQ ID NO: 92142 - DNA, 885 bp, Zea mays
  misc_feature: Ceres CLONE 1580758
  misc_feature: Encodes the peptide sequence at SEQ ID NO. 92143
aaagctggagctccccgcggtggcggccgctctagaactagtggatcccccgggctgcaggaattcgtctcacccctagaaaaaaccacgcccaacacgcgtcataaaaaatgggtacgcatcaataaagaggagcttgggaagttgccaaggcctccgatttcgctaatgcgacgataatggcgaccacgacgtcagcgaccaccgccgccgcagcagccgccaccaccgccaagccgcgggggtcgtcgtcggccctctgccagagggtggccggcggcggcaggcggcgctccggggtggtgcggtgcgacgccgccggcgtggaggcccaggcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtggccccgtgctattcaagaactcactagcctgaaccatattgaagaggctgctgttcttagtacctgtaatagaatggaaatttatgtggtggcgctatcatggaaccgtggtatcagagaagtagtggactggatgtcgaagaaaagtggtattcccgcttccgagcttagggagcacctgttcatcttgcgaagcagtgatgccacacgccatctgtttgaggtgtcagctggccttgactctttggttctcggtgaaggacaatccttgctcaggttaaaacagttgtgaggagtggacagaacagtggaagcttgggaaagaacatcgataggatgtttcaggatgcatcactgctggaaagcgtgtccgcagcgagaccaac

SEQ ID NO: 92143 - protein, 203 aa, Zea mays
  misc_feature: Ceres CLONE 1580758
  misc_feature (85)..(201): Pfam Name: GlutR_N Pfam Description: Glutamyl-tRNAGlu reductase, N-terminal domain
  misc_feature: SWISSPROT Homolog: EC 1.2.1.70 Glutamyl-tRNA reductase
MATTTSATTAAAAAATTAKPRGSSSALCQRVAGGGRRRSGVVRCDAAGVEAQAQAVAKAASVAALEQFKISADRYMKERSTIAVIGLSVHTAPVEMREKLAVAEELWPRAIQELTSLNHIEEAAVLSTCNRMEIYVVALSWNRGIREVVDWMSKKSGIPASELREHLFILRSSDATRHLFEVSAGLDSLVLGEGQSLLRLKQL

SEQ ID NO: 92144 - DNA, 946 bp, Zea mays
  misc_feature: Ceres CLONE 1580762
  misc_feature: Encodes the peptide sequence at SEQ ID NO. 92145
  misc_feature (658)..(658): n is a, c, t, g, unknown, or other
gcggtggcggccgctctagaactagtggatcccccgggctgcaggaattcgtctcacccctagaaaaaactcgtccgctccggccgcgcgcctccgacccacgccgatgccgcccccgcccccaccgcctctcggcctccgcctccgtctctccctcctcccgccccaccctatcgctccttctatccgtcatgccttctgctcaccctccgtcgtgtcctgccatctttcggtgcgccccctcgcccaacgccgcggtgggcgcccgcgccccctctgcgccgcgcggggcgaggccgaggcggagggcttcgcgtggccggatgggtccgaggaggagctgcggcggctcctggagctgctccctagggagctgagtcggcgggtggagacccacccagagctcccggcgctcgtggaggtggtcatggacctcggccggcccccgctcgcgcgcttcccgtccggagacttcctcctctcccaacgccccatctccttcgacgacctccgtcacgctacctcccactcccaggttgggaactttggagcggataatcgtgctggaattagccgcacgctgcaccggatcagcgccattaggaatcggataggcgtcattgtcagcctcacatgccgtgttgggcgtgcagtgccngggagcgctaatttgcttcaggatttggttaaggacagtggctcttggctgctcatcggcccacctggggtggggaagactactgtcataagagaaattgcccgtatgttagctgatgactattagaagcgcgtgaatgatggcgaacatctaatgagatgggggggggatgtgaaatcccccacccagataggcaatgcacgttggttgcaagtgcctaacagacatgcagcataaggactgaaagaaccggtggaaaccatatgcccaagcgattgtattgatgaa

SEQ ID NO: 92145 - protein, 225 aa, Zea mays
  misc_feature: Ceres CLONE 1580762
MPPPPPPPLGLRLRLSLLPPHPIAPSIRHAFCSPSVVSCHLSVRPLAQRRGGRPRPLCAARGEAEAEGFAWPDGSEEELRRLLELLPRELSRRVETHPELPALVEVVMDLGRPPLARFPSGDFLLSQRPISFDDLRHATSHSQVGNFGADNRAGISRTLHRISAIRNRIGVIVSLTCRVGRAVPGSANLLQDLVKDSGSWLLIGPPGVGKTTVIREIARMLADDY

SEQ ID NO: 92146 - DNA, 893 bp, Zea mays
  misc_feature: Ceres CLONE 1580767
  misc_feature: Encodes the peptide sequence at SEQ ID NO. 92147
  misc_feature (570)..(570): n is a, c, t, g, unknown, or other
  misc_feature (582)..(582): n is a, c, t, g, unknown, or other
  misc_feature (606)..(606): n is a, c, t, g, unknown, or other
ctggagctccccgcggtggcggccgctctagaactagtggatcccccgggctgcaggaattcgtctcacccctagaaaaaaccaatcaagagctgcagagcggagcagctcaatccagagctgcaatggcgacgctcctcattgggctgctgttcttgctcggctcgcctgtgactctcctaacgtgcgtggccgcgggcgcgtcgtttcctgtcaatgtctggcccaagccgacgtccatgtcctgggcggagccgcacgcggccgtcccggtgtcgccgtcgttccacatcgtcgtcgcgtcgtcaggtaacccgtacctcgtctcggccgcggagcgctacgccaagctgctgttcaaggagacgtaccgacccatcgttcggccggcggtcaacgtcaccgcggggcacgcgctggagacgctgaccctggccgtgtccgacctcgccgccccgctgcagcacggcgtgggacgagtcctacaacgctggagatcctccccacgggcggggccacggtcaccgcggtcaccgcgtggggcgccatgcgcggggctggagacgttcntcgcaactgtcntggcgggccggcgggccggggacngcgcccggacctgctgctagtgggccgctggcgtgcacgtccaggaacgtcccctgtacccccaaacgtgggctgatgctcgacacccgggaggacttacttcccccgtgggcgacatcctgcggaccatctacgccatggcggccaaaaaaaaaaaaaaatgtttccctgggccattcgggaaaccgagtcgtttccccatcgggtggccctccaagaccttgctttcccaaaaaggggccctccggaaggaattgttctacaccctccaggacgtcaagcgcttc

SEQ ID NO: 92147 - protein, 166 aa, Zea mays
  misc_feature: Ceres CLONE 1580767
  misc_feature (149)..(149): Xaa is any aa, unknown, or other
  misc_feature (153)..(153): Xaa is any aa, unknown, or other
  misc_feature (161)..(161): Xaa is any aa, unknown, or other
MATLLIGLLFLLGSPVTLLTCVAAGASFPVNVWPKPTSMSWAEPHAAVPVSPSFHIVVASSGNPYLVSAAERYAKLLFKETYRPIVRPAVNVTAGHALETLTLAVSDLAAPLQHGVGRVLQRWRSSPRAGPRSPRSPRGAPCAGLETFXATVXAGRRAGDXARTCC

SEQ ID NO: 92148 - DNA, 864 bp, Zea mays
  misc_feature: Ceres CLONE 1580769
  misc_feature: Translation starting site: 147
  misc_feature: SWISSPROT Homolog: EC 2.2.1.6 Acetolactate synthase
ctccccgcggtggcggccgctctagaactagtggatcccccgggctgcaggaattcgtctcacccctagaaaaactttctcccactccgtgtaccgtggcacccaccccaaacactcgcgccgcctacgagacagccgccgcaaccatggccaccgccgccgccgcgtctaccgcgctcactggcgccactaccgctgcgcccaaggggaggcgccgggcgcacctccaggccacccgccgcgccctcgccgcgcccatcaggtgctcagcggcgtcacccgccatgccgatggctcccccggccaccccgctccggccgtggggccccacagagccccgcaagggtgctgacatcctcgacgagtccctcgagcgctgcggcgtccgcgacgtcttcgcctaccccggcggtgcatacatggagattcaccatgtactaactcgctcccccgttatcgccaagcacgtcattactccatacagcaagggagagcctttgacggctcgggctacgcgcgctcctcgggccgcgtgggggtctgtatcgccacctcaggccccggcgccacctaactagtctccgcgctcgccggagcgctgctcgataccgtctgcatgggcgccatcacgggacaggtgccgcgactcatgagtggcaccaacgccttctaagagacgcccatcgtacgaggtacttgctccatcaccaagtacaactacctggtcctcgacgtccacgacatcacacgagtcttgcacgatgctttcttactcactctctctggtcgaccagggcgcgtgcctgtcaacatcttctaggacatcaggagcatattgcagagccttgtctgggaccagccatg

SEQ ID NO: 92149 - DNA, 1310 bp, Zea mays
  misc_feature: Ceres CLONE 1580770
  misc_feature: Encodes the peptide sequence at SEQ ID NO. 92150
  misc_feature (74)..(74): n is a, c, t, g, unknown, or other
  misc_feature (75)..(75): n is a, c, t, g, unknown, or other
  misc_feature (971)..(971): n is a, c, t, g, unknown, or other
  misc_feature (1310)..(1310): n is a, c, t, g, unknown, or other
aggtattataaaaatatattctataatattggggaaaatggaattgataagaaggatatttataatagtagagnntgttaaaactggagctcaccgcggtggcggccgctctagaactagtggatcccccgggctgctatgaattcgtctcacccctagaaaaaaagtccccaccaggcaatcaagaacaccacctaccgctgacttgtcaattcctgtctgtgcgcgcgcgcgcgcgtggcgccggccgagcggccgttgacccgatgaccggcgcggcggccgtcgatcccccggcgcctcggccgcggcggctgacggtcctcccgctcatcgcgctcatcttctacgacgtctcgggaggccccttcggcatcgaggactcggtccgcacgggcggcggcgcgctgctcccgatcctcggcttcttcgtcctcccagtcctctggtcgctcccggatgcgctggtcacgggcgaagtcgcatccgctttccccaccaacgccaggaaagtggggctgggatgttcaaccaactttcggccccccacaggggggttccatcggtcagggtttctcccaagtgggggggttcagggggaaagcttcgagagaaacggcgggtttcttaacacaggtgggctatttttccctacgataagtaaacgtacccattcttcccggagcgcgggctgggggactatgagggcgatctgtcaccgtgcccgatcacagagagtacgcagaacgttatctaaattagaagagggaaggatagcaagacaatagaagtggagttgattcataatgaatgtacgcgcgctcatagaagaatatatttcataaatcaacgcgatggcagacgcagccctcgaaaaaaaggagatgagcacgcaggcggggggggagagccatcttcgcgaccacaccagactattgcagccaggcgcagagatgcaaagcagtccagangcgggagagagaatgtatcggagaggataaacagtaatcctacgaagagcgcgagacgaggagacgtgtgatgacggaaatatatgttgtagaacgcgcacgaacgattgatctgaagtccaatagtaaaggaagagtagaaaaagcgatgtatggagtgaatgagaagaagagaagtcgcacctcaacaagtggagaataaggagacagacacgagaaaattctcacagagaaggaggagtattcaagaacaccaaatgacaagaaaaagagacagagagaagagggcagtgaggtaatgaatacctgagaatgggagagagacagattatgtgaagn

SEQ ID NO: 92150 - protein, 173 aa, Zea mays
  misc_feature: Ceres CLONE 1580770
MTGAAAVDPPAPRPRRLTVLPLIALIFYDVSGGPFGIEDSVRTGGGALLPILGFFVLPVLWSLPDALVTGEVASAFPTNARKVGLGCSTNFRPPTGGFHRSGFLPSGGVQGESFERNGGFLNTGGLFFPTISKRTHSSRSAGWGTMRAICHRARSQRVRRTLSKLEEGRIARQ

SEQ ID NO: 92151 - DNA, 917 bp, Zea mays
  misc_feature: Ceres CLONE 1580773
  misc_feature: Translation starting site: 160
  misc_feature: SWISSPROT Homolog: EC 1.4.1.2 Glutamate dehydrogenase
  misc_feature (917)..(917): n is a, c, t, g, unknown, or other
ctccccgcggtggcggccgctctagaactagtggatcccccgggctgcaggaattcgtctcacccctagaaaaacctctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtgggccttcaaggtcatttctgggcctggtgagaagccaatgattggtgtccaccacaagggtgaagaagaaccagtttgcaacctgaagaaaactccccctatgggttctttattcaagaagcccgggaaaattgcctaaagccttaaccttgggtgagccccaatcaaagaaagggtggtgggcccaaaggtacccttgccttaccttctaatggatcccccgtaagggccgggcgccaccaagggatgcctggggggttgattgcccggggccctttatggggggctggggattgtatcaaaaaagagccaaaaagcgggacatttatcgcctaagggtgcttgcaaaaaaagggcctcccccggtccgggggaaaaaaaaaagcccccccctcttgtgacctggggggggggggcccctctgtggttgttcccccccccccccagttgggaggggaggaactttttagggttgaggcn

SEQ ID NO: 92152 - DNA, 1163 bp, Zea mays
  misc_feature: Ceres CLONE 1580774
  misc_feature: Encodes the peptide sequence at SEQ ID NO. 92153
tccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacggctgcagctgcggtggctactgcaaatgcgaccccctgcactgctgatcacatccaatcgactaccatggatatgattattaaccatcctagcttgggggtggttggttgaaaaaataatatgcgaggcctaagcgggctttcctatatacaagttaattgttttggtgcgactgcgtaaaaacaaaaaaaatacaaaagttcttccagagtggcctattcccctctccgtatggttttgtgacctttctcttctcctggggggtctcaactttagccccgctgtttgttttatattcttggacttggggttgtgtattccccaatcgttaaccgctttttttatctcaattcctatggtatggcccgccccctctaacatattgtgcttttttatttaatatcgtaagattctccatcgaaacgccgtagctcattacttatacacaggtcgtcctgtaaaactcctcaatccgtgttttcgtttattggtaggtgctattcccttttttttcccatattgtattatgatgagcctctaagttgactctgttttctcacgcgccttcatgcttccatattgtaatgtccgatggttagtacatatcgttgtgactgccttgcgtacccttggtattattctccagcaccatctttctctacgccctcttgttatatccaccctttcgcttatccacaccacatcccacccttagtgagcaaattcacacaccaccaccgccacttttctcacctgcagtctcatctgttcgcgcaatttttaacctcctcgcatctgcctatgttctattttccaagctcagcactctttcacgg

SEQ ID NO: 92153 - protein, 76 aa, Zea mays
  misc_feature: Ceres CLONE 1580774
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHGCSCGGYCKCDPLHC

SEQ ID NO: 92154 - DNA, 846 bp, Zea mays
  misc_feature: Ceres CLONE 1580780
  misc_feature: Encodes the peptide sequence at SEQ ID NO. 92155
  misc_feature (348)..(348): n is a, c, t, g, unknown, or other
  misc_feature (359)..(359): n is a, c, t, g, unknown, or other
  misc_feature (469)..(469): n is a, c, t, g, unknown, or other
  misc_feature (647)..(647): n is a, c, t, g, unknown, or other
  misc_feature (727)..(727): n is a, c, t, g, unknown, or other
ctggagctccccgcggtggcggccgctctagaactagtggatcccccgggctgcaggaattcgtctcacctgcaacaatcggtggaaggccttccccaaagcgaattgaaggtccaaatggaagaactctgcaactcgaattccgaacaaggctgtcacttcccctttttactggaggaaaagttgaaggggagcagggagctgcaattcatgttgttttgtttgatgctggcactggctgtgttgtatcctctggaccagagtcgtctgccaacttgacatcgttgttctagaaggtgatttcaacaatgaagatgaggaggggctggaccggagaagatttgacangtcacgttgtngaaggagcgtgagggaaagcgggcctattttaactggtgatctacaagtcacactaaaagaagggtgtggggacagttggggagcttacattcacagataactctagctngataagggagtaggaaattcagacttggcttgaagattgcctcaggatttttgtgaggggtgttcgcattcgtgaggcaaaaacagaagccttttatggttaaggaccataagaaggagaattgtacaagaagcactatccacctacactgaaagatgagggtctggaggttggaaanaataggggagggatgggtcattcccataagaggctgaacaaatctggaatatctacagttggagattttccttaggctgntgggttcgggatccacagaaaatagcagaatacttggaagtggtatgttccaacaaatgtgggaaacccttgtgagcatgcaaaacttgtaccttagtggaaaatatacatatactatt

SEQ ID NO: 92155 - protein, 96 aa, Zea mays
  misc_feature: Ceres CLONE 1580780
GAPRGGGRSRTSGSPGLQEFVSPATIGGRPSPKRIEGPNGRTLQLEFRTRLSLPLFTGGKVEGEQGAAIHVVLFDAGTGCVVSSGPESSANLTSLF

SEQ ID NO: 92156 - DNA, 806 bp, Zea mays
  misc_feature: Ceres CLONE 1580781
  misc_feature: Encodes the peptide sequence at SEQ ID NO. 92157
acccgcggtggcggccgctctagaactagtggatcccccgggctgcaggaattcgtctcacccctagaaaaaacccccttgactccgcccacacccacctattcggctattggatctctcgttcgacctcgtctctcttcccgttctgctttgccttttccccttcctctctcccctgtcccccctccgtccctgccgagcgagaaagcgaaggggccaaaaaagccgcaccggcttccttcccccacccgaagagatggaactgttctacgaactgctcctcacggcggcggtcaccctcctcgctgccctcctgctcgccacgctcttcgcagccaatgattcccatcgccggaccgatcgcgccgcagccgcgatcgccgaggaggtggcccacgaggagaggatcatcgaggtcgacgaggtgatgcgtaccgaagggatggcggcggtggcgccgtcggaggcgagatgggtgggttgaggcggagaaggcgccggcagtggtcgtcgcggaggtgaaggagccggagaagcttgccccgaggaggagggggttcccgtgaaggctgttcgggaggtgcgccttgctgccgaactggaagagggggaagacggaggttggcaacattaagcggccgagagttgacctccgccacggtttgtggcggcggcggggtgcttaaaactagccaaactggtgtcggggcgccgaagttcggggccctagggaagggtttccgaatgacgccctgggttgggagggaaactaaccccctcgcctggaatggttcatcgccctaata

SEQ ID NO: 92157 - protein, 75 aa, Zea mays
  misc_feature: Ceres CLONE 1580781
MELFYELLLTAAVTLLAALLLATLFAANDSHRRTDRAAAAIAEEVAHEERIIEVDEVMRTEGMAAVAPSEARWVG

SEQ ID NO: 92158 - DNA, 1125 bp, Zea mays
  misc_feature: Ceres CLONE 1580785
  misc_feature: Encodes the peptide sequence at SEQ ID NO. 92159
  misc_feature (17)..(17): n is a, c, t, g, unknown, or other
  misc_feature (46)..(46): n is a, c, t, g, unknown, or other
  misc_feature (61)..(61): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
ggggggggggggctttnttttatgtcttattttattacaccaatgnaaaatattaaaaaanaaaaaannnnnnnnnnacaagctggagctcaccgcggtggcggccgctctagaactagtggatcccccgggctgctggaattcgtctcacccctagaaaaaaccgcttctctcgtttccttccgatccatacacaccgcgcacgtacgcgtactccatcgtcccggcgcatgcgggttcacgtacgagctcgatcggccgagatgagatggtgacgcggaacgggcttgctcggatccagacgaacggggcgacaaaacccgacaacggcatgtgccacgaccacagctcggcgccggtgcgcgcgcagaccatcgacgagctgcactcactgcagcggaaacggtcggccccaaccacgcccatcatggacggcgccgcctcaacgtttcgccggcgccctcctccgaggagggaagcggcccacccccccacctgggagtccatccagcacccccctttggcgtactctgaaacccttgaaacccggggccgaaaaagtgggacaaaggggataaccccggaccccggaaaggggccaaagggggccccccagcgaaacgggggaggtaacctttcccaaaggcccatcttggggggcctacccagtcgaaggaatcacaaaccatattcgcgctagcgcgggcacacactcaaacccatttacggacacggtaacacaggcgggagagaataccttccgccccattataaaattattttcaaaaccacacaacaagagatatcacctctgtacaaaaaaaatccccttcttgtctgtacactaggtaccttgttaaaaatctcgtggttaagggctagaaccagggaggaacctcattgtcgagggagttaagagggaattaagaggagggggcgggtgacgtatagtacgggaacagatgttttgttaagactccaagactccaatcgcctgtgagatagaaaccctctttcccatacacgaggcaatggacaaagaaataacccgcggcgcggagaatcacgcaatgaacttgtgtgattgccatacacattccacgggtttagatgcgcatagttcag

SEQ ID NO: 92159 - protein, 143 aa, Zea mays
  misc_feature: Ceres CLONE 1580785
  misc_feature: SWISSPROT Homolog: EC 4.1.1.49 Phosphoenolpyruvate carboxykinase (ATP)
MVTRNGLARIQTNGATKPDNGMCHDHSSAPVRAQTIDELHSLQRKRSAPTTPIMDGAASTFRRRPPPRREAAHPPTWESIQHPPLAYSETLETRGRKSGTKGITPDPGKGPKGAPQRNGGGNLSQRPILGGLPSRRNHKPYSR

SEQ ID NO: 92160 - DNA, 1333 bp, Zea mays
  misc_feature: Ceres CLONE 1580788
  misc_feature: Encodes the peptide sequence at SEQ ID NO. 92161
  misc_feature (48)..(48): n is a, c, t, g, unknown, or other
cctgttttgtgtagtagggaggtggcggtgtaccttagcttcctatcncctccccttttttcttcaaactggagctccccgcggtggcggccgttctagaactagtggatcccccgggtctgtttgaattcgtctcacccctagaaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatccagctgggcctgctggaggtgctgcagaatgaggccggcggcggcaaggcggcgctggcccccgaggaggtggtggcgcggatgtttgttgcccccttttactccgccacctgcgcggtcccccccccactggatgtggcgcgtgctctcctcctacgacctcgtccggtggccatatggaggacctgggatggccggttctatgcgtcgtcttatcttctttgcgttccgctctgcaaagtggcttatccccctaacgtaggacgggcatggtcccttgggcccccccctcgctccttcttttatccttgaacaatgtcctcctcaggtagcagtttgggcacccactcctcaatagtgtatcttgccgcccgggtaaaggtggggcactcccacggtttccaacttatgtgcgctacctgagttaatggacgtgggcgtttcccgttggtatctctacgtggcctctcgtgaatcactgtgtcggcgtgtatagtcaccgctccggtggtgtcctattccactcaagcgcgtcccatcggtaaaaataaatatctcactcttctcgtggtgcatatcgcccattctctgccctccctagcttaaaccgctcgtgtctttgggcgaactatttttggtgttcgccccgcgggtggtcgttttttctgaatgcggggcatacactgtcttcagtatactctctgtgtgctgcgacgacactctatgtgagtgcggtgcctctatattcatcggtgctcacgcttcttcatttgatccctatcacgttttgtgttgctctcgcattctcagcgcggtatctactatgtatatacaccaccgctctgtggatagtacatacactctcctcgtatatgtggtcccatccctttcttgtacttgtgtccccaaccgatcgtttctcgtcttcatattctcttgcaagatgagtagctcccacacgatctccgtttgtggtttctcaccttctgtactt

SEQ ID NO: 92161 - protein, 140 aa, Zea mays
  misc_feature: Ceres CLONE 1580788
  misc_feature: SWISSPROT Homolog: EC 2.1.1.68 Caffeate O-methyltransferase
MGSTAGDVAAVVDEEACMYAMQLASSSILPMTLKNAIQLGLLEVLQNEAGGGKAALAPEEVVARMFVAPFYSATCAVPPPLDVARALLLRPRPVAIWRTWDGRFYASSYLLCVPLCKVAYPPNVGRAWSLGPPPRSFFYP

SEQ ID NO: 92162 - DNA, 867 bp, Zea mays
  misc_feature: Ceres CLONE 1580789
  misc_feature: Encodes the peptide sequence at SEQ ID NO. 92163
  misc_feature (867)..(867): n is a, c, t, g, unknown, or other
aaagctggagctccccgcggtggcggccgctctagaactagtggatcccccgggctgcaggaattcgtctcacccctagaaaaaaaactgatctgaccaagccctaaacagcaccgccctctcacatctcctctcccctcgatccatggccgccgccgccgccgccgccgcgccatcccgcaagacggagacctacaccgacaccaagcgccgcgatgacgtgcgcggcgccaatatcgccgcagcgcgcgccgtcgctgacgccgtgcgcacctcgctgggaccccgtggcatggataagatgatctgttcgggcgaccaggcgcaggaggtcatcatcaccaacgacggtgccaccatcctctcccgcatggcgctcctccagcccgccgcgcgcatgctcgcggagctatcccgctcccaggacgccgccgctggggacggcaacaacgactggtggcgtcctcgctggaatccctcttccgccgggcccagttgctcctcttcggcgggggcccaaccaaacggcggcggcgaaagcttttcaccggcttcgggaaaggcgcttgttgaaatcctccacgggatggggcaatccccatttgaactatttggaaccgggaaacccctcctggaaggtcggggtcccaatgggtctcaaaatctaaaggggcggttccccaggaaatacccacccttttttttggcccccttggcgggtgagaaacccgccccttctcccggggggggggaaacccggcttacacccgggaaactttttttaaacaccccggggagaaaccgccgctacttataaaaaaaaacttggtgggggggacaccccgggaaaacaaaaacacgagagan

SEQ ID NO: 92163 - protein, 223 aa, Zea mays
  misc_feature: Ceres CLONE 1580789
MAAAAAAAAPSRKTETYTDTKRRDDVRGANIAAARAVADAVRTSLGPRGMDKMICSGDQAQEVIITNDGATILSRMALLQPAARMLAELSRSQDAAAGDGNNDWWRPRWNPSSAGPSCSSSAGAQPNGGGESFSPASGKALVEILHGMGQSPFELFGTGKPLLEGRGPNGSQNLKGRFPRKYPPFFLAPLAGEKPAPSPGGGETRLTPGKLFLNTPGRNRRYL

SEQ ID NO: 92164 - DNA, 973 bp, Zea mays
  misc_feature: Ceres CLONE 1580790
  misc_feature: Encodes the peptide sequence at SEQ ID NO. 92165
ctggagctccccgcggtggcggccgctctagaactagtggatcccccgggctgcaggaattcgtctcacccctagaaaaaaccgccttctatcgcccccaccccggctcccagatcgcggcggcacacataatggccgcctcgccgtcgctgcacgccgtggcgcaccgggggccctccctgaccgccctcctcttcctcgtcgacgagatggtgttggttccccctgcggcggccgagatccgggagaccgcaatccgggccgacccgcggagcatcatcccgctggacgagttcggcttctcccactcaggcgtgctggagctcaacgtctccggcatcgccttcgacccgcaagcctccgcggagctggacctctcccagctcggcttcttcctctccacgctcgacgcctgggtccacgtcctccgccagctccaggagctcgacgttagctgcgcgctccagtccgagctcgtcaagctcgccttctctttcgaacgactccgcccgccctccaaccccggcggcgtcgaggtcgctcgctcctcctccttctccaccggcttccgcgtctccgagcccggccagtacacgctcgtcttcgctaactgcctcggcggcggcctcaaggttgacatggacgtccgctccgccatgtacaacgtcgacccggcaaccggggagctgcagtacctctccgcaggggcctccgcgctgcccatcttctactatctcttctgcctcggctacgctggactcagcgctgactgggtcgacatcatcgtacgcaagcagggcgccgtattccagatccactacttcatgctcgccgtgctcgggctcaagagactcacctctcgtcgagggcgagcacagtcatgcatcgagcgcacagcaccgccacggaagggacatgctatctacatctcagctttctcaagggaatccgccttcatgctaaaggcacatga

SEQ ID NO: 92165 - protein, 280 aa, Zea mays
  misc_feature: Ceres CLONE 1580790
MAASPSLHAVAHRGPSLTALLFLVDEMVLVPPAAAEIRETAIRADPRSIIPLDEFGFSHSGVLELNVSGIAFDPQASAELDLSQLGFFLSTLDAWVHVLRQLQELDVSCALQSELVKLAFSFERLRPPSNPGGVEVARSSSFSTGFRVSEPGQYTLVFANCLGGGLKVDMDVRSAMYNVDPATGELQYLSAGASALPIFYYLFCLGYAGLSADWVDIIVRKQGAVFQIHYFMLAVLGLKRLTSRRGRAQSCIERTAPPRKGHAIYISAFSRESAFMLKAH

SEQ ID NO: 92166 - DNA, 1116 bp, Zea mays
  misc_feature: Ceres CLONE 1580792
  misc_feature: Encodes the peptide sequence at SEQ ID NO. 92167
  misc_feature (648)..(648): n is a, c, t, g, unknown, or other
  misc_feature (772)..(772): n is a, c, t, g, unknown, or other
tccccgcggtggcggccgctctagaactagtggatcccccgggctgcatgaattcgtctcacccctagaaaaaatctcaatctctctcttctcctcacctcaccttggtgttcacgccgtcgctagcgcctgccgcaccgaagcttctgtcctcccccgcgccgggctcgggtcgtcgtccggcagcaatatggctggcggcttattgggactgcatcgggccaggccttttctggctttcttgccagaggtgcagagcgctgataggaagataccgtctcgagaaaaagttatatacactgttatttacctcttcattttgccgttcatggatcttattcgttacgaggcctccaccccatgggggggggggggggtggggtgggggcgggtgtggtgggggggtggggtgggtgggggggcgtgtggggcggggtgggtgggctgggggccgtggtgggttgggggtccggggctcttggtacgttttcgcattcctgtggttgcggccgtgggaggcctgatgctgtcggtggtgcttatagtgtggggcgcgtgtcggaatctgtgtggtgtgttgcgggcgtcggtgctttggttgtcttgtgtgcgggccgcggagcgggggagtgtctgggtcgcgggtgntttgtggggatgttgtgttgctggtgtgcggaagagcgtgtggtgggtgtgattccgctctttattacttgttgctcttttcctgatggcatccgccctgggtgtgcgtttgttcggttacgcntttggtcctcgtagttgtataccctccgttcttatcttatggttgccgttgctcatcttgatgatttggcgtgcgtttttttatgttgccctttctttcgcgctcttatctcacgcctctctatacgttctattatttcgtccgcttctactacctgtgtaattgatatttagttcgagtatatctatctgccccgcttgttgtgcctcctttgttttcctcgtatcatgaggctccatctacctctctatctgttcttttctgcctggcggtcttttcccctcctttctttgtcaccgttttttctcgtctgtttagcttataattgcggttgcgcttgttcg

SEQ ID NO: 92167 - protein, 169 aa, Zea mays
  misc_feature: Ceres CLONE 1580792
  misc_feature (153)..(153): Xaa is any aa, unknown, or other
MAGGLLGLHRARPFLAFLPEVQSADRKIPSREKVIYTVIYLFILPFMDLIRYEASTPWGGGGVGWGRVWWGGGVGGGACGAGWVGWGPWWVGGPGLLVRFRIPVVAAVGGLMLSVVLIVWGACRNLCGVLRASVLWLSCVRAAERGSVWVAGXLWGCCVAGVRKSVWWV

SEQ ID NO: 92168 - DNA, 831 bp, Zea mays
  misc_feature: Ceres CLONE 1580793
  misc_feature: Encodes the peptide sequence at SEQ ID NO. 92169
tggagctccccgcggtggcggccgctctagaatagtggatcccccgggctgcttgaattcgtctcacccctagaaaaagagcaactgcaacaagaagctcataggcgcccggttctacggcgtccagcccgagtcgtcggcatcgaacgcctccagcagcgccgtggcgacgccggccgcaaccggatcgccgcgggacaccgtgggccacggcacgcacaccgcgtccacggcggccggcgcggtcgtgtcggacgccgactactacgggctcgcccggggcgcggccaagggcggggcgccgtcgagccgggtggccgtgtaccgcgcgtgctcgctgggcgggtgctccgcgtcggccgtgctcaaggccatcgacgacgcggtgggcgacggcgtggacgtcatctccatctccatcggtatgagctccgtgttccagtcagacttcctcaccgaccccatcgcgctgggcgcgctccacgcgcaccagcgcggcgtgctggtggtctgctccggcggcaacgacgggcccaacccctacaccgtcgtcaactccgcgccgtggatcctcaccgtcgccgcctcatccatcgaccgctccttccagtccaccatcgctctcggcaacggcgacgtcgtgaagggagtggcaataaacttctcccaacacagcctcagcggcgagcagtaccctctggtgttcggggcccaggtggccgcccactacgcgccggtcggcgaggcgagcaactgctaccctggatcattggacgcgcagaagtggcccgggaagatctgggtgtgcgtaagcacggaccgaatggtgtc

SEQ ID NO: 92169 - protein, 135 aa, Zea mays
  misc_feature: Ceres CLONE 1580793
  misc_feature: SWISSPROT Homolog: EC 3.4.21.25 Cucumisin
MSSVFQSDFLTDPIALGALHAHQRGVLVVCSGGNDGPNPYTVVNSAPWILTVAASSIDRSFQSTIALGNGDVVKGVAINFSQHSLSGEQYPLVFGAQVAAHYAPVGEASNCYPGSLDAQKWPGKIWVCVSTDRMV

SEQ ID NO: 92170 - DNA, 1137 bp, Zea mays
  misc_feature: Ceres CLONE 1580795
  misc_feature: Encodes the peptide sequence at SEQ ID NO. 92171
  misc_feature (61)..(61): n is a, c, t, g, unknown, or other
  misc_feature (62)..(62): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (892)..(892): n is a, c, t, g, unknown, or other
cacggcaaaagaataaatataaaagaataacagaggacgcaataaaagaaacgcgaatgtnnaaaatnnnnccaaactggagctccccgcggtggcggccgctctataactagtggatcccccgggctgcatgaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacggcctcccgccggggcctccgggttggccggtggaggggaacctgttccaggtgatcctgcagggacggcccttcatgtacgtggtgcgcgacctccgggaccaccccaccggcccatcttcaccatgcggatgagggcagcgcaaccctcaacgatggtcacctagggcggagcttcatccaccaagcgcgcttgtgtgaagcagaggcccccattgtttcgcaaagcccggccccgaaggaacagcccccaacccgcccttccctactttcaatcgatcgggcaaaggtggccacccgtccataacttcgggccgccccccaagcgggaccccacccatggttggacagatggccttctggtccggccccgcaaaaacttttcatgtactgaccacgaaaaaattcatttggttcccccccgtccaacccgggcggtgtcaaagggggggccttttccttcacctgggaaaatccccgggggaaagtgtgggggcccctgttggtaaaaccaccgnccccactttagttgtccgagcccttttgcgtaggccacaaagagatttcgtccaagacgtggtaacaggtttgcccccgtgagcgggggggaataatggataccacaaaatggacaagtgccttcattacattgctggggaggcgaatctccccccaaatcttggcaagcatagacttttcagagttccataatgaatggccccccggacgaaaagcttgcattcccggggaaataacaacaaag

SEQ ID NO: 92171 - protein, 74 aa, Zea mays
  misc_feature: Ceres CLONE 1580795
MDVNDVLLVVLAAALAAMWWRRCSKTGGVDGLPPGPPGWPVEGNLFQVILQGRPFMYVVRDLRDHPTGPSSPCG

SEQ ID NO: 92172 - DNA, 1015 bp, Zea mays
  misc_feature: Ceres CLONE 1580796
  misc_feature: Translation starting site: 373
  misc_feature: SWISSPROT Homolog: EC 4.1.1.8 Oxalyl-CoA decarboxylase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (641)..(641): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtttcaaagctggagctccccgcggtggcggccgctctagaactagtggatcccccgggctgcaggaattcgtctcacccctagaaaaagcagtccacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcggggcgcgcgctggccgcggcgggcacgcggcacatgttcggggtggtgggcatccccgtcacctccctcgcgtcccgtgccgccgcggccggggtccgcttcctcgctttccgcaacgagcagtccgcgtggtacgccgccgccgcctactgcttcctcacgggctccccgggcgccctactcaccgtctcctgcccaggatgcgtccacggtctcgngggcctctcccacgcaacggctactgcctgtccgctcctcatgatcctccgatcctgcgatcaagctgacgccggcaggggcgaactccaggagctcgaccaaaatcgcgccccctaggccctcgccaaagctcgccgtcaaaggaaaaaaccattggcgaaattcccgggccctgtctttcaaagcccttcccgccccccttgtgccgggcctttcccggaaagggggcctaacccgataatcccgttccggaaagtccctccacaaaaaccccccccctgaaaaccaaagggccccggggtctccatattaaaaaaacaaacccccccccataattttggggcccaaacccaaaaaaaccttcccccccgaa

SEQ ID NO: 92173 - DNA, 1333 bp, Zea mays
  misc_feature: Ceres CLONE 1580800
  misc_feature: Encodes the peptide sequence at SEQ ID NO. 92174
  misc_feature (63)..(63): n is a, c, t, g, unknown, or other
  misc_feature (1220)..(1220): n is a, c, t, g, unknown, or other
ccgcctttttatcctttttcctacacactccccgtatttgagtgtcaaacttattttcctttnaaaactggaactccccgcggtggcggccgctctagaactagtggatccgccgggctgcaagaattcgtctcacccctagaaaaaatacgacaaggtcgtcgctcgcccggtcgccccctacacaccactgccgattcaactctctcgctccctgtcttctccaaaaacctaaccgcctacggttatgctctcgacggcttcggtgccctccacctcgttcgccgacgctttcctctactgccgcactcgccaccagatccgcgtcccctggctgcggtccgtcacctcagccgtgtcgtacggggcggaggaccgacacgtggagaggttcgttaacagcaactccatgagcctattacctccgctaactccgcgccgagctcggctgtgccgcgatgggcccccccaagctggcttacaaggcatcgtagctgcacaacgctgctggtgcgccttcctcaagtcagttcccataaaatcccacgttgcacccccttttgttcgacattgatcgccgtttcctaatgtcgcacttcgtcgtacataaccatgtaccctgggaacaactggtcattgcaagaagctgtcgagataattacggacttgttctccctggttccagaaaatgtggtttatctacccccaggcgcaagaaattgtcacacactgttccagaaagaggacctctatttgggacaatctaaagctaatccattgacaaaatcttagccggtctcaataatagaataattttagttacactatattgggcgtttccgcgttggtcctcaaagcgcctcaaattcgtgattcatctcggagcacaacataatagcgttgtctcgagaaaccaacatcaacgtctgacttactctacacggccttagacgatttaccgcgccaaacctgtctatttactgttgtgtcacacactatgccctcagcaccctattttcgcttcatcttcacaatcgcggtgccataagaaacatcttccctatacactggtctttaaccacaggctgcgactatacttcctcccgctttgcttaatactgctcgacacagggcatctcgtgtatttagtcacaagctcctgggcttagatgtctatgtggggtatccagccgctagtttatatactctcctcatacagnagaccgctgtaactttctcactgtatgcgttgtaaggagagatacttgagacacctctctcgtcatttgttctttctcaatctccgacccttgcgttgtgagatgctcgaatc

SEQ ID NO: 92174 - protein, 108 aa, Zea mays
  misc_feature: Ceres CLONE 1580800
MLSTASVPSTSFADAFLYCRTRHQIRVPWLRSVTSAVSYGAEDRHVERFVNSNSMSLLPPLTPRRARLCRDGPPQAGLQGIVAAQRCWCAFLKSVPIKSHVAPPFVRH

SEQ ID NO: 92175 - DNA, 795 bp, Zea mays
  misc_feature: Ceres CLONE 1580802
  misc_feature: Encodes the peptide sequence at SEQ ID NO. 92176
ctccccgcggtggcggccgctctagaactagtggatcccccgggctgcaggaattcgtctcacccctagaaaaaatcctatcttcagtctcctcaccgcgcgctctctaccgcttgtccgtttcttcctcttccgaggtagcaacgtggtgagtgaggcagccgctgctgtgctgcactgctgctgcggaggcccaagccgaccggcggagagcacccgtccttgggcggcggagggtggaagaataaggccgggcttgcggatgccggggtgcggagtatcggggagaggtggtgtgggggtatcgtcggccgcacgccggactgcggcacaatggaagaccctcccctgcctctggatgactatctctcgcggctacaggaaggaacctgagctcaaatatctgcacatctccactcagcacatctgtgttactagaacgcagatttggtcgacatgttactgcgagctctgcttatctgctgcaaaattcccagagcactgcgctgacaagactacggaagtctgggggagtttctgcaacctgctctcgaactcgtcgagaacttgttggacgatgacatgctacactgcctgcttgaagacgacaatgacggccctggctgagagcatgagttcttcatatcggctctgctacggatgggctacaacttcgcggttagacaagttctctagtgtggagagggcatgttttcaccactaatcaagctatcaagggcgacatctgctcgctgcaaaccaaagcctgataaataactggctaccctttgaacc

SEQ ID NO: 92176 - protein, 153 aa, Zea mays
  misc_feature: Ceres CLONE 1580802
MPGCGVSGRGGVGVSSAARRTAAQWKTLPCLWMTISRGYRKEPELKYLHISTQHICVTRTQIWSTCYCELCLSAAKFPEHCADKTTEVWGSFCNLLSNSSRTCWTMTCYTACLKTTMTALAESMSSSYRLCYGWATTSRLDKFSSVERACFHH

SEQ ID NO: 92177 - DNA, 868 bp, Zea mays
  misc_feature: Ceres CLONE 1580804
  misc_feature: Encodes the peptide sequence at SEQ ID NO. 92178
tggagctccccgcggtggcggccgctctagaactagtggatcccccgggctgcaggaattcgtctcacccctagaaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggattttcttttctgacacttcgattcttaccaatcccccttggcctgctgctttccttgacatcgaccagttccccagtcttgctccctgcggtcctccctcctccatctccaggggttgggtttctgacccaccggcccccatggccggttcttttcggccgctgggggctcccccgggcccccactttttggggtttatagggggcttttaaaaaacccccctgtgaaaaccccatttcctccaaggggaccctgtttctttttgtgggcacccctcttggggtaccccgttttttggggtgccaccctccccccggggcccccccatatatattgttc

SEQ ID NO: 92178 - protein, 50 aa, Zea mays; identical to SEQ ID NO: 23071
  misc_feature: Ceres CLONE 1580804
  misc_feature (1)..(50): Pfam Name: AdoMetDC_leader Pfam Description: S-adenosyl-l-methionine decarboxylase leader peptide

SEQ ID NO: 92179 - DNA, 918 bp, Zea mays
  misc_feature: Ceres CLONE 1580805
  misc_feature: Encodes the peptide sequence at SEQ ID NO. 92180
  misc_feature (467)..(467): n is a, c, t, g, unknown, or other
  misc_feature (478)..(478): n is a, c, t, g, unknown, or other
ctccccgcggtggcggccgctctagaactagtggatcccccgggctgcaggaattcgtctcacccctagaaaaactcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcagggtgtgggggggaggcacntacgacttcgncaccgtgctcgcctttcctcgcgtcctcgccttcacattctcgtctacttcatgtccagccccagcccgtgtacctcatcgacttccatgctacaggcgggcaaacaagctcaggtgccaaggcggaatttatcgacctgggccccaattctggaaaattaaaaaggaagcctggggtttccattccgtttgggggcaaatcccggtttgggaaaaaatttaaaatgccgcgcttggttttaaaccaaacccgggtgccccactaaaaagggggccccccaaaggtcccccccctttttccggccggtggaaattttttaaaaaatgcccccccccccaaaaaaagggggcgggtgggggaaaaaaaaatttttaaacaacccccctcgtgggcggggggcccccccaaaaagggggggacccttcattaaaacgggggg

SEQ ID NO: 92180 - protein, 172 aa, Zea mays
  misc_feature: Ceres CLONE 1580805
  misc_feature: SWISSPROT Homolog: EC 2.3.1.119 Icosanoyl-CoA synthase
  misc_feature (99)..(99): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRRVWGGGTYDFXTVLAFPRVLAFTFSSTSCPAPARVPHRLPCYRRANKLRCQGGIYRPGPQFWKIKKEAWGFHSVWGQIPVWEKI

SEQ ID NO: 92181 - DNA, 821 bp, Zea mays
  misc_feature: Ceres CLONE 1580806
  misc_feature: Encodes the peptide sequence at SEQ ID NO. 92182
  misc_feature (415)..(415): n is a, c, t, g, unknown, or other
  misc_feature (549)..(549): n is a, c, t, g, unknown, or other
  misc_feature (582)..(582): n is a, c, t, g, unknown, or other
ctggagctccccgcggtggcggccgctctagaactagtggatcccccgggctgcaggaattcgtctcacccctagaaaaagggaccgacgggcgagagagcggaagcgacgactagctctgcggcctctgccccaagcgccgacgatgggtgccggtgctactgccagggacgaggaggctcctaccggccaccaccatgggaggaagccgcatggcgcagcggcggagtacgcgcaggacgggtccgtggacctgcgcggcaaccccgtgctccgctcccagcgcggcggctggaccgcctgctcttcatcgtcgtgtacgagctgttcgagcggatggcctactacgggatctcgtccaacctcatcatctacctgacggacaagctccaccagggcaccgtcgaggcctccnaacacgtcaccaactggtccggcaccgtcttcctcacgccgctgctcggcgcctacgtcgccgacgcctacctcggccgctactggaccttcgtcgtcggctccgccatttacctgctgggggatggtgctgcntggtgctgtccgtctcgggtgcgggcgctgaanccgccccccttgcggggcccgggcgggttggtccccgcaggggttggggcttgcacttcgggggcttactttcgggggctcttacctggggggccctggggaaaaggggggcccaaagccaaaattttcccccattggggggggaaccttttcaaagaatttcaaccccggggaagggggggcacaaagtggcccttttttaaagtggggggagtgtcccacatttcccggggggactc

SEQ ID NO: 92182 - protein, 161 aa, Zea mays
  misc_feature: Ceres CLONE 1580806
  misc_feature (27)..(27): Xaa is any aa, unknown, or other
  misc_feature (82)..(82): Xaa is any aa, unknown, or other
MAYYGISSNLIIYLTDKLHQGTVEASXHVTNWSGTVFLTPLLGAYVADAYLGRYWTFVVGSAIYLLGDGAAWCCPSRVRALXPPPLRGPGGLVPAGVGACTSGAYFRGLLPGGPWGKGGPKAKIFPHWGGNLFKEFQPRGRGGTKWPFFKVGGVSHISRGD

SEQ ID NO: 92183 - DNA, 873 bp, Zea mays
  misc_feature: Ceres CLONE 1580807
  misc_feature: Encodes the peptide sequence at SEQ ID NO. 92184
ctccccgcggtggcggccgctctagaactagtggatcccccgggctgcaggaattcgtctcacccctagaaaaagggacggacgggcgagagaacgctaagctgagtactacctctgcggcctctgccccaagcgcctaccatgggtgccggtgctactgccatggacgaggaggctcctaccggccaccaccatgtgaggaagccgtatggctcatcggtctgactacgcgcatgacgggtccgtggacctgcacggcaaccccgtgctcacgctcccagcgcggcggctggaccacctgctccttcatcgttatggaccatctgttacagctcatggactactgcggtatctctgccaacctcatcatcaagctgaccgacaagctcccccactgcaccgactaggcctccaataacttctccaactggtctggcatcatcattcaatcacgcctctgctccgtgcctacgtcgccgacgcctacctcggtcgctactggaccttcctcctctgctccgccatttacctgctggggatggtgcatgatggtgatgtcagactctctgcttgagctacaaccaccttcgtgaggatgccaggcggctgtgaccccaggtttcctccgctacgtctctccgcgtacttcgactggcgctctatgatggcgctgagacgcgtagtccatggaccacacgtctccatcattgtggtccgacttgttcgaccagtacgaaccgacgaagctggcttcacagatagacttcatcagctggaggatgttcagcgactctgctggtatcctctacactgcgtcgagcatatctatctgccgacgacgagaactagtcgctgcgctactgaattcccacc

SEQ ID NO: 92184 - protein, 57 aa, Zea mays
  misc_feature: Ceres CLONE 1580807
MTGPWTCTATPCSRSQRGGWTTCSFIVMDHLLQLMDYCGISANLIIKLTDKLPHCTD

SEQ ID NO: 92185 - DNA, 896 bp, Zea mays
  misc_feature: Ceres CLONE 1580808
  misc_feature: Encodes the peptide sequence at SEQ ID NO. 92186
ctggagctccccgcggtggcggccgctctagaactagtggatcccccgggctgcaggaattcgtctcacccctagaaaaaaggtcccgcctcacaccacctcacctcatcactacctcacccatccagccccccaagaactacccatcagccatggcgccgccgtcggtgtccgcctcccacctcctaatcaccgcctcgctcccaaagcccaagccttcctccctccgcccgccgcggctccctgtcgccaagcccctccccgcatcggcggcgctcctggcgctcgcggcctcgcccgcgctcgccgccgacgcgccggcgcctgcccccgccccaatccccgcgccggcgccggagctccaggccgaggcgcccaccccgaccgtcaaccccttctccagctccctcctcacggcccccaagccctccgccgcggcctccgacctccccgagggcgctcagtggcgctacagcgagttcctctccgccgtcaagcgcggcaaggtcgagcgtgtgcgcttttccaaggacggcggtctgctccagctcaccgccgtcgacggccgccgcgccaccgtcgtcgtccccaacgaccccgacctcatagacatcctcgccaccaacggcgtcgacatctccgtcttcgagggcgagtcggcgggccctggcggcttcgtcgccttcgtcggcaacctcctcttcccttttatcgcgttcgctggccttcttcttcctcttccgcgcgcgcagggcggccccggcgccggccttgtgggcctcggcgggcccatgggaattcggccgcttccaaaagcaatttcaggaggggcctgaaaagggtgttacctttcctccaagtttccggggccggaacaaggccaagttcgggctggt

SEQ ID NO: 92186 - protein, 227 aa, Zea mays
  misc_feature: Ceres CLONE 1580808
  misc_feature (103)..(228): Pfam Name: FtsH_ext Pfam Description: FtsH Extracellular
MAPPSVSASHLLITASLPKPKPSSLRPPRLPVAKPLPASAALLALAASPALAADAPAPAPAPIPAPAPELQAEAPTPTVNPFSSSLLTAPKPSAAASDLPEGAQWRYSEFLSAVKRGKVERVRFSKDGGLLQLTAVDGRRATVVVPNDPDLIDILATNGVDISVFEGESAGPGGFVAFVGNLLFPFIAFAGLLLPLPRAQGGPGAGLVGLGGPMGIRPLPKAISGGA

SEQ ID NO: 92187 - DNA, 946 bp, Zea mays
  misc_feature: Ceres CLONE 1580809
  misc_feature: Encodes the peptide sequence at SEQ ID NO. 92188
  misc_feature (341)..(341): n is a, c, t, g, unknown, or other
ctcaccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccangtcggcatgaaccccattcacacccgtcttgatgccaagcgtctcatcggcaggaggttcagtgatgcgtctgtccagagtgaaaatcaggttgggccccttaagggccttttcgggccctggtaaaaacccaatgtttttttccccccccaaaggggaaggaaaaacctttttccccctaaaaaaaatcccccctttggggtttctttaaaaaaggggggaaaaagttgggaaagcttccccttgtgggacccacaaacaaaaaaagtgggggggaaaaaacccccctgccctcttttggggaccccccacggggggggcccccaaaaaatatgcgggggggaaatctcgccccctaaaagggggggggtaaaaaaaaaaaaacacaaaaaggggggactctccccctggggtttttaaaaaaaagaccccccctctgtgggggagaaaaaaaatccccccctttcttttttttggggggggggggttcttttatccccctcccccccccccccaaagaaaaaaaaattttttgtggggggggccccccgtggagcacccacctctttgtggggggaggggaccacaccgcacgcgcccccccc

SEQ ID NO: 92188 - protein, 102 aa, Zea mays
  misc_feature: Ceres CLONE 1580809
  misc_feature (61)..(61): Xaa is any aa, unknown, or other
MAGKGDGPAIGIDLGTTYSCVGVWQHDRVEIIANDQGNRTTPSYVAFTDSERLIGDAAKNXVGMNPIHTRLDAKRLIGRRFSDASVQSENQVGPLKGLFGPW

SEQ ID NO: 92189 - DNA, 914 bp, Zea mays
  misc_feature: Ceres CLONE 1580811
  misc_feature: Encodes the peptide sequence at SEQ ID NO. 92190
  misc_feature (900)..(900): n is a, c, t, g, unknown, or other
ctccccgcggtggcggccgctctagaactagtggatcccccgggctgcaggaattcgtctcacccctagaaaaaatcccctcttccctctctagccttccacccttcatccaccagccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcacagaaggcagttgacacgctcgatgggagattggtagacgggagggagatcatggtgcagtttgccaagtacggcccagatgctgaacggattaataaagggagaatagtggagccagttccaagaccaggggggcgttccaggagtcacagtccaagacggaggtaccgtgatgattatcgagatgaccatgatagagattatagaaggcgaagtcgtagccggagtagagatagatacacccgtgacaggtacagggatagggattaccgccatcgtagcccgagtcgcagctacagtcctgatgattacaagaagcgtgggagagacagtttgtcacctgagcgaagagtcctcgtcgtagctgcagtcctgatgatttacagaggcgtggcagagacagtgcatcttcagcaagtaagagccctagtcgctccccaactgcgcagatgtcactttctcctgagagatctcccgtcaggcgcaacaatgacggattctcaggctctcggagcccatcggantaagcgcattccct

SEQ ID NO: 92190 - protein, 250 aa, Zea mays
  misc_feature: Ceres CLONE 1580811
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (246)..(246): Xaa is any aa, unknown, or other
MSRFGRSGPPPPIRDTYSLLVLNITFRTTADDLFPLFDKYGEIVDIYIPRDRRTGDSRGFAFVRYKYEDEAQKAVDTLDGRLVDGREIMVQFAKYGPDAERINKGRIVEPVPRPGGRSRSHSPRRRYRDDYRDDHDRDYRRRSRSRSRDRYTRDRYRDRDYRHRSPSRSYSPDDYKKRGRDSLSPERRVLVVAAVLMIYRGVAETVHLQQVRALVAPQLRRCHFLLRDLPSGATMTDSQALGAHRXKRIP

SEQ ID NO: 92191 - DNA, 1245 bp, Zea mays
  misc_feature: Ceres CLONE 1580814
  misc_feature: Encodes the peptide sequence at SEQ ID NO. 92192
  misc_feature (61)..(61): n is a, c, t, g, unknown, or other
  misc_feature (64)..(64): n is a, c, t, g, unknown, or other
  misc_feature (65)..(65): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (991)..(991): n is a, c, t, g, unknown, or other
  misc_feature (996)..(996): n is a, c, t, g, unknown, or other
  misc_feature (1245)..(1245): n is a, c, t, g, unknown, or other
gggggggtggtgactttgtgtgattcttggttaggcgccccccccccctccccctttactnccnnccccccnnnnaacagagctggagctccccgcggtggcggcctctctagaactagtggatcccccgggctgcaggaattcgtctcacccctagaaaaaggaagtttgaggcaataacaggtctgtgatgcccttagatgttctgggccgcacacgcgctacactgatgtatccaacgagtatatagccttggccgacaggcccgggtaatcttgggaaatttcatcgtgatggggatagatcattgcaattgttggtcttcaaccacgaatgcctagtaagcgcgagtcatccgctcgcgttgactacgtccctgccctttgtacacaccgcccgtcgctcctaccgattgaatggtccggtgaactgttcagtatcgcgcccacaggtgccgtcctactctgtagacccccccccctggtttgtcaaccatgggcttccgggcgaagtgacaagaatagaccaatgccggcggactttgacctgcccacaccgaagcgttatgtctccgacgtatttgattaatccgcatcatcgtcttatacggcgcagagatcgtgtcattcatctctcaagaaacataaaataccttctagggagtcccatcggctgcggcggcagacagagaaaaatcatggtggccgtcgtgcccctaagcgcttgtatacggcttcgcacattatcgggcgacaaactcccaggcctattaagccgagagaagcgggtgataacaatctctgtaccggcgatagttatgtataataatctctcactcgctgcaggatcttctctattgcctctttgatggggacacaatctcagtaatacaggtgactacggacatcacaccgggcgccgtcgcgcggtgtctcggcgttgtatgatatgcgtcacctactaaggacatgtttgacacgtgttacatctnaccantacctgttgtctaaataaagagatcaacccgcccgagatcacaggaggtaatatctgaattacacctaaaagccggatgcgagtctctgccccgacgtccagtgagttcatacgtagtgtatttgactcgcgtacgatctgacagaggtcgcccgtgcgtcatatactagaccgacatctgcggcggttgataatccacccgacagtgtataaatatgatagacggcgtgatctatgtattatcagcgn

SEQ ID NO: 92192 - protein, 84 aa, Zea mays
  misc_feature: Ceres CLONE 1580814
MPSKRESSARVDYVPALCTHRPSLLPIEWSGELFSIAPTGAVLLCRPPPLVCQPWASGRSDKNRPMPADFDLPTPKRYVSDVFD

SEQ ID NO: 92193 - DNA, 885 bp, Zea mays
  misc_feature: Ceres CLONE 1580815
  misc_feature: Encodes the peptide sequence at SEQ ID NO. 92194
  misc_feature (875)..(875): n is a, c, t, g, unknown, or other
ctggagctccccgcggtggcggccgctctagaactagtggatcccccgggctgcaggaattcgtctcacccctagaaaaattttcccctcctcgcctcgggggtgcgcgaatttcgactagggtttcgcggaccgagagggaagcggggagaggagagggcgggtagggtttccgcgggcgggccccgcatggcctcggcggcagcggcggcggtggcgccggccgcggaggagaagaagggcgcgggcgggccggtcacgggggacatggtcagcgcgggcttcgcggagctggagcggcagcagcggctgctcgccacctgcacgcgcctctaccagcacctgtccgaccacatcggctcgctcgagcgcgggctcgccgcgcgctccgacgcgctccgcgtccgccgcagggcattcgacgcgcgcacccaccgcgcgctcgactcgctccaccgccgcgaggcctccatcgacgcctccgtctcgcgcgcgctcgaccacctccactccatctccgccaaggggtcaccgccggctccggatccggcacacgccgccggcgccggcgcggccgagggcctgcgcgccctctgcgcgcggatggactccgccgcgttcctgggcttcgtggtggcccgccgcaaggaggccgacgcgctgcgggcggagatgccggcggctctcaagctctgcgtggatccggccaagttcgtcatggacgccgtcgccgacgtcttccccgtcgaccgccgcgaggcccggagcttcgccgacctggcctgggcctgcgtgctcatcctcgaggccgccgtgctcgcgctcgccgacccggaccggacatcggccccgcgcgcccgctcgtggccgggggnggcgcgcgag

SEQ ID NO: 92194 - protein, 232 aa, Zea mays
  misc_feature: Ceres CLONE 1580815
  misc_feature (229)..(229): Xaa is any aa, unknown, or other
MASAAAAAVAPAAEEKKGAGGPVTGDMVSAGFAELERQQRLLATCTRLYQHLSDHIGSLERGLAARSDALRVRRRAFDARTHRALDSLHRREASIDASVSRALDHLHSISAKGSPPAPDPAHAAGAGAAEGLRALCARMDSAAFLGFVVARRKEADALRAEMPAALKLCVDPAKFVMDAVADVFPVDRREARSFADLAWACVLILEAAVLALADPDRTSAPRARSWPGXARE

SEQ ID NO: 92195 - DNA, 807 bp, Zea mays
  misc_feature: Ceres CLONE 1580821
  misc_feature: Encodes the peptide sequence at SEQ ID NO. 92196
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
ctggagctccccgcggtggcggccgctctagaactagtggatcccccgggctgcaggaattcgtctcacccctagaaaaaagagcgccacgccaccaccaccccagctcactcgtgccgtgcactcgacccgtcccccctccctccactcgatccacccgccaagacctcccattgccgccgccgagccagccagggggggagaagagaggccagccgcgtcgcggcgggcggaggaggaggacgagcgggagagccgagccgagccggccgggcaggatgttcgggcgggacccctggggcgggccgctggagatctccaacgccgactcggcgacggacgacgaccggagccgcgacctggaccgggcggcgctgatgcggcagctggacgagacgcagcagagctggctcctggccgggcccggcgaccaggccggcaagaagaagaagcggtacgtcgacctcggctgcgtcgtcgtcgaccgtaaggtcttcatgtggaccgtcggcaccatcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggcctctccgacagcaccgtccgccggagcctgttgttnnnnnnnnnnnnnnnnnnnnnnnnnnnnnnnnnnnnnnnnnnnnnnnnnnnnnnnt

SEQ ID NO: 92196 - protein, 157 aa, Zea mays
  misc_feature: Ceres CLONE 1580821
  misc_feature: SWISSPROT Homolog: EC 3.2.1.4 Cellulase
MFGRDPWGGPLEISNADSATDDDRSRDLDRAALMRQLDETQQSWLLAGPGDQAGKKKKRYVDLGCVVVDRKVFMWTVGTILGLGVFIGFVIMIVKLVPHKRPPPPPPDQYTQALHKALMFFNAQRSGPLPKHNGVSWRGNSCMKDGLSDSTVRRSLL

SEQ ID NO: 92197 - DNA, 749 bp, Zea mays
  misc_feature: Ceres CLONE 1580823
  misc_feature: Encodes the peptide sequence at SEQ ID NO. 92198
  misc_feature (448)..(448): n is a, c, t, g, unknown, or other
ctggagctcaccgcggtggcggccgctctagaactagtggatcccccgggctgcaggaattcgtctcacccctagaaaaatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacaaggccccgtgatgaaggtggccaggaaaaagagtcgggcaggaggggcctcagaagaaacctgcccaagggagggccaagggcctggaaaacccccaaagggccgggcaaccaaggtttaaaaggggcttttcaagcgggggccccccctcccttggtgggggggaaaaaaaantttttggcccctccaagcccccttgttattccgggggaaaaaaacccccctctagaagtttcaaaaaccttgggggaaaaaagggggcccaagggtgtgaataaaaagggggggggggggggggggtctcccccgggggggggtttttcccaaaaccccccccttttttaaaaaaaaggggggggaaaaaaaaagggcggctctttttttttttttaaaaaaaattttccccccccccacaaaaaaaaaggggggggttttttttgggggaagaaaaacacttttgggggggtggcccccc

SEQ ID NO: 92198 - protein, 30 aa, Zea mays
  misc_feature: Ceres CLONE 1580823
MDEDFEMPPAGADEMMGDDEMGDFGGDKAP

SEQ ID NO: 92199 - DNA, 1265 bp, Zea mays
  misc_feature: Ceres CLONE 1580827
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
gggtggggtgncnntctcgtatgtggttcgttgtctccctctggtatgttaccggggggtggggagtattttaaagctggagctccccgcggtggcggcctctctagaacagtggatcccccgggctgtacgaattcgtctcacccctagaaaaaaccccagctcactcgtgccgtgcactcgtcccgtccccctccaccctccaagacctcgcattgccaccgccgcccccgatccaggggatgaagagagatgccagcccgcgtcccggccgggccgaagaggaaggaccaacggggagagcggaaacgagccggcccgggcaggatgtttcggggcgggaatcccctggggccgggcccccctggaaaatctccaaacgccaaacccggcgaacggaagaacgaaccgcggcccccgaaccctggaaccgggggcggcccctaatttccggccagctggggaacaaaaaccgcaccaagaaactgggggttcccggggcccggggccccccccctaacccaggggccggggaaagaaaaaaaaaaaaaggggggttacgttcgaaaccccccggggtgtggcctcccgttcggttcaaaaaacgcgaaaggggtccttttctctggtggggaaccccgcttcggggaaccccgggtcccccgcggggcgcccccggggggtttctcttaatatcgggggtttgttggtcccacaccccagggaaaatcgtgtgaaaaagggctccgtgtgcccccccaaaaaaaaaaaagagaggccgcccccccttgcggtttccgttgggcggtcccccggaaaaacaagggttttactacccccccaggaggggccgcttgtctccaacaaaaagggggggcggccccccaggtggtgttctcctttcaaaaaccgcccccactgtgggatttttctccgggccccccgccgtgtttaccgataaaaaaaaacaaaaaattggtgcgctctagagtcctcgcgggagaggggggggaaaaacccctcccggcgccaattaaaaagagaacacgcgggcctcttctcccccaaaaaagagagaaaccaccttcaccccccccggagaaaccccctgtgtgttagaggagaagggtttttcttatataaaaccgcgggggggggagagcccgccgccccccggaaggtgtgcaagagtctgcccccccccccgggtgggcggggtgggctcccaacgtgaaaacaccagggctctacccgcgtggtgggag

SEQ ID NO: 92200 - DNA, 866 bp, Zea mays
  misc_feature: Ceres CLONE 1580830
  misc_feature: Encodes the peptide sequence at SEQ ID NO. 92201
ctccccgcggtggcggccgctctagaactagtggatcccccgggctgcaggaattcgtctcacccctagaaaaagcttgtatcaaattatttgagcaattcaaatcttatgagggcctttactttttcttggggtcttatctgagctccagtgaggacccagagatccatttcaagtacatagaagcagcagcaaggactggacaaatcaaagaagttgaacgtgtaaccagggagtcaaacttctatgatgctgagaagacaaagaactttttgatggaagcaaaactacctgatgcccgtccactgattaatgtttgtgaccgctttggttttgtgccagatctcactcactatctgtacacaaacaacatgcttcgatatatcgaaggctatgttcaaaaggtgaatcccgggaacgctcctttggtagtgggccaattacttgatgatgaatgccctgaagattttatcaagggcttgatcctctctggtcgttctctccttcctggtgaaacactgggtgatgattgtgagaagaagaatcgcttacgtttgctcactcattccctggagcactagtggagtgaagtaggcaaaaatgtgcctgtccataaggctcttggaaaaaacctctttgaccgaacaacaatcctgaacatttctttataccaacccattttacaaacccccggggggggggaaaaatttgggaaaaagggggaccccaccttggctggttgggctttaaaaacggggacaggggggaaagaaaaactttttttttgccccacaaaaaaacccttttttcccgccccacccttttttttgggtgaaaaaaaagagggggggtttcttctggggaaa

SEQ ID NO: 92201 - protein, 192 aa, Zea mays
  misc_feature: Ceres CLONE 1580830
  misc_feature (15)..(156): Pfam Name: Clathrin Pfam Description: Region in Clathrin and VPS
PRGGGRSRTSGSPGLQEFVSPLEKACIKLFEQFKSYEGLYFFLGSYLSSSEDPEIHFKYIEAAARTGQIKEVERVTRESNFYDAEKTKNFLMEAKLPDARPLINVCDRFGFVPDLTHYLYTNNMLRYIEGYVQKVNPGNAPLVVGQLLDDECPEDFIKGLILSGRSLLPGETLGDDCEKKNRLRLLTHSLEH

SEQ ID NO: 92202 - DNA, 966 bp, Zea mays
  misc_feature: Ceres CLONE 1580831
  misc_feature: Encodes the peptide sequence at SEQ ID NO. 92203
  misc_feature (15)..(15): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
ttttgggggtggcgngtgcgggggggggcccggtgtttgggctctccctacctttttannnnaaatacgattattgaagctggagctcaccgcggtggcggccgctctagaatagtggatcccccgggctgcttgaattcgtctcacccctagaaaaattgtccaatccgtttgtctccttgttcttcttcctcctgcggaagctcgccggtcatcggcaccaccgtggcaggatggcagtgccgacgaagccgagcccgccgccgccgccgctgcccacgctggagatgctacacggccagaccctagtggtcgacgtggaggcgtggatcctgcgcccgccggtgtccgccttcccgtacttcatgctcgtcgccgtcgaggccggcagcttcctccggggtcttctcctgctgctgctctacccgctgatgctcctcctcctcggcgacggcgcgcgggctaaggccatggccacagtcgctctcgtcgggctggaggagaaggaggtggccagggtcggccgagcagtgctgcccaagttcttcttggaggccacggcggcggaaggcgtggcagcggtgcatgcggcagcgcgggtggtggcggtgaccgcaaccttcccgagggtgatggtgggacggattcctggagggaagtatgtcgggcgtggtaacgcccgtcgtgggggcctgtaggtgaagagtccggtcgagtggaggtccccccccgggggctgaatggaacaatgtaggaacccccaatgaaggtgggcgggcctaaaaccccttccgggccccgtggttttgggcggaaccaacttggtaggcccggcgcaaaaaaaaaaagagccgccccggggggggcctccttcccggaaaccgggcgaagacaaccggttaaggggtggcccacctaaccctttttttaatggtcccttttaactcacgcggcacagaggaaaac

SEQ ID NO: 92203 - protein, 154 aa, Zea mays
  misc_feature: Ceres CLONE 1580831
  misc_feature: SWISSPROT Homolog: EC 2.3.1.15 Glycerol-3-phosphate O-acyltransferase
MAVPTKPSPPPPPLPTLEMLHGQTLVVDVEAWILRPPVSAFPYFMLVAVEAGSFLRGLLLLLLYPLMLLLLGDGARAKAMATVALVGLEEKEVARVGRAVLPKFFLEATAAEGVAAVHAAARVVAVTATFPRVMVGRIPGGKYVGRGNARRGGL

SEQ ID NO: 92204 - DNA, 968 bp, Zea mays
  misc_feature: Ceres CLONE 1580832
  misc_feature: Encodes the peptide sequence at SEQ ID NO. 92205
  misc_feature (12)..(12): n is a, c, t, g, unknown, or other
  misc_feature (16)..(16): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (100)..(100): n is a, c, t, g, unknown, or other
  misc_feature (573)..(573): n is a, c, t, g, unknown, or other
  misc_feature (670)..(670): n is a, c, t, g, unknown, or other
  misc_feature (729)..(729): n is a, c, t, g, unknown, or other
  misc_feature (779)..(779): n is a, c, t, g, unknown, or other
  misc_feature (836)..(836): n is a, c, t, g, unknown, or other
  misc_feature (837)..(837): n is a, c, t, g, unknown, or other
  misc_feature (861)..(861): n is a, c, t, g, unknown, or other
  misc_feature (862)..(862): n is a, c, t, g, unknown, or other
  misc_feature (898)..(898): n is a, c, t, g, unknown, or other
  misc_feature (905)..(905): n is a, c, t, g, unknown, or other
  misc_feature (910)..(910): n is a, c, t, g, unknown, or other
  misc_feature (940)..(940): n is a, c, t, g, unknown, or other
  misc_feature (958)..(958): n is a, c, t, g, unknown, or other
tttcttttctcnatanaaaattgttgggaagttacgggccgcaggatagaagtaagaggtattttttttttnnnnnttttttaaaagctggagctcaccncggtggcggccgctctagaactagtggatcccccgggctgcaggaattcgtctcacccctagaaaaaatgcggcgcctccactttgcgatgcccgcgtcctcgctcccctccccatcctcctcatctaccgtgctctccattccccacccgctcccaccgccgctcgcagatgccgcccaaggtggtcgccgtcgccgcgggcgaggcccacacactcgccctcacgggtgacgggcaggtgtactcctggggcaggaggccgttcggccgcctcgggaacggccgcgaaagacaacaagttggtccccaccccggtggggccccccggtcctctgccagcgggaaccccccggcccccgagttctttcccccctccccgggttgggggcccttaaccaaaaccccttttccctcggaaaaagggttccaggcccccccttaaacccctaaaatagggagccccccccccccntttaaattttttcccggggggacaaaaacaaccttatttttattggggcccccccccccccaagattgaaggagagcgcggtcttcttttcgtttgnacaccacggttgtgtgtttaaaaaaaaaccacaacccccggagagaggagaaagatgantaaacaaggagtcgtcttttcctcgggacaccccacccccccccacccanaaaaagaaaaaaacggaggcgctacaaataaaaaagaggggtgtttttttttctgcnncacaccccaaaaagagaagggggnntgaaaagaatggtaatatttttcggcacaccccccntcccttnggggngggaaagagggagcaataaaataccaacgncgcggcgaggcgggcgtntcctaccacc

SEQ ID NO: 92205 - protein, 90 aa, Zea mays
  misc_feature: Ceres CLONE 1580832
  misc_feature: SWISSPROT Homolog: EC 2.7.11.1 Non-specific serine/threonine protein kinase
MPPKVVAVAAGEAHTLALTGDGQVYSWGRRPFGRLGNGRERQQVGPHPGGAPRSSASGNPPAPEFFPPSPGWGPLTKTPFPSEKGFQAPP

SEQ ID NO: 92206 - DNA, 815 bp, Zea mays
  misc_feature: Ceres CLONE 1580834
  misc_feature: Encodes the peptide sequence at SEQ ID NO. 92207
  misc_feature (730)..(730): n is a, c, t, g, unknown, or other
ctccccgcggtggcggccgctctagaactagtggatcccccgggctgcaggaattcgtctcacccctagaaaaagctcgatcgagcaaaccgacaaccccctctccgccgccgcgcacctacgctgccctccgtttggtcgtccgcccgcttcgacgggactggtccggccgtcggcgctcggcctgtcgacccaccagcccgctcccgtggcagtggtaacagatgtttgtaatgcttcaagcacacctcaagaaaataggcttgctggtgacagcaacaccatttcagaaaatgcccaggaatcattgagttctttaccagaacaagagtcaaatgatgctagtgttaacacagaaaagcaggaacctggcatttcaaaatgcaaatctgtggacgaaattccaaaaacagtaactgtaaagagatgcaagaacgttgattcaaaaaaagtctcctcaaataacaataataatccaagatttactggcagtccagctctgaaaaagcatcccacaaagggggaccatctttttgaactatgtgaaaatggcatggctcaaaacacaaagcctcctagcacaaggatatgcataaattcagcctgcaaagctgtcttcaactcagataacacattttgtaagaggtgttcatgttgtatttgccatggttttgatgataacaaagatcctagtctttggctggtatgctcatcagagactggtgatcangattgctgtggatcatcccttccacgttgagtgtgcactcaagcacggaaaaggcagatgcatagaacttgcacaatctatacag

SEQ ID NO: 92207 - protein, 68 aa, Zea mays
  misc_feature: Ceres CLONE 1580834
  misc_feature (59)..(59): Xaa is any aa, unknown, or other
MAQNTKPPSTRICINSACKAVFNSDNTFCKRCSCCICHGFDDNKDPSLWLVCSSETGDXDCCGSSLPR

SEQ ID NO: 92208 - DNA, 1283 bp, Zea mays
  misc_feature: Ceres CLONE 1580838
  misc_feature (60)..(60): n is a, c, t, g, unknown, or other
  misc_feature (70)..(70): n is a, c, t, g, unknown, or other
  misc_feature (1283)..(1283): n is a, c, t, g, unknown, or other
agaggtatatagagggaagataatattttccccccccacccccccccccccccccaaccncccccccccnccccaaactggagctccccgcggtggcggccgttctagaactagtggatcccccgggctgtctgaattcgtctcacccctagaaaaacgtgagacgggcttagcgactcggctggcctcccgtcgctcgtgcgtgtggtcctcccgaccggaggcgttctctctccctccccctttcatctggacatggaaaccgtcatcactctctgacatgtgcccgcgacgggcaatccggggacggtcccaagatacaaatctgccgtcggggagacctcgctccgattgactcccggaaacgcgggaaacctggcgctccgcgaggttgccgctcttcgccccagaggcagataacataatagagcgaagagtgaaatccagacagaatgaggggcattttttcacacccccctgggggaaggccccgagtatcgactggcgcgagtgcaggacgagacaataggtggggaatttcagctatctgtgattgaaaactgaaagcttccgtgaggggctaaaggacgttgacggacgaacaaacccctttagagggttgtgagcattatttggcacttggctcggcctctccattggctaataggatctgggccgtgcaatccgtcggccccgtgtggtgtttttttggtggaggttcgccgattatcctgggagaaaggcgctactataagcaggcgccctctggagcatattttaagaggaggaacgcctggcctctacaattagtgcagagatattgtatccacgtctggttaacaacgtattgtcaaacccaactctgtgcgatagttcttatcccctcgataccgatgtgattatcgtccgggacaggaaatttttatctctagtccatatacttaaacacgctaacccagcatgatcaggggtgtggtgatatctatgagataaaggtatgcatatacgggagcccgcgaagatgattatttccacggttatgaggaggaactcactctcattttggggcatctgtggcattgagagattgggtgatcaatatatggatatatataccttagaaagctttatcgacacgacggccataatgctctctgtatggaaaaaccagggcgcggcccatgttgttaaagcctcttattatactggggggtgctcctcacaaatgaggattcgcgcttttgtagtcaagattaataggtctctgcgagaatatacccggn

SEQ ID NO: 92209 - DNA, 880 bp, Zea mays
  misc_feature: Ceres CLONE 1580839
  misc_feature: Encodes the peptide sequence at SEQ ID NO. 92210
  misc_feature (760)..(760): n is a, c, t, g, unknown, or other
  misc_feature (848)..(848): n is a, c, t, g, unknown, or other
  misc_feature (849)..(849): n is a, c, t, g, unknown, or other
ggagctccccgcggtggcggccgctctagaactagtggatcccccgggctgcaggaattcgtctcacccctagaaaaaatccactctcagcatcaccagctaagaacaggtcttcgtctcaataatggaaggcaaaacagggcagctcaggtgctgtttcgtcgccatcgtgctcgtcctgggtcttgtccttgagcagtcccagcaggctgaagctagaggcaaatggtgctgcgaaaccgccaccggaaaataccattttaatcgctgcgttgactcgggttgggtcgacaatattgggttctgtgcgagtaatgccggttgcatcattatggaggacagatgtggaggtcgttggccagtgcctgctcgtgatgcgctttctctggatgtcatttgattaattataagcaagtacgtgaagttaaaaaacgagggccagacgactgtcgtccagcgattggttatttgtgaacttgtcgtttgtcttcttatttcaactttccaataagccccttcgtgtaatcgtgtcctccccttcaaagtttgtcgactgttgcgtaatcaaatctatatagcaaataaagacggcgccgtacgtgtatatgtcgtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctgntggaagcggtgggcgtggggctcccctgcaccgtcatgcagtgcggcgacgtcatctaccgcagcacgctcccccggaaacgacgggnnctcacatcacggccccggcgtcacgctcgcg

SEQ ID NO: 92210 - protein, 91 aa, Zea mays; identical to SEQ ID NO: 58513
  misc_feature: Ceres CLONE 1580839

SEQ ID NO: 92211 - DNA, 885 bp, Zea mays
  misc_feature: Ceres CLONE 1580840
  misc_feature: Encodes the peptide sequence at SEQ ID NO. 92212
  misc_feature (877)..(877): n is a, c, t, g, unknown, or other
tggagctccccgcggtggcggccgctctagaactagtggatcccccgggctgcaggaattcgtctcacccctagaaaaagcaaaaacttgcttccttcaacggccgcatcattcttccacgtacgtcccgcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtccgtggtggcggagctggagggcgcgctgcttcggagcgcggacatgctcccgtacttcatgctcgtggcgttcgaggcgtccgggctgccgcgcttcgcgctgctgctggcgctgtgcccgctgctgcggctgctggagctggcgggccgtcgcggcctggcgctgcgcgccgccgcgttcgtggccaccgcgggggtgacacgcgccgagctggaggccgtgtcccgcgccgtgctgcccaagttcatggccgacgacgtcgaccccgcggcctgggcggccttcgggagctgcgaggggaggcgcgtcgtcgtcacgcggatgccccgcgtcatggtcgagcgcttcgccaaggagcacctcggcgcgcacgccgtggtcggctctgacctcgagtacagccggctcaggcgctccacggggctcctcaaaggcgcctgccatgaggccgtcgccagccgtgcccgcgcgctgttcgccggcgacgacctgccggaactcgcgatcgccggctcagagatggcgcgctccttcacattctgcgaggagcagatcagcccgccgttcactggagaacacgggatgaacgccgccccacgttccggncggtcatc

SEQ ID NO: 92212 - protein, 219 aa, Zea mays
  misc_feature: Ceres CLONE 1580840
  misc_feature: SWISSPROT Homolog: EC 2.3.1.15 Glycerol-3-phosphate O-acyltransferase
MTPASQAAPPRARRSVVAELEGALLRSADMLPYFMLVAFEASGLPRFALLLALCPLLRLLELAGRRGLALRAAAFVATAGVTRAELEAVSRAVLPKFMADDVDPAAWAAFGSCEGRRVVVTRMPRVMVERFAKEHLGAHAVVGSDLEYSRLRRSTGLLKGACHEAVASRARALFAGDDLPELAIAGSEMARSFTFCEEQISPPFTGEHGMNAAPRSGRS

SEQ ID NO: 92213 - DNA, 850 bp, Zea mays
  misc_feature: Ceres CLONE 1580841
  misc_feature: Translation starting site: 168
  misc_feature: SWISSPROT Homolog: EC 3.5.1.32 Hippurate hydrolase
  misc_feature (673)..(673): n is a, c, t, g, unknown, or other
ggagctccccgcggtggcggccgctctagaactagtggatcccccgggctgcaggaattcgtctcacccctagaaaaaattttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgatgcgcggcggcggggggaagggcgccgcgaccgcgaacgcgagcgggaggcaccagcaccggcgccagcgctacggcgtgggggcgccgtggagggaggagatcgcggggctggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgcaccggcgtcgtcgccacgctcggcaccggccgcccgcccgtcgtcgcgctccgggccgacatggacgcgctgcccatccaggaggccgtggagtgggagcacaagagccngggtccccgggaagatgcacgcgtgcggccacgacgcgcatgtggccatgctgctcggcgcccgcagcatcctcaaggctcgcgagcaccaactcaagggcacggtgaagcttctgtttcagcccggcggaagagtcgggctgcggccccaaccggaatgatctaggacgccccctg

SEQ ID NO: 92214 - DNA, 903 bp, Zea mays
  misc_feature: Ceres CLONE 1580842
  misc_feature: Encodes the peptide sequence at SEQ ID NO. 92215
acccgcggtggcggccgctctagaactagtggatcccccgggctgcaggaattcgtctcacccctagaaaaacagagtacatgtccagaacagtggtggagctcactcaatccaaagtgcgggcgaaacctaaagcgagaggggggagactgggagagagagggacgagcggcgcggtctgctggtccgtcggtggcgaccgcgacgcctcgctgcagcggccgacgcatccgccgcgggcgtggagctcgccctctcctggctcgcaggagctcgcgagttgtttcgggtgcgaggtgagctccatggaacaattccccggggcgtgcgggtgggagtgggatgcttgctcgtgctgggcttgggcggcagttgctgccagccgctctgatccgtggcgtgaggttaggcttggtttgctctgcccgatccacggccctgtccgtgaatatggctcgcatttcgcccgcgatgcttatcctcttttgatccgcgggttcttccatccgagggcttcgttttgcgaacgttatggctttgagcctgagtctttgtgtgccccctgcgtcctaccatgctcccgaggttggccccctttttttgctcccccggggagaactggcttcgaaggcgtactgtctttccgtgtctgcaaagacaaggggtggttttcttttttttacctcgctttggtttttgtcacccctcactttccgattccggcctgggatgtgatttccccttccttccttagtacttcctatggtgataaaaagcccttttggaggcttttcgtcccggctattgtttccctcaaagtttcccattccgattgccccgggcgttcacgcgggcctcacgcggtcccacggggtggataagctaaaatggctgtgccccgcg

SEQ ID NO: 92215 - protein, 266 aa, Zea mays
  misc_feature: Ceres CLONE 1580842
MSRTVVELTQSKVRAKPKARGGRLGERGTSGAVCWSVGGDRDASLQRPTHPPRAWSSPSPGSQELASCFGCEVSSMEQFPGACGWEWDACSCWAWAAVAASRSDPWREVRLGLLCPIHGPVREYGSHFARDAYPLLIRGFFHPRASFCERYGFEPESLCAPCVLPCSRGWPPFFAPPGRTGFEGVLSFRVCKDKGWFSFFYLALVFVTPHFPIPAWDVISPSFLSTSYGDKKPFWRLFVPAIVSLKVSHSDCPGRSRGPHAVPRGG

SEQ ID NO: 92216 - DNA, 912 bp, Zea mays
  misc_feature: Ceres CLONE 1580846
  misc_feature: Encodes the peptide sequence at SEQ ID NO. 92217
tggagctccccgcggtggcggccgctctagaactagtggatcccccgggctgcaggaattcgtctcacccctagaaaaatttctcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaggttcagcggcgtcacccgccatgccgatggctcccccggccaccccgctccggccgtggggccccaccgagccccgcaagggtgctgacatcctcgtcgagtccctcgagcgctgcggcgtccgcgacctcttcgcctaccccggcggcgcgtccatggagatccaccaggcactcacccgctcccccgtcatcgacaaccacctcttccgccacgagcaaggggaggcctttgccgcctccgggtacgcgcgctcctcgggccgcgtcggcgtctgcatcgccacttccgggcccggcggcaccaaactagtctccgcgctcgccgacgcgctgctcgattccgtccccatgggcgccatcccgggaacaggggccccaacccataattggcaccacccccttcaagaaaaaccccatcgtcaagggtaccccttccaatacaaaaaaaaaaatcctgtggccttcaacttgaaaaaaatcccccccgttgggaggaaagggtttttctcccccccccctctggcccaaaaggggcggggtgttttttgaatcccccagggaatatcccctcaaaaagggggggtcccttcttgggaaaaaacccaaaaaattcccccgggaacatatagggcctcttttcccccg

SEQ ID NO: 92217 - protein, 176 aa, Zea mays
  misc_feature: Ceres CLONE 1580846
  misc_feature (19)..(167): Pfam Name: TPP_enzyme_N Pfam Description: Thiamine pyrophosphate enzyme, N-terminal TPP binding domain
  misc_feature: SWISSPROT Homolog: EC 2.2.1.6 Acetolactate synthase
MPMAPPATPLRPWGPTEPRKGADILVESLERCGVRDLFAYPGGASMEIHQALTRSPVIDNHLFRHEQGEAFAASGYARSSGRVGVCIATSGPGGTKLVSALADALLDSVPMGAIPGTGAPTHNWHHPLQEKPHRQGYPFQYKKKNPVAFNLKKIPPVGRKGFFSPPPLAQKGRGVF

SEQ ID NO: 92218 - DNA, 1032 bp, Zea mays
  misc_feature: Ceres CLONE 1580847
  misc_feature: Translation starting site: 159
  misc_feature: SWISSPROT Homolog: EC 1.4.1.2 Glutamate dehydrogenase
  misc_feature (378)..(378): n is a, c, t, g, unknown, or other
  misc_feature (390)..(390): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagtgtaaccgcaccacgccctcgtacgtcgccttcaccgactccgagcgcctcatcggagatgcggccaagaaccatgtcgccatgtatccccatcacaccgtctttgatgccnagcgtctcatcngcaggagggtcagtgatgcgtctgtccagagtgatatcaggttggtggcccttcaagtcatttctggggctggtgaagaaccaatgattggtgtcagcccaagggtaaggagaaacatttgcacctgaaaaaacccccccatggttcctatccaaaagccgggaaatcgccaaaaccttcccttgggaacccaatcaaaaaggtgtgggccaaggcccccgcccctctctaatggcccccaagggcgggcccaaaagaaaccccgggggaatttccggccccttaagggcgcggggataaaaaaaaagaaacaaaggcggggattttccccctgtggggttaaaaaaaaggggcccccgggggggggaaaaaaaaccccccccccctttatgtggggggggggcccctttttgccccccccccccccccggggaaaaaaattttttgggagagacccccggggggaaacccctttgggggggggggggttttacaagggggggcccccccccccgggggtggtggaaaaaaaaaaaatattacccccccccccccccccccggggaggaacccggtgtggagaaagaaaaatctctccccccccccccaaaaagaaaggggggggggggggtcccctccccc

SEQ ID NO: 92219 - DNA, 867 bp, Zea mays
  misc_feature: Ceres CLONE 1580850
  misc_feature: Encodes the peptide sequence at SEQ ID NO. 92220
ctccccgcggtggcggccgctctagaactagtggatcccccgggctgcaggaattcgtctcacccctagaaaaaaccccagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcaagctggacgaagacgcagccagagctggcctccctggcccgggggcccgggcgaccacccccgggaaagaaaagaaaaaagccgggaccgtttcgaccctcgggctgggccctccgtcgttcaaacccgcaaaggggtcttccatggggggacggtgggggaccctttcctccgggccttcgggggtttttaatgggggtttggacaccccggagacggcaaaggttctgcccccccaaaaaaggggccccccgggggggcggtggggtctgaaaaaagaaaaaacccccggggcgtcggccacaggggggggccctttgtgttttttttaaacacggccaaagaaattccccccccccctcttgccaaaaaaaaaaaaaatttgggggtgcactctgtggggggggcccctcccctctcctataaaagaggggaggggctgttttttctcaaaaaaaatatctctcccccccgggagaaaaccttttttggggggggtgtcttttttcaacaagcggggg

SEQ ID NO: 92220 - protein, 99 aa, Zea mays
  misc_feature: Ceres CLONE 1580850
MFGRDPWGGPLEISNADSATDDDRSRDLDRAALMRQAGRRRSQSWPPWPGGPGDHPRERKEKSRDRFDPRAGPSVVQTRKGVFHGGTVGDPFLRAFGGF

SEQ ID NO: 92221 - DNA, 805 bp, Zea mays
  misc_feature: Ceres CLONE 1580856
  misc_feature: Translation starting site: 196
  misc_feature: SWISSPROT Homolog: EC 1.4.1.2 Glutamate dehydrogenase
ctggagctccccgcggtggcggccgctctagaactagtggatcccccgggctgcaggaattcgtctcacccctagaaaaaccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacggtccctgcctacttcaacgactcacagaggcaggccacgaagggatgctggggtgattgctggcctcaatgtgctgcgtatcatcaatgagccaaccgctgctgctattgcctatggtcttgacaagaggcaaccagcgtcggtgaagagaatgtcctcatct

SEQ ID NO: 92222 - DNA, 849 bp, Zea mays
  misc_feature: Ceres CLONE 1580858
  misc_feature: Encodes the peptide sequence at SEQ ID NO. 92223
ctggagctccccgcggtggcggccgctctagaactagtggatcccccgggctgcaggaattcgtctcacccctagaaaaatcatcagccgagtggttgtgccgtggaagctttcgtttaccgttcccattccccgtcgtctttcctctccttcccactctcccacccgtcctccattgctcccttcctctctctcacggagtcgctgcgatctagccaccgagcacgagcgtcctactcgccgcggaccttgctcatggccgcggggtcgatccgggtcaccatggaggtgggcgccgacggcgtcgcgctcatcaccatcgccaacccgcccgtcaacgcgctccaccccatcatcatcgcggggctcaaggacaagtacgcggaggccttgcgccgtgacgacgttaaggcaatcgtgctcactggtgctggaggcaagttctgtggaggatttgatatcaacgttttcacaaaggttcatcagactggggatgtatcacttatgccggacgtatccgtcgagcttgtgtcaaacatgatggaagagggaaaaaaaacttctgttgcagccattcaaggtcttgcattgggtggtggcctagagttgactatggggtgtcatgctcggatatctactcctgaagctcaacttggatgccagagctaacccttggcatcatccctggattttggaggtacccagcgtttgcccagggctgtagggctacccaaagcaattgaaatgatgctgcaaaattagttcattacggcaaaggaagggaatgaaacgtggtttgaatgatgccccttgctctcctggatgattggataaagaaatcacgttcta

SEQ ID NO: 92223 - protein, 137 aa, Zea mays
  misc_feature: Ceres CLONE 1580858
  misc_feature (18)..(137): Pfam Name: ECH Pfam Description: Enoyl-CoA hydratase/isomerase family
  misc_feature: SWISSPROT Homolog: EC 4.1.3.36 Naphthoate synthase
MAAGSIRVTMEVGADGVALITIANPPVNALHPIIIAGLKDKYAEALRRDDVKAIVLTGAGGKFCGGFDINVFTKVHQTGDVSLMPDVSVELVSNMMEEGKKTSVAAIQGLALGGGLELTMGCHARISTPEAQLGCQS

SEQ ID NO: 92224 - DNA, 1226 bp, Zea mays
  misc_feature: Ceres CLONE 1580862
  misc_feature: Encodes the peptide sequence at SEQ ID NO. 92225
  misc_feature (15)..(15): n is a, c, t, g, unknown, or other
  misc_feature (16)..(16): n is a, c, t, g, unknown, or other
  misc_feature (27)..(27): n is a, c, t, g, unknown, or other
tttatttgaggcccnntgggaaacctnaacaccaaaaaaaaaaaggccggaggagattcctcaacaaagaaagggaaaactggaactccccgcggtggcggccgctctaaaatagtggatcccccgggctgttttgattcgtctcacccctagaaaaattgcaagcaacaggaggagaaaaaactaggagcgagacctcgcagctgacgcgcacaaggcaaaacccaatcggagccgtggaccgggccggagatagggctcgaggccatggcaagcggaggcgagggcgcaaggagcggtaaatcccctcccgctgcctcagtggaggcggcacccggggaggcgacgctgcacattcggtgcgcgaaacagctctaagttcacggtgcagacggacctggggcgccacgagtgggcgggttccaggaggtcgtagccgggagctgcaacgtgcctgcggccgcaacaagggagctaatccccccccccccgtatttggtggggggaacaagccaaacccgctagaaaaacttccaggggggttgagaacaaaattccccccaaaattccacttaagaagaccatatggaagctacgccccctacacgtgccgggactctcccacgggtggaagccggggccctggtctagcgccgagttaatcaccgctttaagccattttcaccatgaataaagctgcccgcatatatttaacagtcgctccctccacgtggaaccgacagggtgcggggagatccatcacgtgcgtgcaagacaaaaaccctctgcgcttgtttgtctccacccagcacgctttgggcgaatgatggggtgtgtgcttctattggcccgaccgtggaaaataaagttgcgtgagtgacgagactggcgtactcgcctctcaaatgacgtttaaatcatataaattagtaagggagccctctacttgatgagagattcttcacccacatgcatgagtcctgtgtcttaagtcaccatggcactgtatataaagtgtcaatcacaacatattatatgtagatagcactcaatgaatgagtggctcgcaacaaacatgtgagaaatgcggattaggtgggcggaactattacaatggtgagaaaacttatagtgcctaatagacgaaataagttacccactaaagatgctagacagagggggatatatactccctcccctcgcgaactactctgattttgagtgtc

SEQ ID NO: 92225 - protein, 36 aa, Zea mays
  misc_feature: Ceres CLONE 1580862
MASGGEGARSGKSPPAASVEAAPGEATLHIRCAKQL

SEQ ID NO: 92226 - DNA, 840 bp, Zea mays
  misc_feature: Ceres CLONE 1580865
  misc_feature: Encodes the peptide sequence at SEQ ID NO. 92227
tggagctcaccgcggtggcggccgctctagaactagtggatcccccgggctgcaggaattcgtctcacccctagaaaaaaatcccccgtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttggagaagaaagaaccaggaaggagctgattccttttcttagtgaaaacaacgatgatgaagacgaggtgcttcttgcaatggctgaggaattgggtgtgttcattccgtatgttggtggtgtagaacatgctcatgttttgctcccacctttggagacattgtgtacagtggaggaaacttgtgtccgtgataaagcagttgaatctctgtgccgtattggtgcacaaatgaaggaaactgacattgtcgactggttcattccagtagtaaagaggctagcagctggaagaatggtttacaactcgcgtatcgtcctgtgggtcttttccacatagcctattccaggggcgtcggacccatttgaaaaacagaattgagggactatctattgggtcgcctatgttaaggaagagaatgccctattggtccgaaagaaacaaacaggcttcaaatccttgtgaaaggtttgccg

SEQ ID NO: 92227 - protein, 151 aa, Zea mays
  misc_feature: Ceres CLONE 1580865
MAMIDEPLYPIAVLIDELKNEDIQLRLNSIRRLSTIARALGEERTRKELIPFLSENNDDEDEVLLAMAEELGVFIPYVGGVEHAHVLLPPLETLCTVEETCVRDKAVESLCRIGAQMKETDIVDWFIPVVKRLAAGRMVYNSRIVLWVFST

SEQ ID NO: 92228 - DNA, 1120 bp, Zea mays
  misc_feature: Ceres CLONE 1580866
  misc_feature: Encodes the peptide sequence at SEQ ID NO. 92229
  misc_feature (21)..(21): n is a, c, t, g, unknown, or other
  misc_feature (66)..(66): n is a, c, t, g, unknown, or other
  misc_feature (67)..(67): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (79)..(79): n is a, c, t, g, unknown, or other
  misc_feature (746)..(746): n is a, c, t, g, unknown, or other
gggggagggtggggccgtctnatttatatttatatgaaagaccagtttaagttgggcgctgggggnngggggggnnngnccatgctggagctcccctcggtggcggccgctctagaactagtggatcccccgggctgcaggaattcgtctcacccctagaaaaaacaacccctgtctgtgggagaagggaggagccagagccagccagccagccaccgcccacggcggccacacaacctcggtcggcgcggcggctcaacccaatggctccttcctccccccgccgcccgctgcgccaccacccgtctcccctcgtcgtcctcgccgtcgccgtcctcctcgtctcgctccgaatctcgcgcaccgccgatgggctgccggaagcgggaggaggaggaggcgacggtctgtaccgggagattctcagagacgagaccgtgcagaagctcaaggagctgggcaagatatctgaatggggatgggtaccccccaaaagacctttctaaaatccgggcttctatcagaacccaccggtggtaatcctcagcctgggaagaaaaagaaccctggggccttaaccaacgggggggtgcaatcccaaaatgggggaaaaatttcccatgggcccgaaatattgaaacccgcgggaaaaaatttctctccccgaaaaaaaaaggccccttttgttacaaaatttgggggtatttttccataaaattgtggaaacacacacccggggccccccnggttgaaaaacaccaccaccggggaggatgctgtttaacgcaaaatggggggaatcctcttttgggggggattatttatttatttcgtacgcaacaattctctcgcacctacactcggtgagaaaggtgttcttttaagaaagaattattagcggggggaaaaaaacaccccccagagaggggtttcaaacacaaacacaccacggtggggggagagaactattgggcactttcaaaccgagaaaataaaaggagggggggttcttaatatttctcggaataaaattttttttctcgtgtgaagaacaccgccttcatgagttgtgggtgcccacccaccccggaaattatactgtttttgaacattctttcaa

SEQ ID NO: 92229 - protein, 80 aa, Zea mays
  misc_feature: Ceres CLONE 1580866
MAPSSPRRPLRHHPSPLVVLAVAVLLVSLRISRTADGLPEAGGGGGDGLYREILRDETVQKLKELGKISEWGWVPPKRPF

SEQ ID NO: 92230 - DNA, 871 bp, Zea mays
  misc_feature: Ceres CLONE 1580867
  misc_feature: Encodes the peptide sequence at SEQ ID NO. 92231
cggccgctctagaactagtggatcccccgggctgcatgaattcgtctcacccctagaaaaaatagagagatcccaacagttcgctgccgtcgcctactcgcctccgccagaccgccgccgcgacactacacaccagcgcccccacagaaggagcaaggggggagaaggaaagcggcacccgccgcacatacgccgcgcggcggagccatagccgagctgcggcacgccacggcggcggcggcggcgacgcgcgccactggctccccttccaagcgcgacgccgaggccgcgtcctcgcccttggtcgcgtctccccgcgtcggcggcggcaaggacgggctccgcccccaccagaggtggccgctcccgccccccgtccacaccctcctcgcggtgcgaggaccccaagtcccccaccgcctccgcctcctaccggatcctggtcgcgggcatcgcctgcttcgccctcgctgcgctcttctccgcgccttccctctgggcacgcctcaacgcgccgtacctgtgccgcagggaggggggattccgctcccctgccccagggtcagcccgccggactctcgggggggaaaatcctcatgcaccaccaacttcatgggaaaccgtggggctgaacgtcagaaaccatgagggcctccgaccctttgtgtcagaacaatggaaactgccgggggtttataatttttcccccccctaaggggggaattaaaccccgcaaccgtaatggcctttgtgtaaaaggctggttgcccaattgccgaaagattaacggaaaggcttaccccttatttttgccccgggtgctaaagccgggggacccaagtaattggaaaaggaaccggaccgtaatatt

SEQ ID NO: 92231 - protein, 75 aa, Zea mays
  misc_feature: Ceres CLONE 1580867
MRASDPLCQNNGNCRGFIIFPPPKGGIKPRNRNGLCVKGWLPNCRKINGKAYPLFLPRVLKPGDPSNWKRNRTVI

SEQ ID NO: 92232 - DNA, 917 bp, Zea mays
  misc_feature: Ceres CLONE 1580868
  misc_feature: Encodes the peptide sequence at SEQ ID NO. 92233
ggagctccccgcggtggcggccgctctagaactagtggatcccccgggctgcaggaattcgtctcacccctagaaaaacccccgcctcgccctccgtcgtctcagcgtatgttgtgcatgtgaagagagagaggaagagggtgacgagcgagaaaaaaagctaatagagtgataggttgacaagacgcattgaagctaaggccacgcataccaaagcaacctcaccatcgctcgcaagctactcgatcaaggacattattgtcgcaacgagctagctaggatccgcgcgttagtttcgcgaagcggtggtacatatggctcgcatcctcgtgctggctctggtcaccatcgcgagcctcctcctgccgccggtcgtcgcgagccagcaggcggcggccaagtgcgagtacagaaagcactccggccaccggtacaggcacccggtgggcgtgcggaagatcgtggtggacgcgggcggcgccggcgatttcgtctccatccagcgcgccgtcgactccgtgccggaggggcacaccgtgccgcgtcgtcctgcagatcaacgccgggacgtacattaaaaaaggtggtagtgcccggcgttcaaagcggtacctcacgttccaagggcgcccgggggccaacgtggaccgggggggaaagtggccacgaccgggggcaggcgaccgggggcccccaagggggaagcccctttcccaaactttacaacaccggcccttaagtaacccaatcctcaggctaaaatttttttcacccgcttaagaaacactccagcttttcagggggggaagccaccccgtttttgcccccacacgagaaccccccccagtaaacgggggggcccaaaaaaaaacaaatggggtgctaccccagggggggcgagggcaaaaaaatgggaa

SEQ ID NO: 92233 - protein, 87 aa, Zea mays
  misc_feature: Ceres CLONE 1580868
MARILVLALVTIASLLLPPVVASQQAAAKCEYRKHSGHRYRHPVGVRKIVVDAGGAGDFVSIQRAVDSVPEGHTVPRRPADQRRDVH

SEQ ID NO: 92234 - DNA, 865 bp, Zea mays
  misc_feature: Ceres CLONE 1580870
  misc_feature: Encodes the peptide sequence at SEQ ID NO. 92235
ctggagctccccgcggtggcggccgctctagaactagtggatcccccgggctgcaggaattcgtctcacccctagaaaaaatcctggacgcccgtccggctctgctccattcccttcgtctccctccagcagcctccggccatcgccctctgcgatgacctccacgacgccggggaccttcggaacgctggctaactccggaccggtcgcgctctcgttcccgacgaccacctccttcgcaagcttcctaggcggcggttcgagtcctagccgaataatggacagcgggggaggagtcgggctgtccaagttcaaggccatgaccccgccttccctcccgctgtcgtcgtcgtacccgccgccggcgcagtcgtacctacacgcgttctccggcctcctcgactcgcccatcctcttgactcccagcttattcccgtcgccgacgacgggcgcgatcccgtcggagcccttcaactggatggggacgccggagaacgacctaagcggcagcggcggcgtagaggctgagcagcgccagcagtacaccgacttcgcgttccagacggcggcggcggagacgtcgacgattattaccggcgcggcgcacacggcgtccttcccgcagtcgtctgggctgatgcccccatcgggacgagtaggagactcgtacagcggcgagatgctgcaacaacagcccgcgtggacctaccaggaatccgacggcgcaatttcgaggcggccggcggcccagggctgggcaacttgttcggggaaccggcgggcggttacggggccggtttccggggcttcccccgagcagaaggcggaagcccaccgccccgttctttcgggaacaacggggaat

SEQ ID NO: 92235 - protein, 196 aa, Zea mays
  misc_feature: Ceres CLONE 1580870
MDSGGGVGLSKFKAMTPPSLPLSSSYPPPAQSYLHAFSGLLDSPILLTPSLFPSPTTGAIPSEPFNWMGTPENDLSGSGGVEAEQRQQYTDFAFQTAAAETSTIITGAAHTASFPQSSGLMPPSGRVGDSYSGEMLQQQPAWTYQESDGAISRRPAAQGWATCSGNRRAVTGPVSGASPEQKAEAHRPVLSGTTGN

SEQ ID NO: 92236 - DNA, 1178 bp, Zea mays
  misc_feature: Ceres CLONE 1580878
  misc_feature: Encodes the peptide sequence at SEQ ID NO. 92237
  misc_feature (19)..(19): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1120)..(1120): n is a, c, t, g, unknown, or other
cacggagaagcctgtttcncatagctatacataaaaaagtaaaaccaacaacaatccagccgcccnnnnnggaatagctggtactccccgcggtggcggccgctctataatagtggatcccccgggctgcttgaattcgtctcacccctagaaaaagagactgcgagacacaggcaggcaggcagcggaaaaatagagacaaagaaggggcaggagcagtgacctgccacaccagaggaaacgagagagagaaaaacagcccgatctcctcctcccactccgatcgccctaccgatcgccgcctcgtgaagcttccctgttccctccccgccgcccgcgacgccatggagccgccgcacaccgaggaggccgccgctgctgcagcaggaggagcagagggcggcagcgcaagcccgggcaccggcctcgaagggccgatgctgaggctggggctggacggcggcggggaggggcacccccctcatctgggggctggggaggaggcggacacttggcttccagagcggcctggcgaggccgactgtggctactaccatccgcacgggcggcctgccagcttctgggtagcagcttgccgcttacaaccaacccacctcgaatccgtggccggacactgcaagttttggttggaaggatgcccaaaggaaaagggaggccggcaacaaattacctttgtccaagggaatcggaacccaagggggcccacactccttgttcccttggcccagaaagcttaatgttatatttttagaaataagaaccctttgtgagggaatcctttctgtaatactagaatttttcggggggttgtcgcctaaatattttgcctcagaaagttaattaccaccccgcagatcccccaataagggatcaaaagggtatacgcggaaatcccttggattaagcagaacttaccttggtacctttttaatggtttaatcacacaacgcacaatggggggtatttttccccgctattctattaaaaagtactctggggggtgtgttgaacgaaaaaagcaaaactagggcgtcccccccaaccctcagtgaaaggctaagcggaaactggggggggccacaatatgcacaaaagggancttttggagcaactccccaaccgatggggaagaaaaaattatcgcatcaccaatcacg

SEQ ID NO: 92237 - protein, 137 aa, Zea mays
  misc_feature: Ceres CLONE 1580878
MEPPHTEEAAAAAAGGAEGGSASPGTGLEGPMLRLGLDGGGEGHPPHLGAGEEADTWLPERPGEADCGYYHPHGRPASFWVAACRLQPTHLESVAGHCKFWLEGCPKEKGGRQQITFVQGNRNPRGPTLLVPLAQKA

SEQ ID NO: 92238 - DNA, 853 bp, Zea mays
  misc_feature: Ceres CLONE 1580879
  misc_feature: Encodes the peptide sequence at SEQ ID NO. 92239
  misc_feature (853)..(853): n is a, c, t, g, unknown, or other
agctccccgcggtggcggccgctctagaactagtggatcccccgggctgcaggaattcgtctcacccctagaaaaatcccgccgtcccgccgccaccgcagcaccgctactgccggagtctctcgccaccgtcgttgctctcccgccttcaccgtgccaactcccctccttgcctcccccgcgcttcagtcgctccactccccatcgctttcgcctggtcagaattccagatccaggtgtcctttgacccagaccgcgcctgcctttccctccgctcggattcttcgccgtcttcgttcctactgggcaccgccggggtggagcggagatcggatccgccaggagctgattccttctctcgtagtctagtttgatgcggattcattcgctgaccggcatagcatgatcctgcggtgattgcggtcgcggatagcttgtgcaagctgttggcttgggagttatctttctaatctggcctaaagaaatcctgaggcggtagcgtcacatggatgcaagtacggaggttactgatgttattactgcagtgggcattgacaatgggccaacggggaagttgccgccccgtgatagggtagaggggcacgcaaaaaaaacgacgtgctggctgatggaccgcattcgggtgagagcgaggggaatcaaccccgtctgaagaagtggaaatgggagcccccctcgcaatcccaggaaataaaacccccaaatttccggaggggggtttaagggcctttcacccaaaaggttgttacttaaaatcctcgcgaaaagaaccccttcgggggcgggggaaaaagaaggtgaaccccgggaaaaattctcttccccaatcctn

SEQ ID NO: 92239 - protein, 55 aa, Zea mays
  misc_feature: Ceres CLONE 1580879
MDASTEVTDVITAVGIDNGPTGKLPPRDRVEGHAKKTTCWLMDRIRVRARGINPV

SEQ ID NO: 92240 - DNA, 994 bp, Zea mays
  misc_feature: Ceres CLONE 1580881
  misc_feature: Translation starting site: 212
  misc_feature (787)..(787): n is a, c, t, g, unknown, or other
  misc_feature (838)..(838): n is a, c, t, g, unknown, or other
  misc_feature (936)..(936): n is a, c, t, g, unknown, or other
tggagctccccgcggtggcggccgctctagaactagtggatcccccgggctgcaggaattcgtctcacccctagaaaaaacagcaccgcgcccgccttttcaccccgctcgatcgatcggcacccgcgcatcgcgtcggcattctctccagccgctactccctccctgcctctccacgatctcgcgaaccctgctagatccttgactcgccatgtccaacccctggggcggcatcgttggtgccggcgtgtgggcgctggacgccgagcgcgctgaggaggaggagcgcgacgcagccgcggctcccgtccccgcccccgcccccgccgcgggcttccccagcctccgcgaggccgcagcgggcgccgccggcaagtccaagaagaagaacaaaggaacaacgctctcgctctcggagttcgccgggttcggcccggggcggcggcaagcgccggcgccgccggagcccaggggcctcaccacggcggagatgatgatgctgcctacggctccggagaccgtggcggcgggttcgacgacgacggcaggggctcggatctcgacatgccctcccgcgccgacgaggaccgcgactggtccatgagcaagaagtcgttcacgccctctcccgacgactccggctcgcggaggcggtacggtggcctcgggagtggcgcgcccgcgtccgtcggccgcgctgacgacgatggctactggtcgcgcgggaagaagccgctgccatcaggcccgtcgcgctacccgagcctcggctccgcgggcgggggcntcagcgaatcggccgtctcgaacgaatcctcgaacgctgggtccggcacgncgcgagcatgatgagcgggagaggcctcgcatcgggcttgatccggcaaaacgtgacgccttggcaacccttcccctcctggtgaggggggaacccanccggccaatccattttggaaccccaagccacggaaagactttctgcccataaaggtgt

SEQ ID NO: 92241 - DNA, 967 bp, Zea mays
  misc_feature: Ceres CLONE 1580883
  misc_feature: Encodes the peptide sequence at SEQ ID NO. 92242
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
  misc_feature (959)..(959): n is a, c, t, g, unknown, or other
  misc_feature (960)..(960): n is a, c, t, g, unknown, or other
  misc_feature (961)..(961): n is a, c, t, g, unknown, or other
  misc_feature (962)..(962): n is a, c, t, g, unknown, or other
  misc_feature (963)..(963): n is a, c, t, g, unknown, or other
  misc_feature (964)..(964): n is a, c, t, g, unknown, or other
  misc_feature (965)..(965): n is a, c, t, g, unknown, or other
  misc_feature (966)..(966): n is a, c, t, g, unknown, or other
ctggagctccccgcggtggcggccgctctagaactagtggatcccccgggctgcaggaattcgtctcacccctagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctcgaaggatcagcatctactcttgattgtggactttgtcgcatctgatatcaacttcataaatctttatccaagatggcgctgcaaaacattggtgcttcaaacagggatgatgccttctacaggtacaagatgcccagaatgattaccaagatagaaggccgtggtaatggtatcaagacaaatgttgtgaacatggttgacatagcaaaagcacttgccaggccagcttcctacacaaccaagtactttgaatgtgagcttggtgcacagtccatatttgatgagaagacagggatttccttggttaacggggctcatgatactgcaaagctggctgggtctccttgagtattcatcaagaatcaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 92242 - protein, 91 aa, Zea mays
  misc_feature: Ceres CLONE 1580883
  misc_feature (1)..(91): Pfam Name: eIF-5_eIF-2B Pfam Description: Domain found in IF2B/IF5
MALQNIGASNRDDAFYRYKMPRMITKIEGRGNGIKTNVVNMVDIAKALARPASYTTKYFECELGAQSIFDEKTGISLVNGAHDTAKLAGSP

SEQ ID NO: 92243 - DNA, 1038 bp, Zea mays
  misc_feature: Ceres CLONE 1580885
  misc_feature (516)..(516): n is a, c, t, g, unknown, or other
  misc_feature (979)..(979): n is a, c, t, g, unknown, or other
  misc_feature (980)..(980): n is a, c, t, g, unknown, or other
ctccccgcggtggcggccgctctagaactagtggatcccccgggctgcaggaattcgtctcacccctagaaaaaactcgcaatgtctacttgtctaccgtcgctgcgctagccctcctccctgcttcttgcttttgcctgagcctgcagcctgctgcaagcttttgctttggtttaggtgcttcttttccacccctttactgttccccccacttttgcttgctttgtcacgcacacgaaaagctcctgcctttaccttatctccgcacccgtagtgggatttggtgggagctgcgctgctcgcccctcgcgtttctttgctcaattgggggtcacggtcacggcccgcgggtgctgcgcgtgctcgtgggcgggcggaattcggggttcttgcgcggtcccggtccccctcgcgattgcggacgctctctgcagatcttcgcgtaactccgggagcgcgccggatatgaactgcgtgcccgcccgaccatctggctgccggggtcgggcgccctcntgctttctcaaaccggaattgggaaccagtttttgggccgccgaaccaatctcaacccgggggcccaagttcaaaggggctccctccccgggggtcaaaatcttaaggcgcccccccccggtttacttacaggccgccccccccccagggaaatttctcccccacaattttattgggaggagcacccccttttattctcgccccccaaaatataaaatgtgttcccaaaaaaatcccccccatatttcacaaatttttcccccccccgaggagggggggcggcgccccccctcggggaaaaaactggggcgcggtggggcgccctaaagaaatttcctccccacaaaaatattttcacaaaaaggcgggcggttgttgttcttttttttacagccccccgcagagaaagtttatttggaggcctgcccccccaaatatttgttttataaaaacacaccccccnntttttattatgatgtttcctcaaaacaagcgacaattaattttctacttcacccgccg

SEQ ID NO: 92244 - DNA, 1333 bp, Zea mays
  misc_feature: Ceres CLONE 1580887
  misc_feature: Encodes the peptide sequence at SEQ ID NO. 92245
  misc_feature (1106)..(1106): n is a, c, t, g, unknown, or other
  misc_feature (1196)..(1196): n is a, c, t, g, unknown, or other
  misc_feature (1289)..(1289): n is a, c, t, g, unknown, or other
agcgaggctgttcctctcacccttttccttttcttttcttccactcgacaattatctttcctcttttcaaagctggagctcaccgcggtggcggccgctctagaactagtggatcccccgggctgcatgaattcgtctcacccctagaaaaacatggaagaactcaatttggaggaggaaatgagagcatatgacatggtagggtgtcttaatgagaaggaggggtatgcactttttgtctcttgaagtccctggtttggcagaaagaaggccatcactagtccaaggagacttcatattcgctagatatgctgggaatgattctcagccttaccaaggtttcattcacaaggttgaagctgatgagatatttttaaaatctgatcatcagttccacattaatcacagagaaagacacctattccttgttagccttcccttattacatgagtgtacctgagaatggtttccccccccttttggtgattccaaatttttgttaacccgcccatctagtttcccctaatattccaccttatatgagttttgaaaatggtttctcttttttaaccctcctcgctcctaccatataaacttctggatgcacagctccattatttgtggcccgaggccttattcttcccatgctatagaggatgtgcttacccgttagttcggcaatttaaggtgaccctctttggtgaaaacttgggcattagctctcttctacacctctctgttaataagcgcccttttttctttttactcctttttatttaacccccggactcacaattatattggcgctaattaaattacaccacccttactatttggagtttggcgagatccaattgctcgcacaaattttggtgtgctcgcgatcttatatattcgtacttatatactcgactagcgaaacataagtacatcctcttttctatgatgacgatggggatcgcgtctccccgtatctcgtctttcacatgttttttcattgattaagtagattcctactcctcgcctttctggtgtatgactatatattcacgatttttgtactatatcgcacgatcgttctcatataccgcaattatgtctgatgncgtcgtcgactcgcttatatattttctctcgcacctacatatttttctgcagctatatttcgttctcacatatttttatgttttatgtcnccttatagtttgcgtgcctcttatttctgtccctctgtagtcctctttcttcgtatttctatatatcacttgtatagcgatttgacatagatnatctactagtagattttctctctatcactattctctaccgcccc

SEQ ID NO: 92245 - protein, 82 aa, Zea mays
  misc_feature: Ceres CLONE 1580887
MRRRGMHFLSLEVPGLAERRPSLVQGDFIFARYAGNDSQPYQGFIHKVEADEIFLKSDHQFHINHRERHLFLVSLPLLHECT

SEQ ID NO: 92246 - DNA, 972 bp, Zea mays
  misc_feature: Ceres CLONE 1580891
  misc_feature: Encodes the peptide sequence at SEQ ID NO. 92247
  misc_feature (641)..(641): n is a, c, t, g, unknown, or other
ctccccgcggtggcggccgctctagaactagtggatcccccgggctgcatgaattcgtctcacccctagaaaaaacgccacttccctccccgcaccctgctccctcgcttcaaatcgattcggcgctaccgagcaccaaacgccaaggcggctgcttaccagagtcatgcggacccaaagaagcctccttcccctgctcctgctttccgccgccgcgctgctcgccgacgcgcaggagcgcaagaactacgtggttcatctcgagccgagggacggcggcagcaccgcttcgttggaggagtggcaccggtccttcttgccggaggcgacgctggactcggcggcggacgacgggccgaggatcatccactcgtacagccacgtgctgacgggcttcgctgcccgcctcaccgacgcggaggcggagacgctgcggcgcaaggaggggtgtctgcggctgtacccagaggagttcctgccgctggcgaccacccactcgccgggcttcctcggcctccacatgggcaaggacggcttctggagccgctccggcttcggccgcggcgtggtgattgggctcctcgacaccggcatcctggccagccacccgtccttcggcgacgccgggctgccgccgccgnccaagaagtggaaaggcgcctgccagttccggtcgatcgccggcggcggttgcagcaacaagtcatcggcgcgccccccttcgggagcgcggccataaacaactcggcgccccgtggaacgacccggccacggacgcacacggccagcaggggggcgggaacttcttgcataaaccgacctggggggaaaacccacgaacggggttcggggaggggccccacccccccgggcctaagaaggggtgccccccggaccggggccccatcatggaattcttgccggccttgacaccccccctaaggaaaggttcaaacttgcctccttttcact

SEQ ID NO: 92247 - protein, 190 aa, Zea mays
  misc_feature: Ceres CLONE 1580891
  misc_feature (26)..(107): Pfam Name: Subtilisin_N Pfam Description: Subtilisin N-terminal Region
  misc_feature: SWISSPROT Homolog: EC 3.4.21.25 Cucumisin
  misc_feature (159)..(159): Xaa is any aa, unknown, or other
MRTQRSLLPLLLLSAAALLADAQERKNYVVHLEPRDGGSTASLEEWHRSFLPEATLDSAADDGPRIIHSYSHVLTGFAARLTDAEAETLRRKEGCLRLYPEEFLPLATTHSPGFLGLHMGKDGFWSRSGFGRGVVIGLLDTGILASHPSFGDAGLPPPXKKWKGACQFRSIAGGGCSNKSSARPPSGARP

SEQ ID NO: 92248 - DNA, 934 bp, Zea mays
  misc_feature: Ceres CLONE 1580892
  misc_feature: Encodes the peptide sequence at SEQ ID NO. 92249
ctccccgcggtggcggccgctctagaactagtggatcccccgggctgcaggaattcgtctcacccctagaaaaaacgccacttccctccccgcaccctgctccctcgcttcaaatcgattcggcgctaccgagcaccaaacgccaaggcggctgcttaccagagtcatgcggacccaaagaagcctccttcccctgctcctgctttccgccgccgcgctgctcgccgacgcgcaggagcgcaagaactacgtggttcatctcgagccgagggacggcggcagcaccgcttcgttggaggagtggcaccggtccttcttgccggaggcgacgctggactcggcggcggacgacgggccgaggatcatccactcgtacagccacgtgctgacgggcttcgctgcccgcctcaccgacgcggaggcggagacgctgcggcgcaaggaggggtgtctgcggctgtacccagaggagttcctgccgctggcgaccacccactcgccgggcttcctcggcctccacatgggcaaggacggcttctggagccgctccggcttcggccgcggcgtggtgattgggctcctcgacaccggcatcctgcccagccacccgtccttcggcgacgccgggctgccgccgccgcccaagaagtggaagggcgcctgccagttccggtcgatcgccggcggcgggtgcagcaacaaggtcatcggcgcgcgcgcgttcggaagcgcggccatcaacgactcggcgccgcccgtgtacgacgcgggccacggcacgcacacggccagcacggcggctggcaacttcgtgcagaacgccgacgtgcggggcaacgcgcaacgcacggcgttcgggatggcgcgcacgcgcactggccatctcaagttgtgcacgcgaggcgtgctccatcatgaactcttgccggcctgt

SEQ ID NO: 92249 - protein, 256 aa, Zea mays
  misc_feature: Ceres CLONE 1580892
  misc_feature (26)..(107): Pfam Name: Subtilisin_N Pfam Description: Subtilisin N-terminal Region
  misc_feature: SWISSPROT Homolog: EC 3.4.21.25 Cucumisin
MRTQRSLLPLLLLSAAALLADAQERKNYVVHLEPRDGGSTASLEEWHRSFLPEATLDSAADDGPRIIHSYSHVLTGFAARLTDAEAETLRRKEGCLRLYPEEFLPLATTHSPGFLGLHMGKDGFWSRSGFGRGVVIGLLDTGILPSHPSFGDAGLPPPPKKWKGACQFRSIAGGGCSNKVIGARAFGSAAINDSAPPVYDAGHGTHTASTAAGNFVQNADVRGNAQRTAFGMARTRTGHLKLCTRGVLHHELLPAC

SEQ ID NO: 92250 - DNA, 789 bp, Zea mays
  misc_feature: Ceres CLONE 1580894
  misc_feature: Encodes the peptide sequence at SEQ ID NO. 92251
ctccccgcggtggcggccgctctagaactagtggatcccccgggctgcaggaattcgtctcacccctagaaaaagttcgacctcgtgcacgtcgggaccaccgcgctggccgaaggagggtcgccggcgctgggtcaggccgggacggaggaagcgcttgagttcttcatgtttgatgtcgaccgggtgctgcgcgcccgtgggctgctctggattgacagctacgtgtgccacagcgatgaacggaggcagctgctcgtcaggctaattggtaggtttggttacaagaagctcaaatgggtaacgggagagaaggccggaacagggagcgcaaagccggcgatgtacctctctgcagtgttggagaagccggcacgaagttgaaatcaaatgaatggagtggatggatcatgtaattggctgttgttagcctgttaggtagttgttgctcatctggcagattgcagtgatgtgctgctattctcattcaagcagagaaggaaagcaaaggagggccctttgagctatttgttcatgttatctatctaaaactattcttttgctgtcagttatagtgtatggcaccagcaccatttcttcaataagaaacatagtgcagcaagcaactgcaaagcagcaagctctactcttcttctgtactgaacgtgtgactagataacaataagcgtgtaccatggcggacgagtacggccgcagcggctacagcaggtccggcgccggcgacgactacgacagcggctacaacagcaagtcctgcactgatgactc

SEQ ID NO: 92251 - protein, 71 aa, Zea mays
  misc_feature: Ceres CLONE 1580894
MFDVDRVLRARGLLWIDSYVCHSDERRQLLVRLIGRFGYKKLKWVTGEKAGTGSAKPAMYLSAVLEKPARS

SEQ ID NO: 92252 - DNA, 798 bp, Zea mays
  misc_feature: Ceres CLONE 1580896
  misc_feature: Encodes the peptide sequence at SEQ ID NO. 92253
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
ctggagctcaccgcggtggcggccgctctagaactagtggatcccccgggctgcaggaattcgtctcacccctagaaaaaaatagaaaaatccggagaactgagaaagcccactcgttagtcgttactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggtcttgggtcacctccacctcttacggaagcctatccacgcggcgctcgctcgcctcgcggagcgctacgggccggtgttcttcctccggctcggctcgcggcaagccgtggtggtgtcgtccgcggcttgcgccacggagtgcttcaccgagaatgacgtctgcttcgcgaaccgcccgcggttccccacgctcctgctggtttccttcggcggcgccacgctcccaatgtgccgctacggcccgtactggcgcaacctccgccgcgtcgccacggtgcagctcctgtccgcgcaccgcgtcagctgcatgctccccgtcatatccgccgaggtgcgcgcaatggcgcggaggatgtaccaatccgccgccgccgcccccgccggcgccgcgagggtcgagctgaaacggaggctgttcgagctctcccacagcgccctgatggagacacgaaatcgacagnnnnnnnnnnnnnnnnnnnnnnnnnnnnnnnnnnnnnnnnnnnnnnnnnnnnnnnt

SEQ ID NO: 92253 - protein, 199 aa, Zea mays
  misc_feature: Ceres CLONE 1580896
  misc_feature: SWISSPROT Homolog: EC 1.14.13.89 Isoflavone 2'-hydroxylase
MEPAYVVTLSFLFLFLLHHLLGRHRRRTNGKNKRTQLPPSPPAIPVLGHLHLLRKPIHAALARLAERYGPVFFLRLGSRQAVVVSSAACATECFTENDVCFANRPRFPTLLLVSFGGATLPMCRYGPYWRNLRRVATVQLLSAHRVSCMLPVISAEVRAMARRMYQSAAAAPAGAARVELKRRLFELSHSALMETRNRQ

SEQ ID NO: 92254 - DNA, 867 bp, Zea mays
  misc_feature: Ceres CLONE 1580903
  misc_feature: Encodes the peptide sequence at SEQ ID NO. 92255
gagctccccgcggtggcggccgctctagaactagtggatcccccgggctgcaggaattcgtctcacccctagaaaaaagtgcatgccactcccgtttctccctccaccaccattcaccaccaccagtgccactgccactgccacacacccacaccgaattacgcggcggccctgcgcgcaggatgctctttgcctgcctgcctgcctgctactgctcatctctgcccatatagcgcgcggctagcagcttccggatggacgcgtgcgatgtagcagtggccagctactcggcagcagcgctcgctctctagacgcttgggcttggcacgccggcgccgagatcatccatggccggcgcaggccaggaagaagaaaaggtggagcacgagggagaagaaatggtggccggccggcagcaaggatcgtcgcgcggcgccgtggagcaatgcggcggccaagcacagcctgccgtcaccgctccatgctcgtccaagaacccgccggacgcgaggaagccttacgcgactccggaggggtgctccgtccacccggggccgccgcgggatcaacggcccaacgcgtcgccgaaccaccgcgtgtccctggagaacgacgttaggcagctgcagctgcatttgcgtcaggagaggtctgtccgggtcatgctcgatcgggccattggccgggcgtccagcgcgctgtctcctggccataggcatttccgggattcccggcgcagacaaaggagctgatagcggagatcgaattgctcgaggaagaaatcgccaaccgcgagcagcacgttcttactctctacggagcatcttcgaccagtgcatgtctggggccaccgtcttgccagagctc

SEQ ID NO: 92255 - protein, 134 aa, Zea mays
  misc_feature: Ceres CLONE 1580903
MAGAGQEEEKVEHEGEEMVAGRQQGSSRGAVEQCGGQAQPAVTAPCSSKNPPDARKPYATPEGCSVHPGPPRDQRPNASPNHRVSLENDVRQLQLHLRQERSVRVMLDRAIGRASSALSPGHRHFRDSRRRQRS

SEQ ID NO: 92256 - DNA, 897 bp, Zea mays
  misc_feature: Ceres CLONE 1580906
  misc_feature: Translation starting site: 391
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (419)..(419): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (496)..(496): n is a, c, t, g, unknown, or other
  misc_feature (504)..(504): n is a, c, t, g, unknown, or other
ctggagctccccgcggtggcggccgctctagaactagtggatcccccgggctgcaggaattcgtctcacccctagaaaaaaagacacaccgacgcgtacgtagcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaataaaacatgggtgatgaatgtgtaccctccctaaaannnnnnnaanaaaaaaaaaaaaaaaaaaaaaaaaaaaaaaaaaaaaaaaaaaaaaaaaannnnnnnnnnnnnnaaaaaaaaaaaaanaaaaaaanaaaaaaaaaaaaaaatccctctttttccttttctcccaattaagccccttcttttcccaaaaaaccccaaagagtttttgttggggggggcgcgggtatcttgggtcattttgaaaaaggggaaccccaaaaggggggctttttagggggccccaggggggggggggggagttctcacaaaacctctttttaaaaaggggaaaattttttaaaacccccccttccgggaaaaaattttaaaaacgcggggaccccccccccccccgggaaggtttccccccccccctcgcggaggggaaaaaaggggccaaatgttccccccctccctataaaggcccccccggggagggccttttaaaaaaaggggcccctgggccaaaaaaaaaagggaaa

SEQ ID NO: 92257 - DNA, 821 bp, Zea mays
  misc_feature: Ceres CLONE 1580907
  misc_feature: Encodes the peptide sequence at SEQ ID NO. 92258
  misc_feature (530)..(530): n is a, c, t, g, unknown, or other
  misc_feature (717)..(717): n is a, c, t, g, unknown, or other
acccgcggtggcggccgctctagaactagtggatcccccgggctgcaggaattcgtctcacccctagaaaaaaccaaccaacaggtggcgagagcgagagcgagagcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgagattgtttttgtttcaccaactggcgaggaaattaagaacaagaggcaattaagtcagtacctaaaggcacaccctggaggccctgctgtttcagagtttgattggggaactggtgataccccaaggcgttctgctcgtattagcgagaaagtcaaggtatttgatagcccagagggcgagaagatcccgaagcgcagcaggaactccagtggtaggaagggtaagcagggggaagaaggaaaccccctgagaccgaagaagcnaaagatgctgaaactggcaaggaggcagaggaggccccaagcgaagatgccgcaaaggagactgatgtggagatgaagcctgctgaaagagtgaagggggcctctgctgaaacagaagatgctgacatggctgatgctcctgcacaggcaccatggaagagattagaaaccaactgaagaactggcngagctattgcagctcctcctgtgcctccgaagaagagaaagatgcaggcagctgaacctgagctgcagcagcaaccaactggagattcggcccctgctctggtg

SEQ ID NO: 92258 - protein, 147 aa, Zea mays
  misc_feature: Ceres CLONE 1580907
  misc_feature (8)..(78): Pfam Name: MBD Pfam Description: Methyl-CpG binding domain
  misc_feature (123)..(123): Xaa is any aa, unknown, or other
MATPGEQPAEVVSVEMPAPDGWTKKFTPLRGGRSEIVFVSPTGEEIKNKRQLSQYLKAHPGGPAVSEFDWGTGDTPRRSARISEKVKVFDSPEGEKIPKRSRNSSGRKGKQGEEGNPLRPKKXKMLKLARRQRRPQAKMPQRRLMWR

SEQ ID NO: 92259 - DNA, 808 bp, Zea mays
  misc_feature: Ceres CLONE 1580908
  misc_feature: Encodes the peptide sequence at SEQ ID NO. 92260
ctccccgcggtggcggccgctctagaactagtggatcccccgggctgcaggaattcgtctcacccctagaaaaattcgttgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagttctggctgtggctagtgacatggcacctgggcctgttcatcgtgctcaccttcggccagatcggattcaagggcaggaccgaggactatttcgagaagtgaagcggttatgatcggatccatcatcgctggtgctgcgttgcgtgcgtgcctgccgcaatcgaacctttgctgtgtatagggttccgatttcgtggaatgtaccatgctacttttgaccttcaatgtaaaatctatgccgcccgggcccaaacgcgctctgctttaaagtcgcgtttccatcaaatctccacgagcggatagcggcggtacgaatcttttcgtgctcgtctttcacgtccgggtgggctg

SEQ ID NO: 92260 - protein, 144 aa, Zea mays; identical to SEQ ID NO: 83774
  misc_feature: Ceres CLONE 1580908

SEQ ID NO: 92261 - DNA, 832 bp, Zea mays
  misc_feature: Ceres CLONE 1580909
  misc_feature: Encodes the peptide sequence at SEQ ID NO. 92262
  misc_feature (813)..(813): n is a, c, t, g, unknown, or other
ctccccgcggtggcggccgctctagaactagtggatcccccgggctgcaggaattcgtctcacccctagaaaaaaacctcaccttcaagcgtcaagtagcaaaactacagctttccttcacccccagcaagaaaaccgagcgatctagcagactaccacagaagatttcctactcggccgcacgtgcagaccctgatctgactgagagaggcaggcagcagctcgatcggcagtaaccgtgagcgagccatgggactggcctggatggtgacggcggccgtcgcggcggtgctggcgtcgtgggcgttcaacgcgctggttcacctcgtctggcgtccctacgccatcacccggaggctccgcgcgcagggcgtgcgcgggccgccctacacgttcttcaccgggagcctcggcgagatcaagcggctccgcgccaagggcgccaccgtcacgctggacgtcgacgaccacgacttcatccccatggtgcagccccatctgcgcaaatggatcgcgctctacgggcggacgttcgtgtactggaccggcgcgaggccgaacgtgtgcgtggcggacgtgaacgtggtcaggcaggtgctcttcgaccgcaccggcctctaccccaagaacctcatgaacccgcacatctcccgcctgctcggcaagggcctcgtcctcaccgacggcaacgactggaagcgccaccgcaaggtcgtgcacccggcctttcacatggacaagctcaagctgatgacggcgaccatgtccgactgcgctcgctcgatgatctccgagtgggacgcacagctgcanaaaggagagagcgggcgcc

SEQ ID NO: 92262 - protein, 194 aa, Zea mays
  misc_feature: Ceres CLONE 1580909
  misc_feature: SWISSPROT Homolog: EC 1.3.3.9 Secologanin synthase
  misc_feature (188)..(188): Xaa is any aa, unknown, or other
MGLAWMVTAAVAAVLASWAFNALVHLVWRPYAITRRLRAQGVRGPPYTFFTGSLGEIKRLRAKGATVTLDVDDHDFIPMVQPHLRKWIALYGRTFVYWTGARPNVCVADVNVVRQVLFDRTGLYPKNLMNPHISRLLGKGLVLTDGNDWKRHRKVVHPAFHMDKLKLMTATMSDCARSMISEWDAQLXKGESGR

SEQ ID NO: 92263 - DNA, 995 bp, Zea mays
  misc_feature: Ceres CLONE 1580910
  misc_feature: Encodes the peptide sequence at SEQ ID NO. 92264
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (22)..(22): n is a, c, t, g, unknown, or other
  misc_feature (42)..(42): n is a, c, t, g, unknown, or other
  misc_feature (67)..(67): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (101)..(101): n is a, c, t, g, unknown, or other
ttttttttttnnntnntttttntccacgtgacatagtatccnccccatttccttttcttaggtatanaaannntnnnnnnnnaaaaaactggagctcaccncggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctggtgaaacaaggcagggcgctccgtaagcttgaagatgggatgtatccagagcctacttcgttggcttacggtagcagggccagcggctcagtgcctccctcaagaagaatcaggccgccaaggttcctcgtccggggccgatcttgtttactaacgggagtgggccccggtgggggaaacaaagttcgggcctccctgggccgtcaacgcgaacccccgagtccctactcgccaaggggggcaaatgaaccggtgacctgccctgccccggacgaaacgggaaaccgggcggaaggaattccctgggggtttccacggggcaatgggaacaagcccaaataaaaccttcctgaccgaagggccctttctctgggtgcgcattgatgccctggaggtccccccagacggggccaaaacgccc

SEQ ID NO: 92264 - protein, 217 aa, Zea mays
  misc_feature: Ceres CLONE 1580910
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLVKQGRALRKLEDGMYPEPTSLAYGSRASGSVPPSRRIRPPRFLVRGRSCLLTGVGPGGGNKVRASLGRQREPPSPYSPRGANEPVTCPAPDETGNRAEGIPWGFPRGNGNKPK

SEQ ID NO: 92265 - DNA, 858 bp, Zea mays
  misc_feature: Ceres CLONE 1580912
  misc_feature: Encodes the peptide sequence at SEQ ID NO. 92266
ctccccgcggtggcggccgctctagaactagtggatcccccgggctgcaggaattcgtctcacccctagaaaaattcctccaccttatcatcgcccacgtacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcagagatgttttgcgagtagtcactatacaagctttgccgtagaaaaacttgcctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggattggctggtctatcaacagcgaagtatctggcagatgctggccataaacccatattgcttgaggcaagagatgttttggggtggaaggtagctgcttggaaggatgaagatggagattggtacgagactgggcttcatatctttttttggagcttatcccaacatacagaatcctgtttggcgagcttaggaattgaggatcgtttacagtggaaaagaacactctatgatattcgccatgccaaaacagccagggagaattcaggcgggttgat

SEQ ID NO: 92266 - protein, 196 aa, Zea mays
  misc_feature: Ceres CLONE 1580912
  misc_feature: SWISSPROT Homolog: EC 1.14.99.30 Carotene 7,8-desaturase
MDTGCLSSMNITGASQARFFAGQLPPQRCFASSHYTSFAVEKLASRNKGRRSHRRHPALQVVCKDFPRPPLESTINYLEAGQLSSFFRNSERPSKPLQVVVAGAGLAGLSTAKYLADAGHKPILLEARDVLGWKVAAWKDEDGDWYETGLHIFFWSLSQHTESCLASLGIEDRLQWKRTLYDIRHAKTARENSGGL

SEQ ID NO: 92267 - DNA, 850 bp, Zea mays
  misc_feature: Ceres CLONE 1580914
  misc_feature: Encodes the peptide sequence at SEQ ID NO. 92268
ggagctccccgcggtggcggccgctctagaactagtggatcccccgggctgcaggaattcgtctcacccctagaaaaaaaaagccaaacaccggaccacccctcccccctccattcctccctctccctacacctccgctccctctcgccgctttcccccacccaatccgaccgctgggccgcctcctctccgccggggccggcgattccccggagattccgcgcgattcggctcagattctgggctcctcttgtggtttctcggcgaatcggcgggatcgggactcccggctggagaatcttccgtctgtttcgctaactgtttggatcattttacgtggagattgcatgccatcaccttccttgaagtgaaaaatatatgggctgatcttggcatttcatgggaggttttgaagatgatgaaccaccctcaaaacgcgcaagagcatcctcagtagaatctgcaagtttaccagactgtttcttgttttcaaaatctgccaatcctttgggaagtacaatggctagacctttgccttcccaagggaaagaagctatggttggttccaagggtgttattaagaaggaggaattttgtaggataatcagcaaaactctgtatagtctgggatatgagaaaaagtgagcagttctgggagaggaatcagggattactttacataaccctatggtgaaatcttttcagagagcaggtgattgatgggaatggggataatgcgggttgttactttgaataagattggccttccagatgtaaacatcatgaaatctgcggcatttttgatatgggaaccaaaaattctttgaccttctaaaaaatgacaatgtct

SEQ ID NO: 92268 - protein, 81 aa, Zea mays
  misc_feature: Ceres CLONE 1580914
MGGFEDDEPPSKRARASSVESASLPDCFLFSKSANPLGSTMARPLPSQGKEAMVGSKGVIKKEEFCRIISKTLYSLGYEKK

SEQ ID NO: 92269 - DNA, 923 bp, Zea mays
  misc_feature: Ceres CLONE 1580918
  misc_feature: Encodes the peptide sequence at SEQ ID NO. 92270
  misc_feature (923)..(923): n is a, c, t, g, unknown, or other
aaagctggagctccccgcggtggcggccgctctagaactagtggatcccccgggctgcaggaattcgtctcacccctagaaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgacaccctcccagctatggtcagtggggtttattcggatgacaataaccttcagcttgagggcaccacacagtttcgcaagttgctatctatagagaggagccttcccattgaagaaatttatcaaatcagggggtgtttccaagatttgtggcagttgctcccaaaaaaaggaatttgcccccgcctgcatttccaaaccagcctggggcttcccacaaaatatttgctttctgggcaccttcagaaaaaacaaaaggtttggtatttgaatcattgggggcggttccctaaattttgggaaaacttccttggggtcggggaaaagaaagatattgttcgtggaacaaggctgtggggggggtctttgggaataagtttctagggggtttttccccaaaaaggggcggagcccttgtctctttcccaaaggggggctttgagaacccccttgtgttccccccttgttaaaaaaagaggttgaaaaacctcccctctttttgaggagaaacccctcccn

SEQ ID NO: 92270 - protein, 195 aa, Zea mays
  misc_feature: Ceres CLONE 1580918
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLDTLPAMVSGVYSDDNNLQLEGTTQFRKLLSIERSLPIEEIYQIRGCFQDLWQLLPKKGICPRLHFQTSLGLPTKYLLSGHLQKKQKVWYLNHWGRFPKFWENFLGVGEKKDIVRGTRLWGGSLGISF

SEQ ID NO: 92271 - DNA, 823 bp, Zea mays
  misc_feature: Ceres CLONE 1580919
  misc_feature: Encodes the peptide sequence at SEQ ID NO. 92272
  misc_feature (677)..(677): n is a, c, t, g, unknown, or other
  misc_feature (744)..(744): n is a, c, t, g, unknown, or other
  misc_feature (823)..(823): n is a, c, t, g, unknown, or other
ctccccgcggtggcggccgctctagaactagtggatcccccgggctgcaggaattcgtctcacccctagaaaaattcctccaccttatcatcgcccacgtacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcagagatgttttgcgagtagtcactatacaagctttgccgtgaaaaaacttgcctcgaggaataaaggaaggagatcacaccgtagacatcctgccttgcaggttgtctgcaaggattttccaagacctccactagaaagcacaataaactatttggaagctggacagctctcttcattttttagaaacagcgaacgccccagtaagccgttgcaggtcgtggttgctggtgcaggaatggctggtctatcaacagcgaagtatctggcagatgctggccataaacccatattgcttgaggcaagagatgtttttgggtggaaagtagctngctgggaggatgaagatggagattggtacgagactgggcttcatatcttttttggagcttatcccancatacagaatctgtttggcgagcttaggattgaggatcgtttacagtggaaagacactctatgatattcgccatgccan

SEQ ID NO: 92272 - protein, 179 aa, Zea mays
  misc_feature: Ceres CLONE 1580919
  misc_feature: SWISSPROT Homolog: EC 1.14.99.30 Carotene 7,8-desaturase
  misc_feature (137)..(137): Xaa is any aa, unknown, or other
  misc_feature (159)..(159): Xaa is any aa, unknown, or other
MDTGCLSSMNITGASQARFFAGQLPPQRCFASSHYTSFAVKKLASRNKGRRSHRRHPALQVVCKDFPRPPLESTINYLEAGQLSSFFRNSERPSKPLQVVVAGAGMAGLSTAKYLADAGHKPILLEARDVFGWKVAXWEDEDGDWYETGLHIFFGAYPXIQNLFGELRIEDRLQWKDTL

SEQ ID NO: 92273 - DNA, 926 bp, Zea mays
  misc_feature: Ceres CLONE 1580921
  misc_feature: Encodes the peptide sequence at SEQ ID NO. 92274
ctccccgcggtggcggccgctctagaactagtggatcccccgggctgcaggaattcgtctcacccctagaaaaaacagcttctcccgacgaacacggcaccacaagccccgcacggccgctacccacccagatttagactctcccaccgcggctgcatatctctcccccacccgcactccggtcgtcccattaccctctggcattggttgtcgatttcttcattcgtgcttgcttgcgtacaatatttaaatcaatgaaggcaaatatgggcacaaaagctcgtccaccatctgctgatgcagaaaaaggggagattggcgaaatagatacaagggctccaattcaatctgttaaagctgcaatgagtttatttggtgaggtccgcttttcatccacctacttggctgaaagaaagcccaaggctcctcaaacagagagggttttagccaaggagacagagttgcacatggcccagaaagagttgaataaatacaaggaacagctcagtaatgctgagacaacgagagtacaggctctctctgagctagagaaagctaaaaaaactgttgaggagctaacagccaagctggatctgattaacaagtccaaacagttggccatccacgcaacttaggatgcagagactcaaatcaagcatcttgaaggtggcagcacaagtgaaggtctaggaacagatggtgctctgaagccggaactggaaaagtgcaatggtaacagtatgctgtttgctttgggcagaccttgatgtcgccaaaactagaagcttaccaaagctcaaaagagggattttttgaaacatttttttgcgatatgaagggtagttcttgcgttcccaaaacagggaaagaagggaatctcttggtatatcaatctcggaacgcccacattttgaatcaaaagctaa

SEQ ID NO: 92274 - protein, 126 aa, Zea mays
  misc_feature: Ceres CLONE 1580921
  misc_feature (27)..(126): Pfam Name: DUF827 Pfam Description: Plant protein of unknown function (DUF827)
MKANMGTKARPPSADAEKGEIGEIDTRAPIQSVKAAMSLFGEVRFSSTYLAERKPKAPQTERVLAKETELHMAQKELNKYKEQLSNAETTRVQALSELEKAKKTVEELTAKLDLINKSKQLAIHAT

SEQ ID NO: 92275 - DNA, 2103 bp, Zea mays
  misc_feature: Ceres CLONE 1580922
  misc_feature: Encodes the peptide sequence at SEQ ID NO. 92276
aacaaccctagacgtggaatcaggatcagtgtgcacggggaaccagcaacggcagcacgtacgtggaaccggcaccgacgaattgcacggggcagcagacaatcgtcgcctccttgactccatccgcgaccttcctccatccgtggtgccagcaaactgcacgagaagacctaggtcaggtgactcggtgctagccacactattacaagatgcctcctagtcgtttgcaggttggaacaaaaacaacagaaggacataaccaagcaggaaacacattacatccatatgaagtgcagcgccttagacaagttatgagaaacaatgcaaggctgcaacaactgggaattcctggtttatgcgacacactgccaaaggcatattcctttcatcacaacaaaaataagccaaattttacaaataatgaagattcagaatctgattataatccttcatcaaatgacactggtgaagaagatttacttgatgatgacaatgttcagggctcgaaggattataatatgaggactacaaacatgtctaatggtgtaatcaagctacgcactaaaagacttcttgcagagaaagaatctattagaattacaaggtcaaaaaaaactgctgcccagcctaatggtactgaagtgtttgacaacaacgatggccatacccaggctacagttcaagctagtgaccctgctctatttgacgagtacacccacatggctaatggaggtcattccattgctcgccctgatgggcacaacctgatgggaaacaaagataatgtaaacatccaagttgatgacaacatgaccagtggaggtgaagctagcatcgagcctagtgtacatgtacaactaggtgaaaatgatcgatgggaaaggggagttaatatgggacatggtctccataggatgaaccgagctatgcgtggaaaactgccggttgttattcctgaagggaggataaggcccgtggcacctcttgttgctgcaaagttttcaactgaatgcaatattgcagttaggaaccatgtgccagtgtacaagcattggaaggattacaagaaccataatggcatgtttaacctatttacagataaacttagtgcaaagtttgatatcaacacaaatgatgcaccagtccaaaaggcttgttcccaaatgatgaaaaatgctataaggcaacaacggtacagactaaagaaaaaattctttgatccttttccactacatttggtgacaaaaacatcaccaatcagatcgatgagtaatgaagagtggaatgatcttgtggaatattggaagagcccaaaaaggatggagacatcacaaaagaacaaagataaccgatccaaagttaaatttcatcaaacaacgggatctcgtagctatatggttcatgtagaaattttgggagataaaaacattggtcaagagcccgatgcattagatttgttcaaggagtgtcattacagcaggaaaaagaaatgttacacatctaccgtgcaacaagctataactcaaatggataacaagcggtctgcaactacagaaggtgaaaaatcaatgtctgcaactgaagttgttgctaatgtgcttgctgaaaatacaaagaagaatttgttccttcaaaatgtggggatacaaaatgttggtcctaggtctagtctgagaaatattgaagcacagttggaagtggagaagagggcaaacagtgaccttaaatctattgttgatgctcaacatgaacaattggatgcattgttaaagcaaatgcaagaaactgaagaaaataggatcagggagcaagaggaagtgaagaagaagcaagctgagatggaaacaaagatgcaacttgtgttgagtcagattcattcaagattgagatagtatttatgtcatgttgacaactttttttgttgttgcaacaactttctttcttttttatggaaccaactataatgttttggatatgatgtggtgttctggttggatagtctttattgtttgggattgtccatgtgaagttctagttggatatttgaatttaaatattgatattttgtcattataattgttatgttaaaaaaaaaaaaaaaaa

SEQ ID NO: 92276 - protein, 560 aa, Zea mays
  misc_feature: Ceres CLONE 1580922
MPPSRLQVGTKTTEGHNQAGNTLHPYEVQRLRQVMRNNARLQQLGIPGLCDTLPKAYSFHHNKNKPNFTNNEDSESDYNPSSNDTGEEDLLDDDNVQGSKDYNMRTTNMSNGVIKLRTKRLLAEKESIRITRSKKTAAQPNGTEVFDNNDGHTQATVQASDPALFDEYTHMANGGHSIARPDGHNLMGNKDNVNIQVDDNMTSGGEASIEPSVHVQLGENDRWERGVNMGHGLHRMNRAMRGKLPVVIPEGRIRPVAPLVAAKFSTECNIAVRNHVPVYKHWKDYKNHNGMFNLFTDKLSAKFDINTNDAPVQKACSQMMKNAIRQQRYRLKKKFFDPFPLHLVTKTSPIRSMSNEEWNDLVEYWKSPKRMETSQKNKDNRSKVKFHQTTGSRSYMVHVEILGDKNIGQEPDALDLFKECHYSRKKKCYTSTVQQAITQMDNKRSATTEGEKSMSATEVVANVLAENTKKNLFLQNVGIQNVGPRSSLRNIEAQLEVEKRANSDLKSIVDAQHEQLDALLKQMQETEENRIREQEEVKKKQAEMETKMQLVLSQIHSRLR

SEQ ID NO: 92277 - DNA, 805 bp, Zea mays
  misc_feature: Ceres CLONE 1580927
  misc_feature: Encodes the peptide sequence at SEQ ID NO. 92278
  misc_feature (249)..(249): n is a, c, t, g, unknown, or other
  misc_feature (618)..(618): n is a, c, t, g, unknown, or other
  misc_feature (673)..(673): n is a, c, t, g, unknown, or other
  misc_feature (692)..(692): n is a, c, t, g, unknown, or other
  misc_feature (693)..(693): n is a, c, t, g, unknown, or other
ccccgcggtggcggccgctctagaactagtggatcccccgggctgcaggaattcgtctcacccctagaaaaaagccgccgcctccttccctctcctcctccacgtctcctcaacagccgctgccacccggagccttcccgcagcgacgccatgtgggctcttcgccgagctggcaaccccctcaggttccgtgcccaaaaagttgcaagtgcctatgtctgtgcgagtcttgaggtgctgctagctgcntgatgcaaagaatgtagaagagcaccatgaggcagactgccagaaaatgtgctgctgtcataaaccaaggtcaccagccctttcaaattgtcatttttcaatctggccagttttgctttgcaattagggggttttctccctcctcaagccagggggccaaaattttggggtgaacaaaccttttttaattttaaagggagggattttttttgaatttccgaggggttccccccccaaggggggtttaaaaaaaaaaaaaaaagggggtggggccccttaaaaaaaaaaaattttcctaaaaaaaagaaaatccccccccaaaaaaaaatttgtgctctccccccccccaaatggggggggatccccctnctttccacaaaacccggggggagggagggggccccccccccccaaaaaaaaaaanttggggggggttttttttnnccccccccccccccaaaaaaaaaaaaaaaagggggggaggggggggttttttttctctccccccccccaaaaaaaaaaaattttttttttgttttagggacgccccccaccc

SEQ ID NO: 92278 - protein, 33 aa, Zea mays
  misc_feature: Ceres CLONE 1580927
MWALRRAGNPLRFRAQKVASAYVCASLEVLLAA

SEQ ID NO: 92279 - DNA, 829 bp, Zea mays
  misc_feature: Ceres CLONE 1580929
  misc_feature: Translation starting site: 217
  misc_feature: SWISSPROT Homolog: EC 6.1.1.6 Lysine--tRNA ligase
ggagctccccgcggtggcggccgctctagaactagtggatcccccgggctgcaggaattcgtctcacccctagaaaaactctttccattcctccgcgccgccactagctgtcctaaaccctaccatcacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaaacttacagatgtggcagagtgtttagctgggaggatcatgaaacagagaacatcgtcgtcgaagctattcttttatgatctttatggtggtggcatgaaaggtcaagtgatggctgatgccaggactcggaagtggatgaggctgaattttctagtaccactcaggtgtgaagcgaggtgatattgttggcattggtggatatccaggaaaagcaaccgagggaagc

SEQ ID NO: 92280 - DNA, 1212 bp, Zea mays
  misc_feature: Ceres CLONE 1580930
  misc_feature: Encodes the peptide sequence at SEQ ID NO. 92281
  misc_feature (1)..(1): n is a, c, t, g, unknown, or other
  misc_feature (2)..(2): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (588)..(588): n is a, c, t, g, unknown, or other
  misc_feature (678)..(678): n is a, c, t, g, unknown, or other
  misc_feature (679)..(679): n is a, c, t, g, unknown, or other
  misc_feature (830)..(830): n is a, c, t, g, unknown, or other
  misc_feature (836)..(836): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (999)..(999): n is a, c, t, g, unknown, or other
  misc_feature (1050)..(1050): n is a, c, t, g, unknown, or other
  misc_feature (1053)..(1053): n is a, c, t, g, unknown, or other
  misc_feature (1083)..(1083): n is a, c, t, g, unknown, or other
  misc_feature (1149)..(1149): n is a, c, t, g, unknown, or other
  misc_feature (1183)..(1183): n is a, c, t, g, unknown, or other
nncccccccnnnccacccctgcgacgaagtatgaggtagggaaagaaggaggggggaannnatgtgggtttgggcaaagctggagctcaccgcggtggcggccgctctagaactagtggatcccccgggctgcatgtattcgtctcacccctagaaaaaagccgccggctccttccctctcctcctccacgtctcctcaacagccgctgccgcccagagcctgtcccgcacacgacgccatggtgggctcttcgctcgaactggcaaccccctcagggtccgtgcccaaaaagttgcgagcgcataaggctgtgggagtattgaggtgctgctagctactgatgccacaggtgtggaacaccaccatgaggctgactgccagaaaatgtgctgctgtcggttgccaaagtcaacacccatttaattgccatttccatgtggtcactttggttgcaacaagggtgcctccatcttagcttgggcgcaattcccgtgctgacaagcgccatgagttacggaaacagattttcctggacctccgaccgtgccaccagcaggatgttccacaccccactcaccggtccggcnaccgccaaacataattatcaaccaaggaatgcctggcctgacccacatccgagggtaccccccccaacgatgatatggccctcactcgcnnaaaccccggcaggaagagcagtccacaaccctaccaacgaatgtctgctgggaatttcttcggttcccaccgctcccaatggaacttgtgaatccgatgaaattacacgacttgtcgcccccctcacaaaggaaacttgggaggtttgggngatggncatacccggaacaagggaccttcggaagatcgcgatcaaaaaaaggtcnnnctgttagaaacacaaaatggcgcgcataaacagaccaatgcgggcacaggcaggatcaccacacacaacgcggcgcgggggaacaccaacccccatactaggggaacgcacntgccgtaataaaccctccccggcgagaatggcgcgccaacaagaggtgtgnccncgcacccaacgccccgcttgtggaaggcgncatgcgtgagtacgagaccacgcttttccccggtgagtagccactctacccggtaagtcggcaatncttttatccgacacaccctcaccgacatagttgnacagtctccacctcctcgtcctgcgtgta

SEQ ID NO: 92281 - protein, 31 aa, Zea mays
  misc_feature: Ceres CLONE 1580930
MVGSSLELATPSGSVPKKLRAHKAVGVLRCC

SEQ ID NO: 92282 - DNA, 1228 bp, Zea mays
  misc_feature: Ceres CLONE 1580931
  misc_feature: Encodes the peptide sequence at SEQ ID NO. 92283
  misc_feature (67)..(67): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (912)..(912): n is a, c, t, g, unknown, or other
  misc_feature (1166)..(1166): n is a, c, t, g, unknown, or other
  misc_feature (1167)..(1167): n is a, c, t, g, unknown, or other
gggtttttggggggttcttggccgggtcgggtggcgggtgggtccggttttgtttgcccaaataagnaggggggnnncaaaactggagctccccacggtggcggccgctctagaactagtggatcccccgggctgcaggaattcgtctcacccctagaaaaaaccacctcgcctgctagcctcctccgtctgctcaagacgagggaggagcagagaccgaactctgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgtgccgggcccgggtccgaccaacagcagcactgaagcgcatccctgccgccgacaccgggcttcatgggtccagccaacaatgaggccaccccggcttaaacgatcatcggcagcccgacctttcgccggccaccttatgcgtccccagccttccaccgtctgggaacaccggaacaggcccgcccagttgccttcccaccagggagaggcttgcccccgcccaggttattcgggggggtggggccgcacaatcttggcctttcgggggttccccctggggggccaatttttcttggcctccctgcccccagttgagaaaacaaaataggtattgcccccctccaaaagaggtcggggggggggcaaatatttcgcgggtttatcccgccccccccggcacggggtgtccaccagttttacttaaggggtttgtgcccccccccgggagaggttggggacccccccctttttttttttcccgngagcacaaatggaatattttcccccgttttgggcgtcctcttttcccccgccggagtgtgggccctcttccgttagaaggtcgctcttgcaccaaaatcacacaatatgttctggtggagacccctctcccctctcttttagtaaagaaagaggggcgcgtgtttatcatttgtgcgctcatctttcttttattgagaagaccccccgcaccacacggctgttgttgtcccaatttccccatagaagggtgggnngcgcgtggaccccccggtgggtttgtaaaaggattctcgcgggtgacccccttgagtattg

SEQ ID NO: 92283 - protein, 82 aa, Zea mays
  misc_feature: Ceres CLONE 1580931
MAATAMIGITNLRCRHDPLSSLPRATSSAARSCTLLPPRCRRHSSCCSPSSSVSPCRARVRPTAALKRIPAADTGLHGSSQQ

SEQ ID NO: 92284 - DNA, 900 bp, Zea mays
  misc_feature: Ceres CLONE 1580932
gagctccccgcggtggcggccgctctagaactagtggatcccccgggctgcaggaattcgtctcacccctagaaaaaaaaggcagaacccagccgcggcgccctcttcgcagtcccaactcccaaccgagaggtgaaagcatccgtcccgtcccagtttcgccgccgaccctgcaaagcagaaggctctttgcgcgtcctcccctctttcctcccggactcgccggcgttcctgtctgttgctgccggtgggcggtggtggtacggctcatctcctttaccttttgatttgaaatcgttattgggatcctttttgggacttcaggcgttcgctattgggatcctttttggtacttcgggcgtttctctgtctcacagcgtcgtggggtttcgcgcttcttttggcggacacggggtcgattgacgattgaagctaagccacccgggttgcttggggatcctggcttggtgattggccgagttgactgaatcaggcgaaattgattccgatggaaggtctgcgacttagtcccctgtcggggcttggctttgcccgaatcccgaaccgttggccctttggcaagtatcttttggtaacctccttgccaaagggcccattccgaattgtcggcctaaagcattggccaaataattggtcccaatccctttggggttgggggggaaaccgggaaaatccccacaaattggaaaacaactttttttttcgccccgattttttttattctggaaaaacaaacccctggggatcttcccccaaaaacgggggggggggttattttgaaaaaaggggggaaaaaagggccccaatacccggggggcccaaaaggtttttctccaaaaaacacccccccgcgttgtgggaagaaaaaaaagcatcgtt

SEQ ID NO: 92285 - DNA, 857 bp, Zea mays
  misc_feature: Ceres CLONE 1580934
  misc_feature: Encodes the peptide sequence at SEQ ID NO. 92286
ctccccgcggtggcggccgctctagaactagtggatcccccgggctgcaggaattcgtctcacccctagaaaaaagcctgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgcctgtggggaggcggcgggtgtttgtgcagacggagaccggctgcgtgctcggcatggacctggaccgcggggaacacgcgcacaccgtcaagcgccggctgcagctcgcgctcaacatgcccacgggcgggactcgctcaccttcggggatcgcctcctggagacgaactgtccttcattaccccgggacttgccgctgctggtcacccggaaaagcatcaacgggagctgctccaccccggggcctctggcccggtctcaaggacttccaagcacaaggactgcagcggaactgtttgagatgctccggctgttccacaacctgtggcccgggtggaaacgccttctgtgaacaccggggtggacgggcatcagggagcggggtgggaatccggtccccaatt

SEQ ID NO: 92286 - protein, 173 aa, Zea mays
  misc_feature: Ceres CLONE 1580934
MSPNLDSAIKSQVPALLLRRLFGASRRDEAKQLQRTPAPVGRRRVFVQTETGCVLGMDLDRGEHAHTVKRRLQLALNMPTGGTRSPSGIASWRRTVLHYPGTCRCWSPGKASTGAAPPRGLWPGLKDFQAQGLQRNCLRCSGCSTTCGPGGNAFCEHRGGRASGSGVGIRSPI

SEQ ID NO: 92287 - DNA, 859 bp, Zea mays
  misc_feature: Ceres CLONE 1580939
  misc_feature: Translation starting site: 214
  misc_feature (674)..(674): n is a, c, t, g, unknown, or other
ctggagctccccgcggtggcggccgctctagaactagtggatcccccgggctgcaggaattcgtctcacccctagaaaaaagcagcaactctctccctctccgttcttggtggtccgagacccttggccgtacgctctgcctcactcctccgtctcttgcttcccttgccgccggcggcgcgcggcgccgggcgcggatcggcggcgggtgacatggtggaggccgccgccgggcgccggacaggcaccagccgtcggcggcctagcggcagcggaggggagcaccggcacctggtcgcgctcgccgtcgccgcgcgcgtcgccatggtcaccacccggtccgtgggtccagcagcagtagcggaaggtgatggagcgggagctgctgtaacagatgccggcgccgctggcggtggcggacgatgcatggaggacttcttcgactgcctcctcggcttgctcggcgcgttaggcatgacatgggctgcggcgcggccccagcggcagccgcgcccgccgctgcctcgcggggctgcgggggcggggcctgcgccaactgactcccggcgtttcgcggcggagctcaggtccaccccctggccggatcgccggcaatggcgcctgcgccgtcgcgtcactgtacacgctgcagggcaagaatggcgtcaaccagnatgctatgatcttctgggagaacttctgtttcagagatgatacatcctttttgtggtgggtttgacggcccatgcaccttatggccaatttggttgcaagaaaaagtagagatctgcctgctctaaaagttaggaaaaaagtttgacgacgggagaatggtaaaagtaaccatccactggcaaca

SEQ ID NO: 92288 - DNA, 844 bp, Zea mays
  misc_feature: Ceres CLONE 1580946
  misc_feature: Encodes the peptide sequence at SEQ ID NO. 92289
  misc_feature (844)..(844): n is a, c, t, g, unknown, or other
ctggagctccccgcggtggcggccgctctagaactagtggatcccccgggctgcttgaattcgtctcacccctagaaaaaacaaccaccgctagctagccctccacgtcttgaacctaggccggacaccagccagaacaggccatgtccatgggctccccggtgcagctcaggcggctgaagcctctgtaccagttcgtggtgaacaacatcctggccatcgtggccgtgccgctcgccaccgcggtcctgctcaaggcgtcgtcgctcgggcccgaggagatcctggcgctccggccggcgcacctgttcctggccgcgttcctgcctgccgcggccacggtgctgtacctgatgctccggccgcgcacggtgtacctggtggactacgcgtgcttccccaccagccccaactgccgcgtcccgttcgcgacgttcctggagcactcccgcgtgtggccgggcttcgacgagcgcagcgtccggttcatgacgcgcctgctggagcggtcggggctcggaggaagagacgtgcctgccgtacgcgcaccacttacatcccgcccgtcgccgcgaccctggaatcctccccgcagccgaggcccaagcttcgtcaatctttctcaggccattggacctacctggctcgccaaagaccggggggtcttcccccgcgggaacaatcaacctccctgggggggtgaacttgcagccctggttcgcgaccgaatcgccgttcctttccccggaaaattgggtccacgccacccggagtacagggcttccacccgggggaacgttgccacaaacgatgccacctctccgccggggaattgggggtggcn

SEQ ID NO: 92289 - protein, 233 aa, Zea mays
  misc_feature: Ceres CLONE 1580946
  misc_feature (69)..(204): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MSMGSPVQLRRLKPLYQFVVNNILAIVAVPLATAVLLKASSLGPEEILALRPAHLFLAAFLPAAATVLYLMLRPRTVYLVDYACFPTSPNCRVPFATFLEHSRVWPGFDERSVRFMTRLLERSGLGGRDVPAVRAPLTSRPSPRPWNPPRSRGPSFVNLSQAIGPTWLAKDRGVFPRGNNQPPWGGELAALVRDRIAVPFPGKLGPRHPEYRASTRGNVATNDATSPPGNWGW

SEQ ID NO: 92290 - DNA, 861 bp, Zea mays
  misc_feature: Ceres CLONE 1580947
  misc_feature: Encodes the peptide sequence at SEQ ID NO. 92291
ggagctccccgcggtggcggccgctctagaactagtggatcccccgggctgcaggaattcgtctcacccctagaaaaaagccaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggagtccggcgaggccgcccacgcctgcggctgcggtagcagctgcaggtgcgacccctgcaactgctgatcacatcgatcgacgaccatggatatgattattatctatctagcttgtggtggtggttgaacaataataagcgaggccgagctggctgccatacataggtattgtgtggtgtgtgagagagagagagaaacagagttcttcagtttgctatctctctctctgcaatgttggcgtcagtctttgtgctcatggacgtgtgtccacatgcatgttggttgaccccaatgcgtctgctgaaccataaattaatgggcccccaagaattgattggaacccttttttttttttttttccttggggggggggactcgagaaaaaaaaaaaaaaaaaaaattgggggggggggcccccccaaaaaaaaaaaaaaattttcccccaaacccttcgggaaaaaaaaaaggggttcccccacaaagagggggaaaaaatattttcccccccccgggaaacaaaaaaaaaaagtgggggggggggcacg

SEQ ID NO: 92291 - protein, 76 aa, Zea mays
  misc_feature: Ceres CLONE 1580947
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAAESGEAAHACGCGSSCRCDPCNC

SEQ ID NO: 92292 - DNA, 875 bp, Zea mays
  misc_feature: Ceres CLONE 1580948
  misc_feature: Encodes the peptide sequence at SEQ ID NO. 92293
ggagctccccgcggtggcggccgctctagaactagtggatcccccgggctgcaggaattcgtctcaccccctagaaaaaaaaaaagcttgcaaggcgccaaggacggacggaggcgacgactcgcaaggtagctctgctcgggcgaggcagcagcagcacgcagcagtactccgttcagaatcaggagagaagacgttgttctccgggcactcgagtcgaagtcctgacgagatggacggcaatgcgaggtcggcggcaacgaatcagaagaagcccgtcgtcgcggacgacgacctcgtggagctgctgtggcacaacgggagcgtcgtcgcgcagccccaggcgcaccagaggccggcgcccacctacgaccccgaccgcccgggcaccagcggcctcaccggcgaagagaccgccgcgtggttcccggacaccctcgacgacgcgctggagaaggacctgtacacgcagctctggtacagcaccatcgccgacgccgccccgcagcacgagggaacgctcccggggcctacctcgcagcctttcgccttcgccgcccgttgggagcagcgggcgtcaagtccaactgggctggggaaatttgggtcaactttctgggaaagcaacaagggttcaggaccccggcaaggatacggggaaaaggacccggaatttccctcgggaattgccaaaaaaatacgggggggcaaaaaggggaattttttttcgggggggggttggggaaaaaaatatgggggggacccggggggccccccaagagaaccggcccccttttttaaaaaaaaaaaggggggggggtgttaaaaaacaccccaaaaaattcccccgggggagaagacccccccgggggagg

SEQ ID NO: 92293 - protein, 197 aa, Zea mays
  misc_feature: Ceres CLONE 1580948
MDGNARSAATNQKKPVVADDDLVELLWHNGSVVAQPQAHQRPAPTYDPDRPGTSGLTGEETAAWFPDTLDDALEKDLYTQLWYSTIADAAPQHEGTLPGPTSQPFAFAARWEQRASSPTGLGKFGSTFWESNKGSGPRQGYGEKDPEFPSGIAKKIRGGKKGNFFSGGGWGKKYGGDPGGPPREPAPFFKKKKGGGC

SEQ ID NO: 92294 - DNA, 841 bp, Zea mays
  misc_feature: Ceres CLONE 1580950
  misc_feature: Encodes the peptide sequence at SEQ ID NO. 92295
  misc_feature (671)..(671): n is a, c, t, g, unknown, or other
  misc_feature (718)..(718): n is a, c, t, g, unknown, or other
aaagctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctggcagtacccggcgaagaccttcttncacgacgtcggcctcggcggcatcggctacgaggtcacccgctaccntctacgcacctgcaaggacctcagttcccccaacttcgcatcaagacggcgccaaccaggaagtggaagaagtccggactttcatcgggaaactgcctgttcccccaacaagaaacgggccgc

SEQ ID NO: 92295 - protein, 194 aa, Zea mays
  misc_feature: Ceres CLONE 1580950
  misc_feature (138)..(138): Xaa is any aa, unknown, or other
  misc_feature (154)..(154): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSWQYPAKTFXHDVGLGGIGYEVTRYXLRTCKDLSSPNFASRRRQPGSGRSPDFHRETACSPNKKRA

SEQ ID NO: 92296 - DNA, 867 bp, Zea mays
  misc_feature: Ceres CLONE 1580953
  misc_feature: Encodes the peptide sequence at SEQ ID NO. 92297
agctccccgcggtggcggccgctctagaactagtggatcccccgggctgcaggaattcgtctcacccctagaaaaaacagctcactcgcaaccactcaccaagctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgaggggcggcgtgcgcgccgccgacgccgaccgcgacggcggcgtgcagctgggggaggacgaggtggcccgcctcttcgccttcgcgcagagccacctccgcgtcaagatcgcccagctcgggtactactagtactgctgatccgtcgtcggccgatcgatcggccaatatggaggcatggagcatatggcatcgatcgatgggtttgtcactactcgatcgtcacttgtttgcacagctgggtgggtgggaatgtgttgttgctacttttttttctctccgtcccggtgggatgtggtggtgtacttatggtaccgaatggctggtttgcccaaaacctttggacccaaaaaaaaaaaaaaaaaaaaaaaaaagggccggggccttttccccttgcccatttaaaagcccctttgtttgaaaaaaagaaaaaaactcggccttttatttttgtcaccatgggcccccccccccgcgttaaccccccaaagaatctcttttggggggcccccggttcccggcgccaaaac

SEQ ID NO: 92297 - protein, 98 aa, Zea mays
  misc_feature: Ceres CLONE 1580953
  misc_feature (18)..(46): Pfam Name: efhand Pfam Description: EF hand
MAFMRYRALPRGELTAEEFRAWLAQFDADSDGRISREELRHALRSLNVRFAWWKARGGVRAADADRDGGVQLGEDEVARLFAFAQSHLRVKIAQLGYY

SEQ ID NO: 92298 - DNA, 846 bp, Zea mays
  misc_feature: Ceres CLONE 1580954
  misc_feature: Encodes the peptide sequence at SEQ ID NO. 92299
  misc_feature (546)..(546): n is a, c, t, g, unknown, or other
  misc_feature (755)..(755): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
ggagctccccgcggtggcggccgctctagaactagtggatcccccgggctgcaggaattcgtctcacccctagaaaaaaggactaggagtccagtagcctgctagctatctatcagtgatccctcgcgaacgatgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaggccaggcgggcggtggccgggctcaaagatgcgctcgtggaggctcaccagctcatcacatcctgccagaggagggggctcacgtcccagctgttctcggcgtccaggcaggccgacaggttcagggacgtcgagcgcaagatcgaaacctgcgtgtccatcatccctgtcatcggctacatcggcataacaagacgcctcgatggttcgcaatcccagtcccagctgtcngccggaggggctgaagatccggagttcacgctggccgagaatcgcgtgggccacaacaacttcggcggtcgtgctcaagcacgacgccgaacctgggcacaaggtataccagggaaggctcctgcaaaacgggcctggaagtggccgttcagcgccttaaaccgcccgccggggggaaacggaagaaccccttctttcggggaacaagnaattcttttggcggttcggccaagaacggaatttgttccgcttcctggggcaaccgtagctaagnnnnnnnnnnnnnnnnnnnnnnnnnnc

SEQ ID NO: 92299 - protein, 229 aa, Zea mays
  misc_feature: Ceres CLONE 1580954
  misc_feature (208)..(208): Xaa is any aa, unknown, or other
MWDGLESAATVAQLVGLDVGGLITMIGQAARKARQNTKDCEHLARRVGMLAELVPHLQDPEARRAVAGLKDALVEAHQLITSCQRRGLTSQLFSASRQADRFRDVERKIETCVSIIPVIGYIGITRRLDGSQSQSQLSAGGAEDPEFTLAENRVGHNNFGGRAQARRRTWAQGIPGKAPAKRAWKWPFSALNRPPGGNGRTPSFGEQXILLAVRPRTEFVPLPGATVAK

SEQ ID NO: 92300 - DNA, 886 bp, Zea mays
  misc_feature: Ceres CLONE 1580962
  misc_feature: Encodes the peptide sequence at SEQ ID NO. 92301
  misc_feature (424)..(424): n is a, c, t, g, unknown, or other
  misc_feature (442)..(442): n is a, c, t, g, unknown, or other
  misc_feature (443)..(443): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (463)..(463): n is a, c, t, g, unknown, or other
  misc_feature (762)..(762): n is a, c, t, g, unknown, or other
  misc_feature (763)..(763): n is a, c, t, g, unknown, or other
tggagctccccgcggtggcggccgctctagaactagtggatcccccgggctgcaggaattcgtctcacccctagaaaaaaacgcggcgtggtatcgctttcgcgtctgcgtgcgtgcgtgtgcaggcaggcaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagatctctttcgaacgcaaggctgcaattgagtacattcattctttatcaagggcacagcctgctcgttctctcaatggtgctggcctttgtcctgctagtagatcacttagcacccaggnccgcactacgtcaagcannacannnagctcggctccccnaccccctccagagaagactcactttggtggccttcaaagacaaggatcgcattttccccaacctctatgggctgaatgaacctttttctaaaaggcccaattaaaaaaaggtaactggggttagaacccaggattttggggtttcaaggggggcaaaccggatattttaataaaaaaaaaaaaaaacaggtccttcgggccctagaaagaacaaattttttcctttttggggcaaaaaggggcttttttcccccaggggtttaaaagagaccgcccccttttattggggggaaaaaaannaaaaaaaaagaagcccccctcccttcaaaaaaaaaaaaaaattccccgccccccccccccccccctctttgagggggagaattttttgtgtgtgggaaggaagagagggcccccccctctctt

SEQ ID NO: 92301 - protein, 90 aa, Zea mays
  misc_feature: Ceres CLONE 1580962
  misc_feature (52)..(52): Xaa is any aa, unknown, or other
  misc_feature (58)..(58): Xaa is any aa, unknown, or other
  misc_feature (60)..(60): Xaa is any aa, unknown, or other
  misc_feature (65)..(65): Xaa is any aa, unknown, or other
MALRRALLRSAEISFERKAAIEYIHSLSRAQPARSLNGAGLCPASRSLSTQXRTTSSXTXSSAPXPPPEKTHFGGLQRQGSHFPQPLWAE

SEQ ID NO: 92302 - DNA, 1312 bp, Zea mays
  misc_feature: Ceres CLONE 1580963
  misc_feature (17)..(17): n is a, c, t, g, unknown, or other
  misc_feature (18)..(18): n is a, c, t, g, unknown, or other
  misc_feature (798)..(798): n is a, c, t, g, unknown, or other
  misc_feature (926)..(926): n is a, c, t, g, unknown, or other
  misc_feature (1023)..(1023): n is a, c, t, g, unknown, or other
ggttggtgggggggggnnttattttgggttttatacctttaattttttgtccattgagcggggggggggttccaagctggagctccccgcggtggcggccgctctagaactagtggatcccccgggctgcatgaattcgtctcacccctagaaaaagcaaaaatcacagcggcaggggacagcaaaaatctccatgcccacgctgcggcctagatctccggcgagccggccccgcgcggtagccgattcactctccgacccccacccgatgggggggcgaagtgccccgagcccccccggggtgaaccgcctccctcaaattttggctgggggggggttccccaagaaagagagggatccccctcgtgttgggtgtctgtggaaaaaccccccccaccgggagaggggccctccctccggtgtgccgcccccgggggaccctaatataaaaaaacccccccgaggaaaaaaaacacaccccgcggaggggtgtgtgttatccccccctaaaaaacaaccccgggtgtgtatggtaacaaaagataaacagcgggggggcgagatgggtttcttcccccctcccaggtagaagagagcccccccctctccccccacggtaaagagggggcgccagctcaccacaaaaaagaaaaacttggggggttatcatggtgggggcgggccgctccgttggtaatccaccaaataaaattatccaaagtgcttccccctcgcaccaagaacagagacatcctcacgaaaaaggagggcatccctcccgtgtgtgggtcgatatgncgtaataagaacacattattagctccgcggttggagggtgatgggttaaagatctcttttcgttgtcgctgtgtctcgacgctcaacaggctgatccgtacgggaggcgggagcgagggtaaaagtgnggtatgtattatacaaaaataaatattcaactatcacttcctctcgcctcccaacatcaaagagatgttagtgtggcgagagtgacttgatatatanatagtgaagaagagagaggcatggacgcctgcatgtaagagacttgtatacactcgcgctaggtcacatctgacagaggagggaattgaatcgattgaatcaaaatataagatatcttctctctcctgcccattatagaagaagaaacagaaaaaacctgaatgtgtattatatctctgaactattgaaatattaatataacgaaaacatacctgttcccccatattataaacaaacgccccgcgcgcgcgccacgagaaagctttagctcgcctcagcgccaagtcgg

SEQ ID NO: 92303 - DNA, 861 bp, Zea mays
  misc_feature: Ceres CLONE 1580964
  misc_feature: Encodes the peptide sequence at SEQ ID NO. 92304
tccccgcggtggcggccgctctagaactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggaccaaggagttcatggaagcccttgctgccggcgctgatgtgtccatgattggccagttcggcgtcggtttctactctgcctacctcgtcgccgatagagttgtcgtgaccaccaagcatcacgatgacgagcagtacgtgtgggagtcccaagcgggcgggtcgttcactggtactcgtgacacctcaggggagcagcttggcagggggacctaaatcacactgtttcctcaaggacgatcagcctggagtaccttgaggagcgtccccctcaagggatttgggtcaaaaacccttctaagttcatcagcttcccccatcccccctgggggactggaaaagacaaccaaagaagaaaatttcttgacccaccaaaaaaccaggaaaaaacaaaaaaaaaatccttaaggaaag

SEQ ID NO: 92304 - protein, 173 aa, Zea mays
  misc_feature: Ceres CLONE 1580964
  misc_feature (28)..(152): Pfam Name: HATPase_c Pfam Description: Histidine kinase-, DNA gyrase B-, and HSP90-like ATPase
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHHDDEQYVWESQAGGSFTGTRDTSGEQLGRGT

SEQ ID NO: 92305 - DNA, 885 bp, Zea mays
  misc_feature: Ceres CLONE 1580965
  misc_feature: Encodes the peptide sequence at SEQ ID NO. 92306
  misc_feature (885)..(885): n is a, c, t, g, unknown, or other
aaagctggagctccccgcggtggcggccgctctagaactagtggatcccccgggctgcaggaattcgtctcacccctagaaaacatttgtgtatagcttttgagatgcttggccaaaacctatatgaactgctcaaaaggaatcacttaagaggtctgaaattgaaatatgttcaagccttctcaaaacagatattggatgccatggttgtgatgagagaagctggaatcatccattgtgatttgaagccagaaaatatcctgttagctcccagtgtcacaacagctgcagaagtgaaagttattgattttggatcagcctgcctggagggtaaaacggtttactcgtacatccagagccgctattacaggtctccagaggttctccttggctatccatatactaccgcgatcgacatgtggtcgtttggctgcatagttgctgaactgtttctaggtttgccattgtttcctggagcgtcagaatatgatgtgcttcagcgaatgatgaaaattcttgggggccaaccaccagatgaactgctaagggaagctaaaaacactgcaaggttttttaaacatgttggaagtatctatcctggcaatgaggcacctactggtctttgtagtgcgtacaaaagtttaagtgaagaagatgttgaagtgagagactccaagaagccacagatgggaaagtggtacttcccacacctaaagcttgacaaactcatatgtacctatccttggaacaattccgaactgacagagacagaaaaatggatcgtttgggattagttgatttcttgaagggtctccttgaatttgatcccaaatagagatggtcaccattgcaggctctataccatccattcataacaggcaaatn

SEQ ID NO: 92306 - protein, 229 aa, Zea mays
  misc_feature: Ceres CLONE 1580965
  misc_feature (1)..(160): Pfam Name: Pkinase Pfam Description: Protein kinase domain
  misc_feature: SWISSPROT Homolog: EC 2.7.12.1 Dual-specificity kinase
MLGQNLYELLKRNHLRGLKLKYVQAFSKQILDAMVVMREAGIIHCDLKPENILLAPSVTTAAEVKVIDFGSACLEGKTVYSYIQSRYYRSPEVLLGYPYTTAIDMWSFGCIVAELFLGLPLFPGASEYDVLQRMMKILGGQPPDELLREAKNTARFFKHVGSIYPGNEAPTGLCSAYKSLSEEDVEVRDSKKPQMGKWYFPHLKLDKLICTYPWNNSELTETEKWIVWD

SEQ ID NO: 92307 - DNA, 1029 bp, Zea mays
  misc_feature: Ceres CLONE 1580974
  misc_feature: Encodes the peptide sequence at SEQ ID NO. 92308
  misc_feature (21)..(21): n is a, c, t, g, unknown, or other
  misc_feature (28)..(28): n is a, c, t, g, unknown, or other
  misc_feature (51)..(51): n is a, c, t, g, unknown, or other
  misc_feature (52)..(52): n is a, c, t, g, unknown, or other
  misc_feature (59)..(59): n is a, c, t, g, unknown, or other
tgttgggggggggggggggtngatcttnattttggggggtgggtgggttgnnccacccnggggggggggttggtcaaaactggagctccccgcggtggcggccgctttgaactagtggatcccccgggctgttttgattcgtctcacccctagaaaaaatagaaaaatccggagaactgagaaagcccactcgttagtcgttactcccaacaccgggaatccatggagccggcctatgtcgtcaccctctccttcctcttcctcttcttgctccaccatctcctcggccgccaccgccgcaggaccaacggcaagaacaagagaacgcagctgccaccgagccctcccgccatcccggtcttgggtcacctccacctcttacggaagcctatccacgcggcgctcgctcgcctcgcggagcgctacgggccggtgttcttcctccggctcggctcgcggcaagccgtggtggtgtcatccgcggcttgcgccacggagtgcttcaccgagaatgacgtctgcttcgcgaaccgcccgcggttccccacgctcctgctggtttccttcggcggcgccacgctcccaatgtggccgctacggcccggtacgggcgcaaccctccgccgcggtcgccacgggtgcaggctcctggtccgcgcaccgcggtcagcttgccatgcctcccccgtcaatatcccgcccgagggtggcgcggcaaatgggccgcgcggagggaatggtacccaaattccggcccgagcgtcccgccccccggcccgggggcccggcgaaggggtccgaagccttgaaacccgggagggcttgttcccaagcttcttccccaaaaacggcccctggaagtggaagaaccatttcgtgggcggaaaacaaaagacattcccccgttgcccctggggccgggaacaatcgaacccgggaacaatgtctctcgcggggagggcgcccaggaaattttcatgggaagaggccccttgggaaccggtgttccaatttccgccttattctaaa

SEQ ID NO: 92308 - protein, 269 aa, Zea mays
  misc_feature: Ceres CLONE 1580974
  misc_feature: SWISSPROT Homolog: EC 1.14.13.89 Isoflavone 2'-hydroxylase
MEPAYVVTLSFLFLFLLHHLLGRHRRRTNGKNKRTQLPPSPPAIPVLGHLHLLRKPIHAALARLAERYGPVFFLRLGSRQAVVVSSAACATECFTENDVCFANRPRFPTLLLVSFGGATLPMWPLRPGTGATLRRGRHGCRLLVRAPRSACHASPVNIPPEGGAANGPRGGNGTQIPARASRPPARGPGEGVRSLETREGLFPSFFPKNGPWKWKNHFVGGKQKTFPRCPWGREQSNPGTMSLAGRAPRKFSWEEAPWEPVFQFPPYSK

SEQ ID NO: 92309 - DNA, 842 bp, Zea mays
  misc_feature: Ceres CLONE 1580975
  misc_feature: Encodes the peptide sequence at SEQ ID NO. 92310
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
ctggagctccccgcggtggcggccgctctagaactagtggatcccccgggctgcaggaattcgtctcacccctagaaaaagacagcatcactgccgtgtagtgtagctagagcccctgcactggtccggattcgcagagcaaaacggaaatgatcactgtggcagcaccggaggcgcagccgcaggtggcggcggcggcggttgcggcgccggaggagaccgtgttccggtcgaagctgccggacatcgacatccccacccacctgccgctccacgactactgcttctcgagggcggcggaggccgcgggcgcgccgtgcctcatcgcggcggccacggggaggacctacacgtacgccgagacgcgcctcctgtgccgcaaggccgcggcgtgcctccacgggctcggcgtcgcccagggcgaccgcgtcatgctcctgctccagaactccgtcgagttcgtgctcgccttcttcggcgcgtccttcctcggcgccgtcaccacagccgccaacccgttctgcacgccgcaggagatccacaagcaattcagcgcctccggcgcgaaggtcgtcgtcacccactccgcctacgtcgccagctccgcacgacccttccgagatcgggtggacggcaatgctcgcctagaccacagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 92310 - protein, 170 aa, Zea mays
  misc_feature: Ceres CLONE 1580975
  misc_feature: SWISSPROT Homolog: EC 6.2.1.12 4-coumarate--CoA ligase
MITVAAPEAQPQVAAAAVAAPEETVFRSKLPDIDIPTHLPLHDYCFSRAAEAAGAPCLIAAATGRTYTYAETRLLCRKAAACLHGLGVAQGDRVMLLLQNSVEFVLAFFGASFLGAVTTAANPFCTPQEIHKQFSASGAKVVVTHSAYVASSARPFRDRVDGNARLDHSV

SEQ ID NO: 92311 - DNA, 930 bp, Zea mays
  misc_feature: Ceres CLONE 1580976
  misc_feature: Encodes the peptide sequence at SEQ ID NO. 92312
  misc_feature (396)..(396): n is a, c, t, g, unknown, or other
  misc_feature (620)..(620): n is a, c, t, g, unknown, or other
ctccccgcggtggcggccgctctagaactagtggatcccccgggctgcaggaattcgtctcacccctagaaaaagtctcggtttacaaagcctccgccgccgcaagtccactccacccgttgtccaggttagttggttggtttcaatttcgagttcgccgagcgacagcttgcgcctgccatttctcggctccgcgtgccggagctcgttcatctccagcttctccggccgttactcgctctgaaccgacgacagtaccgataaagccccgactcgccatcctccggcgacgatgccttcccgatcggattccgactccctgctggtgcgcgccgagggcatgcgcgacgcggcgttggactaccgcggccaccccgccgatcgcggcgccaccgncggcttggagtcggcgctcttcatcatagcgtgggagatcgcggagcgcttcacgtttctagggcgtgttcggcgaacctgaatcaacttcccggacggggcccgccccggggaggggcaccctcggccgccgggcggcggcccatcaacgccctggaaacggggtgggggccaacctgctgccccctgcctggggcggtggccctttggcgggaaaaatgggnttcgggccggctaacgcccacccctgcttcattggccttcgctgcctctaaaatccctcggggttcgggggtatgttggggcctcttttataacctttccccctccctccggggagagcggccaacccttggcaacccccccccgggggggggcagaattctggtgcccccgtcccgggcccttaagagggaaccttcctttctaggttcttcccctcttaattcctgggcccgtggggcccaaggggcgggccacacaagcccgggggcgttccaggggcggttccgggcggccccaaccccgtttctg

SEQ ID NO: 92312 - protein, 61 aa, Zea mays
  misc_feature: Ceres CLONE 1580976
  misc_feature (35)..(35): Xaa is any aa, unknown, or other
MPSRSDSDSLLVRAEGMRDAALDYRGHPADRGATXGLESALFIIAWEIAERFTFLGRVRRT

SEQ ID NO: 92313 - DNA, 926 bp, Zea mays
  misc_feature: Ceres CLONE 1580978
ccccgcggtggcggccgctctagaactagtggatcccccgggctgcaggaattcgtctcacccctagaaaaagactctcctctctctctctctctctctctctctctctctctgagctgctctcggtttaggtcgaggagttgctagctagctagggggtttggatccccgctggcgctgagctgctccgctgctgcgtgctagtccttctacagacacccagccccagctaatcacgcaagcatagatagaggctggggtgggcagggaggtgctccgaccgagatccctcacatcagaatcagatcacatcatcggccctcggatgcgatgcaccaccggcgaaagcccgcttccgccgcggcccctccggccgcctagtagccggccccccacaagcccacggagcggctgtcgatcgagtggctcctcgtctccatcttcctcgtagccaccttcctgttacacgaggaagtgggtgaaagcggtcctcccgctcctcccgcttcagcgaaaaacaagtcgaatgcctccttgagtggaaggcgttctcccggggcggggcagaggtccaccccaacccctaagggcggcctgccagagagggagggcaccctccccgggggtcggatagcccgcatataaccgggggaaggtttggataatttctcccaggaaagggggatgccccatagcatgaaacccccctggaccccccccctaataccccattccccctttagtggcgacttgtgtcggaagaaagaaaacacctggggaaaagtacaaaaccggctgagggcgaaagcccgcggacacccccggggggggggtgggttaaaccccgaagttttgtgggaaacccgtctgcggatctgtttgacaaaaagttttccggggtggcgaccgagtatcgggggtggagg

SEQ ID NO: 92314 - DNA, 1252 bp, Zea mays
  misc_feature: Ceres CLONE 1580979
  misc_feature: Encodes the peptide sequence at SEQ ID NO. 92315
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (68)..(68): n is a, c, t, g, unknown, or other
  misc_feature (72)..(72): n is a, c, t, g, unknown, or other
  misc_feature (73)..(73): n is a, c, t, g, unknown, or other
tggtgttgtgtnnnnnnctccctctacctacaggggggagagggttcttcattactctgttcgagaangagnntataagggggggcaaaactggagctccccgcggtggcggccgtctctagaactagtggatcccccgggctgctggaattcgtctcacccctagaaaaagttgtgttgccaaagttatcgttagtcttctctatcgacggcgaggcttgagcgctcacgtccaaggcgttcccgtgccggtggccaagccagcaaccaacgagatggactacctcaggacggtggttcctgtcacaactcttggtagagcgcggctccaatcttgtcggcatcaacccaggatcgggaaatgtgcgaatggtgtttgctagtcagaatgtgccaatcattataccatattgcattgcccgacacatcaatccacaagaggtcgatagaaccaagattcttcttggcggcgatctgtatgctacaacgtgccatggccccccccaccccaaatttgcaaaaagaagggaagaacggcattatgcaatatgtttgtggtctagcacagaatgtaaaaaagcgccgtttttttggaaccgtatttattgaaaaatgcccctttccaaccaatataccataactcctcttttccattaacaaatataaatggggaaatacatagtgttcggaatgaggccattttctcttctgtctccccccagcgcatacaaacccgagcgagggaagcgttaaatgaggtttcggtatgattgtctgcatgcagattgggggggagaatagtaaaatttgaggttgctttccgaggatagaataataacatattttaaattgtgagtaatactcgcacctttactgtagatgaatccgtgtgtcatagcgattattatgagtgttgtcactaggtgtgttggaacgcctatgggggattttacccacgatatattatattaatatgaattttaacatggcctggtcacctactataaggatccggcagaacggcggaaagagcaattcaacaacacaatagggtgtgtacagtgtgtactcccttgtgttattatgtatacaatctatagactagtcaattcgacaaggtgacaggttaggattatgattctgtggggagcttaaaggagaaatgctccttctgcgtagcaggtcgccccccatcctccgatatcaatgagagacacgtgaaacaatggcatatacatatgtttctcccatc

SEQ ID NO: 92315 - protein, 79 aa, Zea mays
  misc_feature: Ceres CLONE 1580979
MVFASQNVPIIIPYCIARHINPQEVDRTKILLGGDLYATTCHGPPHPKFAKRREERHYAICLWSSTECKKAPFFWNRIY

SEQ ID NO: 92316 - DNA, 819 bp, Zea mays
  misc_feature: Ceres CLONE 1580980
  misc_feature: Translation starting site: 222
ctccccgcggtggcggccgctctagaactagtggatcccccgggctgcaggaattcgtctcacccctagaaaaatctcccttcggttccccaattcgaaatcgaatcgggtcggtcttgccgtgcgtgcgtggctgcgcgagcgactcgactgcaccccccgctcctcccagtccccacacactgcgcgccgccgccgggtcctcctagggtttcgccgcgatgtcgctccggccgagcgagcgggagcagatgcggaagggcaactacaagcagacggtggacgcggaggagagccgccgccgccgcgagggccagatggtggacatccgcaaggccaagcgcgaggaaagcctccagaagaagcgccgcgatgggtttcccgcctccgccgctggtgtgccgccgatgggccactccaccgcgctccagcagaagctcgatggcttgccggcgatggtgcaggccgtccactccaacgacccctccgtgcagcttgaggccaccacacagttcaggaagctgctttctatagaacgtagtcccccaatcgaagaggtgatcagcacaggagtggtgccgcgattcattgagtttcttacacgtgaggaccatccccaactccagtttgaggctgcatgggcactcaccaacattgcatcaggcacatcagagaacactaaggtgggtggttgaaaagtggtgctgtgcccatctttgtcaagctactcaactccctcagcgaggatgtccgtgaacaggctgtatgggctttaggtaatgttgctggtgactccccaagtgtcgtgatctggtactt

SEQ ID NO: 92317 - DNA, 835 bp, Zea mays
  misc_feature: Ceres CLONE 1580985
  misc_feature: Encodes the peptide sequence at SEQ ID NO. 92318
tccccgcggtggcggccgctctagaactagtggatcccccgggctgcaggaattcgtctcacccctagaaaaaaggcttcccttcagcaaacagcctggtacttctattcagccgcttaccgcgcgctctcttgtgcggcaattgggcgaccgccgccgccctaactcaggtgccgaggtcttcgccagtaacttcaacaggtcctcgcctggtccttctctggcgaggagcatctccgccagactttctgctggctcaggtgcgaatcatggggaagtttatgcgtgacaatccaatgctatcatgtagtgaagtaaacagacatcactatagtcttgcggcagttgctgtcggtttgggactaggagttgccgggttatgcaaggcattgtatagcggtctgtccataccatgggtttctccaaggaatttgttttcgggatcagggagggcatactatgttggaggtctgcgaaatcttggcaacaattgctttcttaatgtcatcctccaggcacttgccagctgtgatggttttatttcctttctagataatttgcttgcaactgatggcttgctacctgaagaaaaggctgtaagaatgcctcttcttcttgctttaagttccctcttggaagacttaagcatagttccgagatgaaaggactgttgttgaatcccccctggaagtaatgccaggcctttgaagtttggtatggttggtcaaccttcaattccgaaccagaaccggcggggatggctttcaaaaaaacttttttcccccaatctttccgggaatcttccttggaagggggaaggaaattttggccccca

SEQ ID NO: 92318 - protein, 130 aa, Zea mays
  misc_feature: Ceres CLONE 1580985
  misc_feature: SWISSPROT Homolog: EC 3.1.2.15 Ubiquitin thiolesterase
MGKFMRDNPMLSCSEVNRHHYSLAAVAVGLGLGVAGLCKALYSGLSIPWVSPRNLFSGSGRAYYVGGLRNLGNNCFLNVILQALASCDGFISFLDNLLATDGLLPEEKAVRMPLLLALSSLLEDLSIVPR

SEQ ID NO: 92319 - DNA, 899 bp, Zea mays
  misc_feature: Ceres CLONE 1580989
ggagctcaccgcggtggcggccgctctagaactagtggatcccccgggctgcaggaattcgtctcacccctagaaaaaacggttgctcacccttgtgcggtcctttggttggtccacactttttctccgccccccaaaccacatcgattattgcgttgagcgcttagactcttgttgtctttgtttttgtgctcagcgagcatggaggatgccgacgcagttcacgggctctgattggcggatggcgcgtcagatcggagcagtccagcttcagggatttcctgtccctctgaaagggatgaaatgcggcgactacctggtgaactgggtggagctctagtgtcagccagtgttcctgctgacgcctgcctcatctagccccctcccttcgttgagttcttgtggcgagttgttaatccaccgtgtctcgggatccgtttggcctgaggggttgaggagatggacgacaaggactgctcgtgggtgcggggacacaaggtttatggggtctgtcgtcagatccagctctgggagggagccgtagggtgcgttccttaagcagttcggccggggcgccaaattaaagaataatgggttggggcccaggttaaaggaaaccctgcccaaatttaaagcccttgggaaagggaagggggggttcccactccgggggggtgcgcatttcccaggggaaattccccaattttccttcttccgaaaggaatcttgaaccccgcgtttttcttgaggggcccctttaaaaaaaaaagggggttctcccaccttggtaaagaaaatttcccttaaaaacaaaacccccaaaggggggggcctcccggcggggggtctgggtatatttctcgtcaatacgtgtggggtgtgccccgcatataacaaag

SEQ ID NO: 92320 - DNA, 923 bp, Zea mays
  misc_feature: Ceres CLONE 1580991
  misc_feature: Encodes the peptide sequence at SEQ ID NO. 92321
  misc_feature (326)..(326): n is a, c, t, g, unknown, or other
  misc_feature (442)..(442): n is a, c, t, g, unknown, or other
ctccccgcggtggcggccgctctagaactagtggatcccccgggctgcaggaattcgtctcacccctagaaaaagcttctgctcctgctacttgccccctcttatcagagagagtggtgtggtggcgcctccccaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcggaatgcccgtggaaggaggggagagagggagggcgcangcgcagctgagctgagctgagcccgcgaggttcgcggtctgcggtgcggcggcagaggtctcgccagcgcgatggccagcggcggctcctccaggtacagctcgtacaaggcgccngggctgcgcggcgcgctgctgggagcggcgcacgtgtcgtgcctcgaggaccggtacgcgctgggcccgcaactggggtggggccaagttccggcggaatccggtccttgctccaacctggttcaccggcgaaggggcttggccctgcaagtcccatcgcccaaggggccgggctcgtggttccccccaaacaaccttgccccgggggtcaaggcctggaaaaaatcaacctcattgggccccgccctggcggggggcaacccccaagattcttggggggttccaaaggcccggtgtaccaaagaaccccgcgaactccgggggcaccctcgttcatgggaaactctctggcggccgcgggggggcaaaatattttttccacccggctctcccaaaaaagccgggggtgtggctttctccccaaaaaggaagaggggccctcacgggttttttttccgccaaccctcccagggggagggtg

SEQ ID NO: 92321 - protein, 175 aa, Zea mays
  misc_feature: Ceres CLONE 1580991
MASGGSSRYSSYKAPGLRGALLGAAHVSCLEDRYALGPQLGWGQVPAESGPCSNLVHRRRGLALQVPSPKGPGSWFPPNNLAPGVKAWKKSTSLGPALAGGNPQDSWGVPKARCTKEPRELRGHPRSWETLWRPRGGKIFFPPGSPKKAGGVAFSPKRKRGPHGFFFRQPSQGEG

SEQ ID NO: 92322 - DNA, 1128 bp, Zea mays
  misc_feature: Ceres CLONE 1580994
  misc_feature: Encodes the peptide sequence at SEQ ID NO. 92323
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (813)..(813): n is a, c, t, g, unknown, or other
  misc_feature (909)..(909): n is a, c, t, g, unknown, or other
  misc_feature (950)..(950): n is a, c, t, g, unknown, or other
nnncccccccccccccttacgatagtaatgtgagggggaggggagtagaggggggttggttatggctttttgtgaaagctgggactccaccgcgtggcggccgctctagactagtggatcccccgggctgctggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcggtcggctacatggtccgaacccatgggccagcgagaaagaaccctatctcgtgcacagcaccccatgcaagtatcaaggtccgcctaacttactctggcgaaactaacattcataacgggggggcaaagggccaaggcaatccggggaatgccaggcttcagtcaaaaccgaggcgggcttcccggaacatttccttcacatatctgcccccgtgcttttcaacccagtgggaggggctctctcaataccaaaaccccccgaatgggttatctatactccgcccggcggagtgttccaggaaataccccccanttaggcgcgcgtttcacacagaaacacctcccccaaaggggccggccccaccgtaggattatcgcccaaggcgccccttggagcacctcaaagggngcaaccggtttcgcccaccggaaaccgaagaaaattggacnggggtggagacaagtgtgtacaagcagagcgagggcgttttagcggcccactgcggatatagtagaggcacggtaaccccccgtgtttacatgtggaagttgaggggagccacccccatggattaatggcacccggggtcgggcgtggccttctctccgggtgaacatctggtttgcg

SEQ ID NO: 92323 - protein, 213 aa, Zea mays
  misc_feature: Ceres CLONE 1580994
  misc_feature (196)..(196): Xaa is any aa, unknown, or other
MAVALLAALVASAAMLAGTASASPAEGIQPLSKIAVHRATVEMQPSAYVRATPSLLGEQGEDTEWVTVKFGWKEPSEDDWIGVFSPSEFNSVGYMVRTHGPARKNPISCTAPHASIKVRLTYSGETNIHNGGAKGQGNPGNARLQSKPRRASRNISFTYLPPCFSTQWEGLSQYQNPPNGLSILRPAECSRKYPPXRRAFHTETPPPKGPAPP

SEQ ID NO: 92324 - DNA, 769 bp, Zea mays
  misc_feature: Ceres CLONE 1580995
  misc_feature: Translation starting site: 449
ggagctccccgcggtggcggccgctctagaactagtggatcccccgggctgcaggaattcgtctcacccctagaaaaatcccgcatcgcgcatcgcatccaccgccgagcttgctttctttctttcttttttctgggagaagaggaagaagaggggaggcgcgacaaaaagggcgccgcgccccggcccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcgggcccaagtcgcgctccgtcgacaccatctcctcctggctcaaggccgggcatgtcccgtcgcgccggttcgaattttcccgggggggaaacccccccctcccccccgggaaaacgcttggaaaaactccaagggctccccctttaaagcccccccaaagaactgtggccccttttttttttaacacgttgggcccccaacctcccggggggacaaaaaaaagaaaacccccccctcccccttccaaaaaaaaaagaaatttttttttttccccccccccctttggggggaaaaaaaaacccccccccccccgtgggggggcccccaaaattttttgggggggggccccccccgggggtttttttacaccca

SEQ ID NO: 92325 - DNA, 885 bp, Zea mays
  misc_feature: Ceres CLONE 1580997
  misc_feature: Encodes the peptide sequence at SEQ ID NO. 92326
ctccccgcggtggcggccgctctagaactagtggatcccccgggctgcaggaattcgtctcacccctagaaaaaagccgtcggcgcagcagcagcagggcgtcgcgtcgcggtggcggcggtggagcccgcgtcgcgcggcggcgcgggcgcgcgtggcggcggcggagagctggcggcgcgcgtgggtgctggcgctgtgggtcgcggccatggcggcgctgttcgcgtggcggttcgtgcagtaccggcggtcggcggcgttccgggtgatggggtactgcctccccacggccaagggcgccgccgagacgctcaagctcaacatggcgctcgtgctcctccccgtgtgccgcaacacgctgacgtggctccgctccacctgggcgcgcttcttcgtccccttcgacgacagcatcgccttccacaagatcatcgcgacggcgatcgcgctgggcatctgcctgcacgcggggaaccacctggcgtgcgacttcccgcggctgatcgcgtcggcgcccgaggagtaccgtctggtggcgcgcttcttcgggcgggacaggcccagctaccgcgggctcctggcgggcgcggagggcgtgacggggatcgtcatggtcacgctcatggccgtgtccttcaccctggccacgcggccgttccggaagcgggaggaggccagcagggactagaagaaggcggcggcctgcgcatgcaggggcgtcccgctcgccggcttctacgccttctggtactcgcaccacctgctcatcgtcgtctacttcctgctcttcgtcaacggctggttcatgttcctcgtcgacaagtggtaccagaggacgacgtggatgtacatttctgtgccgctggcgctttacgtcgggac

SEQ ID NO: 92326 - protein, 159 aa, Zea mays
  misc_feature: Ceres CLONE 1580997
  misc_feature (29)..(154): Pfam Name: Ferric_reduct Pfam Description: Ferric reductase like transmembrane component
  misc_feature: SWISSPROT Homolog: EC 1.6.3.1 NAD(P)H oxidase
MAALFAWRFVQYRRSAAFRVMGYCLPTAKGAAETLKLNMALVLLPVCRNTLTWLRSTWARFFVPFDDSIAFHKIIATAIALGICLHAGNHLACDFPRLIASAPEEYRLVARFFGRDRPSYRGLLAGAEGVTGIVMVTLMAVSFTLATRPFRKREEASRD

SEQ ID NO: 92327 - DNA, 922 bp, Zea mays
  misc_feature: Ceres CLONE 1580999
  misc_feature: Encodes the peptide sequence at SEQ ID NO. 92328
aagctggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcccgctggtgtgcggcgccgagctgggcagcctcagccgcgacgagctgtggcgcaaggtgtggggggaggccacctacgacctcgccaccgtgctcgccttcctcgccgtcctcgccttcaccatctccgtctacatcatgtccaggcccaggcccgtgtacctcatcgacttcgcatgctacaagccggccgacgagctcaaggtgtccaaggcggagttcatcgacctggcgcgcaagtccggcaagttcgacgaggacagcctggcgttccagtcgcgtctgctggccaagtccggcatcggcgacgagtcgtacatgccgcgctgcgtgttcgagcccaacgcagctgcgccaccatgaaggagggccgcgccgaagcgtcaacggcaatgtcgcggcgctggaccagctgttcgacaagtgccgcgtcccgcctaaggacctgggcctgcctggtggtcaacttgagcctcttcaaccgaacgccctccctgttcggcagaatcgtaacccctacagaa

SEQ ID NO: 92328 - protein, 190 aa, Zea mays
  misc_feature: Ceres CLONE 1580999
  misc_feature (115)..(191): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIPLVCGAELGSLSRDELWRKVWGEATYDLATVLAFLAVLAFTISVYIMSRPRPVYLIDFACYKPADELKVSKAEFIDLARKSGKFDEDSLAFQSRLLAKSGIGDESYMPRCVFEPNAAAPP

SEQ ID NO: 92329 - DNA, 862 bp, Zea mays
  misc_feature: Ceres CLONE 1581000
  misc_feature: Encodes the peptide sequence at SEQ ID NO. 92330
  misc_feature (754)..(754): n is a, c, t, g, unknown, or other
  misc_feature (777)..(777): n is a, c, t, g, unknown, or other
ggagctccccgcggtggcggccgctctagaactagtggatcccccgggctgcaggaattcgtctcacccctagaaaaaacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgcttcngggtcaccgtaccctttgcttgnctgggtttctctttcctttttcttttttttttctttccccggccatggtactttgctttcagttttctctgcctgatgtgatgta

SEQ ID NO: 92330 - protein, 170 aa, Zea mays; identical to SEQ ID NO: 73340
  misc_feature: Ceres CLONE 1581000
  misc_feature (58)..(166): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase

SEQ ID NO: 92331 - DNA, 891 bp, Zea mays
  misc_feature: Ceres CLONE 1581002
  misc_feature: Translation starting site: 157
  misc_feature: SWISSPROT Homolog: EC 3.2.1.21 Beta-glucosidase
tggagctccccgcggtggcggccgctctagaactagtggatcccccgggctgcaggaattcgtctcacccctagaaaaaaaaggccggcgaacagaggagaggagaggagagactagacccgctagctgaggccgggcggcgcgctggacacgaacatgatggggagaaaggcgctcggctgtgctcctcttctcctcctcttggccgccgccgtcgctccggccgagctcagcgtcggggcggcggctgcctcgggcgcggtcacccgggccgacttccccgcggggttcgtcttcggcgtcggctcctccgcgtaccaggtcgaaggtgcagttgcagaggacggaaggaagcctagcatctgggacacattcacacatgaaggctattcccttgacaacgccacaggcgatgtaactgcggatcagtatcataagtacaaggacgacgtaaagcttctgcatgagatgggtgtcgatgcctaccggatgtcgattgcctggcctccacttatcccagatggtcggggagccgtgaatccgaaggggctggagtactacaacaatctcatagatgagctccttagctacggaaatacagcctcacgtgacgatataccatttcgatttcccacaggctcttcaggacgagtacagcgggctgatcagtcccagattcatagaggacttcaccgcgtacgcagacgtgtgctttcacaacttcggcgacgggtccagtactgaagcaccgtcaacgaggcccaagtcgaaaccatcgggggggtaccaacagggaatcctggccgccgcggcggggcttccttccccttcgggtttcgggcggcagggaagggaacttccccacgggagcccatacttagccgccccacc

SEQ ID NO: 92332 - DNA, 886 bp, Zea mays
  misc_feature: Ceres CLONE 1581003
  misc_feature: Encodes the peptide sequence at SEQ ID NO. 92333
  misc_feature (831)..(831): n is a, c, t, g, unknown, or other
ctccccgcggtggcggccgctctagaactagtggatcccccgggctgcaggaattcgtctcacccctagaaaaaattcgcctacggcatattcccccgaggccccgaaccaaaccaaaccaaaccaaaccaaaccagcccagatcagcgaaacacactccgctctcccgagaccggacacatggcggcggcggcggtgacgtccaacggcggcgcagtggccgcaaatgggccggcgcccggccggctggcctccgtgtacagcgaggtgcagacgaaccggctcctgcacgcccttcccctcccctccgtcctccgctccaacttctcggtcgtcgtcggccccgccagctccgccgcgggcaaccccgatgagatcgccaagctcttccccaacctgttcggccagccctcggcgtcgctggtgccgtcggccgagcccgcggcgaccaggccgctcaagatcggcgttgtgctctccggtggacaggcgccgggcggccacaatgtcatctgcggcatctttgactatctacaggagcgtgcaaaaggcagcaccttgtatggatttaagggaggcccagctgggatcatgaagtgcaagtatgtagaactcacttcagactttgtgtatccctacagaaatcagggtggatttgatatgatctgcagtggaagggacaagattgaaacaccggagcagtttaagcaagctgaagacacggccaacaagcttgatttggatggacttgttgtcattggtggtgatgattcaaacaccaatgcctgcctccttggtgatactttaggtcaaggaacatgaaaaccgtgntattggttgcccaagactatcgatggggatctgaaatgtaaggaggttccgacaa

SEQ ID NO: 92333 - protein, 213 aa, Zea mays
  misc_feature: Ceres CLONE 1581003
  misc_feature: SWISSPROT Homolog: EC 2.7.1.90 Diphosphate--fructose-6-phosphate 1-phosphotransferase
MAAAAVTSNGGAVAANGPAPGRLASVYSEVQTNRLLHALPLPSVLRSNFSVVVGPASSAAGNPDEIAKLFPNLFGQPSASLVPSAEPAATRPLKIGVVLSGGQAPGGHNVICGIFDYLQERAKGSTLYGFKGGPAGIMKCKYVELTSDFVYPYRNQGGFDMICSGRDKIETPEQFKQAEDTANKLDLDGLVVIGGDDSNTNACLLGDTLGQGT

SEQ ID NO: 92334 - DNA, 718 bp, Zea mays
  misc_feature: Ceres CLONE 1581004
  misc_feature: Encodes the peptide sequence at SEQ ID NO. 92335
ctggagctccccgcggtggcggccgctctagaactagtggatcccccgggctgcaggaattcgtctcacccctagaaaaacccctgttccctcaacgcttctctcctccacctcttctcgacagccgctgccacccggaaccttctcgcagcgacgctatgtgggctctccgccgagctggtaaccccctcaggttccatgcccaaaaagttgtgagtccccgtggttgtgcgagccttgaggtgctgctaactgctgatgcaaaaaatgttgaagaacaccatgaggcagactgtcagaaagtgtgctactgtcataagccaaagccaccatccttcttattgtcattttcatctggccaatttgcttgggagtagggggtttctcctctcagcccagtgcaaaattctagtgacaaggatgatgagtttagaagaatgtatttttcccggaacttcaaagggtcccccccaaagacggggaaaaaagggagggcggggggggggaacatcggaaaaaaacactctttttttaaagggaggaggccccccccgaaaaaaaaaaagggggggggcccccccaccaagggggggggcggcgtgtgtttaaaaaaaagccggggggggggggggggggggttttttttttaaaaaaaaaggggtgttttaattttttttgtggttcccccccccccccccctcccccccatgaagagagg

SEQ ID NO: 92335 - protein, 72 aa, Zea mays
  misc_feature: Ceres CLONE 1581004
MWALRRAGNPLRFHAQKVVSPRGCASLEVLLTADAKNVEEHHEADCQKVCYCHKPKPPSFLLSFSSGQFAWE

SEQ ID NO: 92336 - DNA, 840 bp, Zea mays
  misc_feature: Ceres CLONE 1581007
  misc_feature: Encodes the peptide sequence at SEQ ID NO. 92337
  misc_feature (711)..(711): n is a, c, t, g, unknown, or other
  misc_feature (803)..(803): n is a, c, t, g, unknown, or other
agctccccgcggtggcggccgctctagaactagtggatcccccgggctgcaggaattcgtctcacccctagaaaaagtgagggaaaaggcgagagcgtagaaagcagtccggtcggagaagcggaagttcgcgttgctttgctgatccaatgggggagaccaacgagctaccgccgccacccgtggccgcgccgccgcccatgatgccgatgcagtccatgatggtcggcgcaggcgccatccacccgccccacgagcagttccaccatctcaactactgcgtccactcaaatccatcctgggttcaggtggcagcacttgcattccttcactatcttgtgatgttgggttctaccgtcatgcttgcaacagctattgttcctgcgatgggtggtaacgctggtgacaaggctcgagttattcaatcgttcctctttatgagtggcataaacacactgctgcaaacacttattggaacgagacttccaacagttatgaatgcctcttttgcatttgttgtcccagtgctgtcaatagcaaaagagattgaatcaaataacttcctgaatgatcatgagagatttaaacacacaatgagaacagcacaaggagctctgattgtggcatccatcctcaacatgatttcttgggttcagcacgatatggggggcatatgccaaaaagttcagtccggtgataatgacccctggntgtttgtgttgttggtccttggactatttcaactggccttttccccaggttgggaaaatgtgttggagaattgggcttcccaatgctaattnctttgccgtgggttgttgcaaccattattgtgcccaa

SEQ ID NO: 92337 - protein, 216 aa, Zea mays
  misc_feature: Ceres CLONE 1581007
  misc_feature (188)..(188): Xaa is any aa, unknown, or other
MGETNELPPPPVAAPPPMMPMQSMMVGAGAIHPPHEQFHHLNYCVHSNPSWVQVAALAFLHYLVMLGSTVMLATAIVPAMGGNAGDKARVIQSFLFMSGINTLLQTLIGTRLPTVMNASFAFVVPVLSIAKEIESNNFLNDHERFKHTMRTAQGALIVASILNMISWVQHDMGGICQKVQSGDNDPWXFVLLVLGLFQLAFSPGWENVLENWASQC

SEQ ID NO: 92338 - DNA, 897 bp, Zea mays
  misc_feature: Ceres CLONE 1581010
  misc_feature: Encodes the peptide sequence at SEQ ID NO. 92339
ctggagctccccgcggtggcggccgctctagaactagtggatcccccgggctgcaggaattcgtctcacccctagaaaaaatcctctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggagtggggaagggatctgcttctcgctgttactggacgtcttcaaggggaatcaaacagcatcgtgtaatcggctgggggctcgcagggtcctgcgcaagctcagaacttgagagactcactggttgacgcaaagtcagatattgttggtcagaattggtcttccggaaagcttctaaatcattttgaacaaggccgaagcacaacgaattaacctaaaaaaacttggaacgcttggtttaaattacggggaaactggagtccaaacagggatctcggtgttgccaatggaattcctaaatcccgcgcccgacccaataaatagaagaaaaattttctcccccaggaaaaccgaacccttttttttgggtttgtcaaaaggaatattctccttggaaattttgcaatccccggggaataaaattcccgaaaaacaacccccttaaaaaggccctagccccccacaggaaaaggggcccccctcttagaagaa

SEQ ID NO: 92339 - protein, 63 aa, Zea mays
  misc_feature: Ceres CLONE 1581010
  misc_feature: SWISSPROT Homolog: EC 1.1.1.86 Ketol-acid reductoisomerase
MPSLDFETSVFKKEKVSLAGHEEYIVRSGEGICFSLLLDVFKGNQTASCNRLGARRVLRKLRT

SEQ ID NO: 92340 - DNA, 853 bp, Zea mays
  misc_feature: Ceres CLONE 1581012
  misc_feature: Encodes the peptide sequence at SEQ ID NO. 92341
  misc_feature (763)..(763): n is a, c, t, g, unknown, or other
ctccccgcggtggcggccgctctagaactagtggatcccccgggctgcaggaattcgtctcacccctagaaaaaagctttctccgctccccgtttccctctccaactccaatccatggcctccacggatcgctccacgccagcggaggacgagcaacagcagaagcgcccgtctctcttctcgccgtaccagatgccccgcttccgcctcgcccaccgggtggtgctggcgccgatgaccaggtgcagggcgcccgacgcggtcccaggccccgcgctcgcggagtactacgcgcagcggtccacggagggcggcttgctcatctccgagggcaccatcatctcgccgtccggccctgggtaatcatctccgctccgttttgctaccgcttccggccatcgatccacgatttctggtgtctccccttttgatctctctttcgtcatgtgaggcatgagcgcagccttgggcggagagattcgcgctagatctgatggtctggtggagacatggtcctcttgactgcgactggtgggttggtgtcaattatatcaatgacatgcgaggacaaaaacgggacggatattaaaatgtggaatagaatatgatatatgggaaccgcaatattatagtagtactggtactgtatgactatttatcgtgtgggtttggtaatgatatacttcgattagtatgctagagtcagtgctgattcagtggcctgaacagaatggatatgtcgacatgctgttcaaatgctgcngtagaagtgaaaaaatagagaaactgtggacgccttctctcacccgggcaattgaaaggttttttttttgggggggggggaacccaccca

SEQ ID NO: 92341 - protein, 82 aa, Zea mays
  misc_feature: Ceres CLONE 1581012
  misc_feature: SWISSPROT Homolog: EC 1.3.1.42 12-oxophytodienoate reductase
MASTDRSTPAEDEQQQKRPSLFSPYQMPRFRLAHRVVLAPMTRCRAPDAVPGPALAEYYAQRSTEGGLLISEGTIISPSGPG

SEQ ID NO: 92342 - DNA, 946 bp, Zea mays
  misc_feature: Ceres CLONE 1581013
  misc_feature (386)..(386): n is a, c, t, g, unknown, or other
  misc_feature (388)..(388): n is a, c, t, g, unknown, or other
  misc_feature (423)..(423): n is a, c, t, g, unknown, or other
tgggctccccgcggtggcggccgctctagaactagtggatcccccgggctgcaggaattcgtctcacccctagaaaaaagcaaaggcgggggagagagctccgtgcagtcaccgtcgtgttcggaacgagcgagagagcgggagactagtctcggcgcctctgctgtgctgtcttcttctccccctctgctctgcttcggctcctcacgcggcctcgccgagacccgcagggggttcagacttcttggtgagagcgatatgagtgtcccaggtcaatgctcatcccggccacaatttatcaccagcgttgggaggagtaaccgctccaatggccccggcactcctcttttcttccccctgaggggggggggggggggggggtcccnanaaaaaccctttcaaatactttattcttctacctangggcccgcatttccccgtctcatttgcatataattgatcctgggaaacttttgggacggggtcttccgggttggggccccgttaccaattttgggctttcttttggattttagtttgttgcctcccggggggtgcctcctccttatcccaacccctttgcccgcgtcgtttgggggggtggtgtttaggggggaccccctttcccgggggctttgtggggggcgtgggttctccgcgcggccgcgggtttcggcgtcgtgggggggggttttgggggggcttgtctggtgggcgctcggggggttcgccgtgggttgttgtgggcggccggctcggttgctgtaggcgggggttgcctcgcttgcgagcagggcgcgccgggggggctcgtgcgcgcggcgggtgtttccctggggtcgggcgccgtccttcccggggttggtggtcggcgcgccgggggtgttgtggggtgttcggtgggttttctctggggtgcgggggggggtgcggctgtgggcgggcg

SEQ ID NO: 92343 - DNA, 660 bp, Zea mays
  misc_feature: Ceres CLONE 1581014
  misc_feature (228)..(228): n is a, c, t, g, unknown, or other
  misc_feature (229)..(229): n is a, c, t, g, unknown, or other
  misc_feature (247)..(247): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (505)..(505): n is a, c, t, g, unknown, or other
ggagctccccgcggtggcggccgctctaaactagtggatcccccgggctgcaggaattcgtctacccctagaaaaatcctccacgcgaatccgcatctccagactccaaccagcgctcgtccctccccgttctttcctcctcccttcagccatcgcagtcgcagcgcaggttcttggctggttgctggtgtcgacagcaaagtccgcaactccaaaatctgctgcgcnntctcccgtctcactcagnaacccggggcaacgcnnnncccgggccttgtccaatttgaaaatttctttttacggccccctttttggccattggcaaaatttgaacccccaacctaagaaaaccccccattttttgcggggggaaaaaaaaaacccgggggagaggggaaaaaaaaaatggggttttttttttttaaaaaaaggggccccaggggggggggtaaaaaaaaaaccaccccttttttttttaaaaagggcccccccaaaggaaagaaancccaaaaaaccccccaaaaaaaaaaaaggggggggcccctctggggggggcccccttttttttttttttttgtttgaaaaaaaaataattgttttttttttttcctccccccaaaaaaaaaaaaaaagacgcgggggcaaaacaaccccccaaat

SEQ ID NO: 92344 - DNA, 897 bp, Zea mays
  misc_feature: Ceres CLONE 1581015
ctggagctccccgcggtggcggccgctctagaactagtggatcccccgggctgcaggaattcgtctcacccctagaaaaacccctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttggcccgggggacgaggaggaggctggtcaaagatctgtggtcaaaaattgatggtggggttcatggaatgggtgcatgactggttgctgtgggacgccttcctggagtgcggagggatcatgaggccaccgattagatagcggctggggagcgagggaccacaggaggcggaggccgccgttagcaccccccaccaccccgcgccgcgagcaagcagccatgggggaagacctcgtcaccaccctgtccatggagaacggcggcggcggccaccacggcccctgcacgctcctctccatggacccgtccggccacctctccgcgccggacgaccgcgccgtcggcgtcatggtgcgacctcttccggaagggggggcttcgggcccggggccccgcgcccacgcccgtgtcgccctccggcgcgccttcgtccgacatcaaccagccgtggcagaacgacctctgcgacatgctggacgtcggcctcggcccgcaggtctaacgcggccaaggcctgctcagctgcgcccccaagcccgggaacccgaaa

SEQ ID NO: 92345 - DNA, 829 bp, Zea mays
  misc_feature: Ceres CLONE 1581016
  misc_feature: Encodes the peptide sequence at SEQ ID NO. 92346
  misc_feature (353)..(353): n is a, c, t, g, unknown, or other
ctggagctccccgcggtggcggccgctctagaactagtggatcccccgggctgcaggaattcgtctcacccctagaaaaatcagacagacgcagactctctcacccgactcgtcagacgtcagccagcagttcgaaaccaaggatcgatccaggagcttccggaaggcgaggcgcgcgcgcagcgtcgaggtgctggtgccggtgccgcccatggatcgggctcgcggatccgcgttcctgctcggcgtcctgctcgcaggatccttgttcgcgttttcagttgccaaagaggagaccaagaagctcgggaccgtgatcggtatcgatctcggtaccacctactcctgtgtcngtgtgtacaagaaccgtcatggcgagatcatcggccatgaccaggggaacccgtatcacacccctcatggggttgcgcttcacccgatagcgagagggctcatctgtgaaggctgtccaagaaacaaggcaggccgtctaaccctgagaaggacactcttttgagcgtcaagcggtcttcatcgggaagaaaggttcgcgggaccaagggaagtcccgaagggacatggaaaccttggtttcccctctacgaatattttacccagggtggggggaggccttctattttcagtgcaagatcataggggttggggggaaacaagggcttctcgcccccgaagaggatcaccgggcccttaaactttggggaacaataaaaaataatgcttttaggaagatacctgtgggaaaaggaaaccaacggaagatcggtgggcaaccgggtgccgcggggcattttctaggatgggtggccca

SEQ ID NO: 92346 - protein, 101 aa, Zea mays
  misc_feature: Ceres CLONE 1581016
  misc_feature (48)..(48): Xaa is any aa, unknown, or other
MDRARGSAFLLGVLLAGSLFAFSVAKEETKKLGTVIGIDLGTTYSCVXVYKNRHGEIIGHDQGNPYHTPHGVALHPIARGLICEGCPRNKAGRLTLRRTLF

SEQ ID NO: 92347 - DNA, 1185 bp, Zea mays
  misc_feature: Ceres CLONE 1581018
  misc_feature: Translation starting site: 444
  misc_feature (14)..(14): n is a, c, t, g, unknown, or other
  misc_feature (56)..(56): n is a, c, t, g, unknown, or other
  misc_feature (58)..(58): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (1032)..(1032): n is a, c, t, g, unknown, or other
ttttttccccctcncctccccccctctactgacacatactccctcggagggagaananatatttnnnnncaatactgggactccccgcggtggcggccgctctagaactagtggatcccccgggctgcaggaattcgtctcacccctagaaaaacactagtcccaactcccaaccaccgccagccgtccgctctccgcaagcgcgaccttccggacagatccgccccgtcgcgccgacgagcggtccttctgcctagtttctccgcccagcgagcggcgggttcctcggagattcccgctggccgcggggatccatttgtgactgctcgcgttgcgcctggatctggtttggggacggacgagtgaaacgcgacggagatcgtgcgaggtggggcacacattaatgcccctgcttggggttaggtcagcacttttggcctcccatgtgtgaggggttcgcggggactgtctattaccaacctgccccaagacgaaagagccagcaaaatggtgggatttggccccgtgaacagctgcgatctaatttatgggtagagagcgggagcgcggcacagggtggcccccgtttactgagagatccgcccccagcaaacgtcgttttcataatacaaatgaatttgcgtatacttatacaggcgtccactatgccgtcggcgacccctgcccgggaaatgttctcctacgggcaggtggaaacaaagctgatatatggccactcgggagacgagagtcagggtaagacgccccccacgtcgcggtgtcccccgtgtatagcagcgcgtggctattttgacatggatgtgccaaacaccggccgttttcagaactactctacgagagaacaggcgcgttaggcggaagaaacggcgcggtagtgtaatgggcggctccgatattaatcgaaactagtatttgctgtcggtgtgacgccaaatagttggaaagagagctagcccgtatagaccgccggcgcgacacggcgtagtagcggcaggagagaaataggctcanccaacggctaggtgagacattgccggcaacgaaaagccgagaagacagaaaggagggcgcggtagtgcatcgatgagacaacgagagaaagctagcgcggaagagcgggctggtcgcggaccacacgacccctgagccacgacacatatacac

SEQ ID NO: 92348 - DNA, 872 bp, Zea mays
  misc_feature: Ceres CLONE 1581022
  misc_feature: Encodes the peptide sequence at SEQ ID NO. 92349
ctccccgcggtggcggccgctctagaactagtggatcccccgggctgcaggaattcgtctcacccctagaaaaaaagccacaaatatttgcaagccacaagccaagccaagcaaaaccctaagaaacccaccctccctccagtctcctcgacccccgccgccgccgccgccatcacaacccagagcaccccctccccaccccaccctgtcccgatggctgcggacgccgccgctgcggcgatgtccgcgacttccctctgcgacgaatctcgagcccgccaccgtgcgcacccgcatccgcgatgtcctggccgaggtgcgcgcgtgcggggacgcgtcgtgtcggtgggtgggtcggacgggccggagcaagggaagggctctttcccctcctgggagctcagcgaaggggtcctgggctgccacgctttaagcccatcgttggacgccgcccgtgaaacccggttaggggggcctcaacggcaaccggggaaccctccggtccctcggtccgaagggggggggaattcaaaaggaaaccccccccccaaagggggggacccaaaagcccaaaaaaccggttccaaaagcctttgaaaaagagggtaaaccccccccggggtgggccttttttagaggaggccgggggcaaaaagaatcccaaaaaaagacccccccccctttttttataaccccggggggggcccccaaaagggggaggaaaaggggggtgaaaaataatctcccccccctccccttaaaaaaaggggggggggggggacccctcctttttaaaactccccccgggtgtgggggcccgccccacaaaaagatatttgtggagagcggggtttctccaaagaaaaataaga

SEQ ID NO: 92349 - protein, 127 aa, Zea mays
  misc_feature: Ceres CLONE 1581022
MAADAAAAAMSATSLCDESRARHRAHPHPRCPGRGARVRGRVVSVGGSDGPEQGKGSFPSWELSEGVLGCHALSPSLDAARETRLGGPQRQPGNPPVPRSEGGGNSKGNPPPKGGDPKAQKTGSKSL

SEQ ID NO: 92350 - DNA, 1241 bp, Zea mays
  misc_feature: Ceres CLONE 1581024
  misc_feature: Encodes the peptide sequence at SEQ ID NO. 92351
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (35)..(35): n is a, c, t, g, unknown, or other
  misc_feature (989)..(989): n is a, c, t, g, unknown, or other
ttttttttttgncnnncncctccccccattttttnttacgtgatcgtgtcgtggggagagacaaaaggaaaactggagctcccgcggtggcggccgctctacactagtggatcccccgggctgcatgaattcgtctcacccctagaaaaatgcgggttcgggacgaactgaaggcctctgtcagcaccagcggcgggtcggagcaggatctctacggactcgtctctctgttcgatgagtatgcgctatctatgctgctccggcgagggttgatataatgaaagaatcggggaagagaatggcgtcgtggaggcgctcgtcggcctgtgctcgtcccctcgggtcgacgcaggataaggttgcttgcctcggccttgtagagtctgagcctccctccaccgtgatggggcctagcagggaaaacttcggaccaagtcgagggacccgagaatgggaggggataaggctgaagaagaaagcgcgcccccccccccacatttgaatgggaaagcctagcatttggtggtcgtaagcaagcagagcaccagagcggatagatgaaggcggagaaaaagaaaaactttgtatgggaaactgaaaaggtgggtatgaagacacgatggccggactgtgggcctggaaaggacatgacgtctcaggggaactcacgaggcgccccatgaggtccgatacagtaatagggcgagggccgcagacagtacagtactagagaaaaaccctagaaaaggaaagtttcacgatctagatggggtggagacaaactctaaatctcaggggaaggtagatctcctaaatcttatccccacaccggatgggtggagacattgtcaccttgtcgtaatgaggctggcggtggcacttcacccccgaaataacgctgtggcaacgtgcgggtacaaacaggagtgcggctttacgcacaccaagatagtatatatatatcgtgatcccgtcttatgcgcagagancacgagcgctctcatagggtgttagataacaccgcaggggtgtgtcacgacgcctgcgttatgctagaacgcctcctctctctgggagcgtaataaccttctcgcggagagcttccccgaagatagtcctgatatacaaagaaacactcgaggaattcaacaacaggtgggcggagcgaagcgaatgactggtcgacgtgtccgcaagatatgatgatttttctagtcgagtagacgtcgctctggaatgcg

SEQ ID NO: 92351 - protein, 42 aa, Zea mays
  misc_feature: Ceres CLONE 1581024
MRVRDELKASVSTSGGSEQDLYGLVSLFDEYALSMLLRRGLI

SEQ ID NO: 92352 - DNA, 848 bp, Zea mays
  misc_feature: Ceres CLONE 1581027
  misc_feature: Encodes the peptide sequence at SEQ ID NO. 92353
ctccccgcggtggcggccgctctagaactagtggatcccccgggctgcaggaattcgtctcacccctagaaaaagcgctgcttcgctgtctttcggcaacgccctttaccacatctgaatctcacccacccacccccgcgccccccgccaaagcatggcgccggcgatggggatgaagcggcctgcggctgcggcggcggcggcgggagcgggggcagcagcagcgcagacggtcacgctgtccgcgccggccgtgcgggacgcggtgcgcgccgccgtgagggatgccgaggccaccgccccggccgccagggtcccggcgacggcggcagccacggcggagatcgctagggacggggtgctgtgcctggaggaggtcgacgggaggcggtggagctacgtggtcgacgccgccggcgccgcggtcaaggctaagggaagggcgtccgtcggcgccgccttcaaggtcgtcccgctccagtccccgctgccgcccgtcgaggaaataatgtcctttataagatcatatgttgtgcccgaaggctttccagatagtgtcacaccttcatatgttccatacatgacatggagagcattgaagcatttctttggtggagcaatgggcgtgtttacaacaagaaccttgctcaactctgttggagtctcccaaagcagggctgcatctggtgctgtggctatcaactggatacttcaagatgggggctgggccgtgttggaaagatgctttttggcccgccaaggggaagaaattttgattatgaacctgaagcagcttcgcctttttcgggtgatcctccttgatgggaagttagggaggctggggattt

SEQ ID NO: 92353 - protein, 231 aa, Zea mays
  misc_feature: Ceres CLONE 1581027
MAPAMGMKRPAAAAAAAGAGAAAAQTVTLSAPAVRDAVRAAVRDAEATAPAARVPATAAATAEIARDGVLCLEEVDGRRWSYVVDAAGAAVKAKGRASVGAAFKVVPLQSPLPPVEEIMSFIRSYVVPEGFPDSVTPSYVPYMTWRALKHFFGGAMGVFTTRTLLNSVGVSQSRAASGAVAINWILQDGGWAVLERCFLARQGEEILIMNLKQLRLFRVILLDGKLGRLGI

SEQ ID NO: 92354 - DNA, 795 bp, Zea mays
  misc_feature: Ceres CLONE 1581029
  misc_feature: Encodes the peptide sequence at SEQ ID NO. 92355
ctggagctcaccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagggcgccgcggcgagccagccgctgagcgtggcgatcccgccggagccgtccatcacgccggtgatccaagactttacggatcccaacctgttttatctaccagcgtattactacggaggctacgacagttccatgagcgagtgggatgattatccgagatatctaaattcagatggagtggagattgccccagcggtatacggagaatattatgggatatgggtatgctccttacggggcata

SEQ ID NO: 92355 - protein, 138 aa, Zea mays
  misc_feature: Ceres CLONE 1581029
MAAVAPPPAPAPAPVPAPAPATGPVADQTTDLLQKLSLDSQPKPADATQPAAATAKKGAAASQPLSVAIPPEPSITPVIQDFTDPNLFYLPAYYYGGYDSSMSEWDDYPRYLNSDGVEIAPAVYGEYYGIWVCSLRGI

SEQ ID NO: 92356 - DNA, 829 bp, Zea mays
  misc_feature: Ceres CLONE 1581032
  misc_feature: Encodes the peptide sequence at SEQ ID NO. 92357
  misc_feature (632)..(632): n is a, c, t, g, unknown, or other
  misc_feature (714)..(714): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
ctccccgcggtggcggccgctctagaactagtggatcccccgggctgcaggaattcgtctcacccctagaaaaagtccactgttccagcttgcacccgacaagccgaacacttcaccctttcccacttcacctccgccgttccgcatctgtggtcaaatacgacgctcgcgtccataccgatccgtgtttgcccattccctctcctcccactcgcttttcctccaaagcgagcgagctaggcgttacgccggagctggtttgggcggtggtgaaggagagaggaaagggaggagatgaaggcggtggagcgagcgaaactggtgaggagcctccggcacgagtcgcggcggctgcgtctactcgtcctcgttatcggtttcttcctcgttactctcaccttcgtcgtcgtctccaagcccgacgcgcttctcttcaacctgaacggcaggctgtcggtggaccaggcgccgcgctcgctcttgatccgccagcgggttgacgccgacgaggggagatccgccgaaactctcgcctcagcctccggagaatcaaaggtggtcgaagacgatacctacggcgaggaagccagcgccaaagccagagccaacgccaatgcccgaagggacactgnccgagaggaacggatgctcgctagtgagcccgagcagagaaaaagggcacaggaaagcactacatctgagattttagctgcngaagacgaccggggaaagaaaaagcnnngcagaggacacagagagcaccagcagcacaagttgacccctcccaactgttccgaatattacatttcacgatgccactgacggcacc

SEQ ID NO: 92357 - protein, 175 aa, Zea mays
  misc_feature: Ceres CLONE 1581032
  misc_feature (113)..(113): Xaa is any aa, unknown, or other
  misc_feature (149)..(149): Xaa is any aa, unknown, or other
  misc_feature (150)..(150): Xaa is any aa, unknown, or other
MKAVERAKLVRSLRHESRRLRLLVLVIGFFLVTLTFVVVSKPDALLFNLNGRLSVDQAPRSLLIRQRVDADEGRSAETLASASGESKVVEDDTYGEEASAKARANANARRDTXREERMLASEPEQRKRAQESTTSEILAAEDDRGKKKXXRGHREHQQHKLTPPNCSEYYISRCH

SEQ ID NO: 92358 - DNA, 791 bp, Zea mays
  misc_feature: Ceres CLONE 1581034
  misc_feature: Encodes the peptide sequence at SEQ ID NO. 92359
  misc_feature (791)..(791): n is a, c, t, g, unknown, or other
ggagctccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccan

SEQ ID NO: 92359 - protein, 180 aa, Zea mays; identical to SEQ ID NO: 91477
  misc_feature: Ceres CLONE 1581034
  misc_feature (6)..(74): Pfam Name: ubiquitin Pfam Description: Ubiquitin family
  misc_feature (82)..(150): Pfam Name: ubiquitin Pfam Description: Ubiquitin family

SEQ ID NO: 92360 - DNA, 991 bp, Zea mays
  misc_feature: Ceres CLONE 1581035
  misc_feature: Encodes the peptide sequence at SEQ ID NO. 92361
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
cgacaaaaacaaaacaaacgcgaggaaaacagaacacaaacaacgcgacagacaaaacccccccaccnnnnnngtgcaagctggagctccccgcggtggcggccgctctataatagtggatcccccgggctgcaggaattcgtctcacccctagaaaaagtcgatcggtgtccctagcctccccctgcccggctgtccttctcctcgatttcgcaagctcctggttacggcggcatctatcgttccgccgcatcgtctctctcgcgacgctgccccagaccgccgagataatggctggccaccgaaacagtcatggaaagcgccagtctgattttactgaaaatggaggcggtaagagaagaaatcctggcgatgatacatatgcacctggtcctgatgacactgtgtatcgctacctctgtgcctctagaaaaattgggagtatcattggcaggggtggagaaattgcaaagcagttccccactgagacccaagctaagatcaggattggcgagagtgtccctggatgtgatgagcgagttattaccatatttagcacaagcaggaaaactaataccatcgatggtgctgaagatgaggtttggccctgctcaggatgccctctttagagttcatgagaggcttgccagtgaataagggtctttgggaacgaagaacgcgaaagaaaatttcaccttcaagttaactgtttcgccttgctttgtgcccatcagaaccaagatttggaatggcttttatttggaaataagggggggcaagaatccatcccaagggaaatcccgcaagtgaagaactgggtgccaccaaaaataccgtggtcccctctagttaaattggatccattattcgccccgccattgttggccccattttagtgggggaagacccgaaaacttttcctccacaaaaattaatcaggggggggtaccaccgcgttaagatttttttccaaaaaatagacggcctccct

SEQ ID NO: 92361 - protein, 112 aa, Zea mays
  misc_feature: Ceres CLONE 1581035
  misc_feature (39)..(104): Pfam Name: KH_1 Pfam Description: KH domain
MAGHRNSHGKRQSDFTENGGGKRRNPGDDTYAPGPDDTVYRYLCASRKIGSIIGRGGEIAKQFPTETQAKIRIGESVPGCDERVITIFSTSRKTNTIDGAEDEVWPCSGCPL

SEQ ID NO: 92362 - DNA, 851 bp, Zea mays
  misc_feature: Ceres CLONE 1581036
  misc_feature: Encodes the peptide sequence at SEQ ID NO. 92363
  misc_feature (545)..(545): n is a, c, t, g, unknown, or other
  misc_feature (776)..(776): n is a, c, t, g, unknown, or other
  misc_feature (819)..(819): n is a, c, t, g, unknown, or other
  misc_feature (820)..(820): n is a, c, t, g, unknown, or other
  misc_feature (835)..(835): n is a, c, t, g, unknown, or other
ctccccgcggtggcggccgctctagaactagtggatcccccgggctgcaggaattcgtctcacccctagaaaaagagggtgcccctcccactctcgcgtcggtcccgcgatgggcctgttctcatcggccgctaagagatgtagaaagtgcaagaagttcctccgcagcgcgggcgcgtgctgctgctcgccgtcggcctcctccgcccctgctggtggtgtgcgcggcaacgaagaggcgtcgacgtcggcgtcggcgctggcttccgcgccagatggcaagaaaaagaagaggtggaggaagagaaagttctggagaaagaagaagaaggccaagaaggagagcgacgatggcagcggcgagctcgtggatctcgtcaacagcttctcggccaagtccgacgtgtgcaagaacgtgaatgcggccgaggagatcctacggggctgcaaccagaacatgcccagcagggcgctgacgttcagccagctgggcgccgcgacggacgggttcagcgagcagaacctgctgggagaaggcggcttcnggcgggtgtacaaggggctcctccaggacaccagagaggtcatcgccgtgaagcagctggacaggaacgggttccagggcaaccgcgagttcctcggtggaggtgctgatgctcagcctcctgcaccacccgaacctcgtcaagctgctgggctacagcaccgactccaaccagcgggatccttggtgtacgagtacatgcccagggggctcgctgggaggactacctccntggacttgccccctgagctgggaagcccctgccgtggcacacnncggattgcggggtcncggtggggccccgcaa

SEQ ID NO: 92363 - protein, 247 aa, Zea mays
  misc_feature: Ceres CLONE 1581036
  misc_feature: SWISSPROT Homolog: EC 2.7.11.1 Non-specific serine/threonine protein kinase
  misc_feature (146)..(146): Xaa is any aa, unknown, or other
  misc_feature (223)..(223): Xaa is any aa, unknown, or other
  misc_feature (237)..(237): Xaa is any aa, unknown, or other
MGLFSSAAKRCRKCKKFLRSAGACCCSPSASSAPAGGVRGNEEASTSASALASAPDGKKKKRWRKRKFWRKKKKAKKESDDGSGELVDLVNSFSAKSDVCKNVNAAEEILRGCNQNMPSRALTFSQLGAATDGFSEQNLLGEGGFXRVYKGLLQDTREVIAVKQLDRNGFQGNREFLGGGADAQPPAPPEPRQAAGLQHRLQPAGSLVYEYMPRGLAGRTTSXDLPPELGSPCRGTXRIAGSRWGPA

SEQ ID NO: 92364 - DNA, 1041 bp, Zea mays
  misc_feature: Ceres CLONE 1581037
  misc_feature (70)..(70): n is a, c, t, g, unknown, or other
acggaaggagaaaaaaaaatattaataattgtttttattttaaatacagacgccatctacacgccgccgnggggggcaaaactggagctcaccgcggtggcggccgctctagaactagtggatcccccgggctgcaggaattcgtctcaccccctagaaaaaagccaactcgtcccctcgggccaacgcgaggccaaaaccaatcacatctcctccccctgaccccctcccaccaccgaggacccttccccaagaactgccccgagtcctggagcgggagagaggtcgagggaggagtccaataagagtttctcctcgcctctctctctttctgctcgaaaaattattgtcgcattggtttggttcccttgccaaaggaggcggctttctgtcctcgctgatctaacatgatggcgagcaccgcgtcagcgaccgccgccgccgccgtggcattcggggcagccgccaagccgcggggaccggcggcggcgctccgcgcaagagtgcctgcccggcgggcaaggcggcgcctcccggcaatgggtgggttgccgcctggcaaacgcccggccggtggaaagggccccaagggcggccaagggccggggtgggggccccaaaaaggggccccgccccaagaccaaaatttagagccccgagccgggccttttctcgggagagagcccaaagggttttctccccacgaggggaaatttttccgtttcccaccggcggctaaggaaataaaccccggcgggggttgtacccacaattgggaaaaaaagggggaaaaaaaaaaagggggaaaagttttatatcgccgcggttatataaccccgtggggtggagaaaaaaaaggggggcgcctcttccaagtggtggggtttatcccacccaacccaagggccaaacccccaagatgtggggaaaagaaaattcccccctgtgtaaaaaaaaaaaaaccttttgtgcggcggggttttggcccaacaaaagagaaaaacctttatttgggggccccccccgggtgggctatatttt

SEQ ID NO: 92365 - DNA, 845 bp, Zea mays
  misc_feature: Ceres CLONE 1581041
  misc_feature: Encodes the peptide sequence at SEQ ID NO. 92366
  misc_feature (702)..(702): n is a, c, t, g, unknown, or other
  misc_feature (742)..(742): n is a, c, t, g, unknown, or other
  misc_feature (806)..(806): n is a, c, t, g, unknown, or other
agctccccgcggtggcggccgctctagaactagtggatcccccgggctgcaggaattcgtctcaccccctagaaaaaggagctgtgagctgagctgagcttaccaccaccacacacgggagatagctatagctagcatagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccaggctggacgccgtgggacgcggagttcggcaaggacgacggcagcgacnagaaagccctcgccagctacctcgtccccctgcagcagtngcatcttcgggtcctctgccaggcgttcgtgggcgccgacccgtccgcccgactgggctgtggnaacactcgggcttcacatcctggacatctggctgggcga

SEQ ID NO: 92366 - protein, 224 aa, Zea mays
  misc_feature: Ceres CLONE 1581041
  misc_feature: SWISSPROT Homolog: EC 4.2.1.92 Hydroperoxide dehydratase
  misc_feature (177)..(177): Xaa is any aa, unknown, or other
  misc_feature (212)..(212): Xaa is any aa, unknown, or other
MLPSFVSPTASAAASVTPPPRPIPGSYGPPVLGPLRDRLDYFWFQSQDEFFRKRAAAHRSTVFRTNIPPTFPFFVGVDPRVVAIVDAAAFTALFDPDLVDKRDILIGPYNPGAGFTGGTRVGVYLDTQEEEHARVKTFAMDLLHRSARTWSADFRASVGARLDAVGRGVRQGRRQRXESPRQLPRPPAAVASSGPLPGVRGRRPVRPTGLWXHSGFTSWTSGWA

SEQ ID NO: 92367 - DNA, 847 bp, Zea mays
  misc_feature: Ceres CLONE 1581043
  misc_feature: Encodes the peptide sequence at SEQ ID NO. 92368
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (382)..(382): n is a, c, t, g, unknown, or other
  misc_feature (473)..(473): n is a, c, t, g, unknown, or other
  misc_feature (544)..(544): n is a, c, t, g, unknown, or other
  misc_feature (549)..(549): n is a, c, t, g, unknown, or other
  misc_feature (550)..(550): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (580)..(580): n is a, c, t, g, unknown, or other
  misc_feature (581)..(581): n is a, c, t, g, unknown, or other
  misc_feature (657)..(657): n is a, c, t, g, unknown, or other
  misc_feature (662)..(662): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (673)..(673): n is a, c, t, g, unknown, or other
  misc_feature (695)..(695): n is a, c, t, g, unknown, or other
  misc_feature (705)..(705): n is a, c, t, g, unknown, or other
  misc_feature (720)..(720): n is a, c, t, g, unknown, or other
  misc_feature (725)..(725): n is a, c, t, g, unknown, or other
  misc_feature (726)..(726): n is a, c, t, g, unknown, or other
  misc_feature (728)..(728): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (745)..(745): n is a, c, t, g, unknown, or other
  misc_feature (746)..(746): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (766)..(766): n is a, c, t, g, unknown, or other
  misc_feature (767)..(767): n is a, c, t, g, unknown, or other
  misc_feature (782)..(782): n is a, c, t, g, unknown, or other
  misc_feature (785)..(785): n is a, c, t, g, unknown, or other
  misc_feature (786)..(786): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (792)..(792): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (814)..(814): n is a, c, t, g, unknown, or other
  misc_feature (815)..(815): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
ctccccgcggtggcggccgctctagaactagtggatcccccgggctgcaggaattcgtctcacccctagaaaaaatcacacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggnnnttgctgcnnnagaggtccggggccttcgtgggatcttgaaattgaatgttctaatggagtccaagggtggcaagaagaagtctagcagtagtcgttcctcctgatgtacgaagctccccttggnctacagcattgaggaatatccccccccctggaggggggggattccaaaaaaaatttttcccccggggtttttttttttcaaaaaaaatttntgggggaaggaaacccccccttttttttttttttttgtcccccccccccgcccccccaaagagagaaaagnacaannaaggnnnncagggnnnnnnngggggcagcnntagagaggacgaagcctttggttttttgttgtttttttccctaaaaaaaaacccccccccccctcccgctgggggnggggntnnnnnnnnanaaaaaaaaaaaaaaaaaaaaanccccaaaaancccctccctcctctntcttnntnttnnntttttttttggnntggggggggggnnnnnaaannaaaaaaaaaaaaaanaannannncncnnnnnnccccccccccccccnncctttnnntgggggctcctctccccccccccg

SEQ ID NO: 92368 - protein, 33 aa, Zea mays
  misc_feature: Ceres CLONE 1581043
PRGGGRSRTSGSPGLQEFVSPLEKITQRHRVVR

SEQ ID NO: 92369 - DNA, 1017 bp, Zea mays
  misc_feature: Ceres CLONE 1581047
  misc_feature: Encodes the peptide sequence at SEQ ID NO. 92370
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
aataaaatataaaaaaacaataaaattaatgttagctccgctgggggctcgtcctattaataannnccnnnncaaactggactcaccgcggggcggccgctctagaactagtggatcccccgggctgcaggattcgtctcacccctagaaaaacatcttcaactatacatcacgcacctggcccctcaaatgctgcatctgcccatttaggcagtcataaccttcatgctgctgccatgctttcagctgttggacgcgggggacctggcttgtcccagttattactgccttttgatgtttcggttgtactccgtgggccatactggatcgcctttaatattgccagaaattttctggtgaactggcttgtttgctggggaacagggtttgcttcagacagctcctcctcctaaaggggggccttccgtgggggggaaactttcccgggcccaaaagttccgggccttttctaaaggaaaacggttgcccccggggtccaaaaggggctttggggcccccactccctcttaaaaatggtgccaacggggcgtttgtgggagacccttttaaaaaaaccaataatcggggggaaattttccaccaaaaaaaagtgtccccccccctgatgggaacaaaagatcgcctataaaaaagatccgccccccccccccgcgggaggggcctttttctctcaaacgcgggggggggtgaggcgaaaacaagcactctgggcgggcgtgtgtgtagccgcccccccgcacccagaggccgcacccacccgcctttttctgaggaactcccaccgccgtgagcagaaacaaagacgccccgaggagggggaggttttattagtaaaccaacgtctgaaaatcacatcttgagctgtatcagtatagagaaagaaacacccttcccgccgcaggaaaaaataaaagtcttctcaataggaaggagtctgcacccccattactaaaatgtgtggagaggtgggtgcgatcatattgtgtccccccctct

SEQ ID NO: 92370 - protein, 58 aa, Zea mays
  misc_feature: Ceres CLONE 1581047
MLSAVGRGGPGLSQLLLPFDVSVVLRGPYWIAFNIARNFLVNWLVCWGTGFASDSSSS

SEQ ID NO: 92371 - DNA, 841 bp, Zea mays
  misc_feature: Ceres CLONE 1581051
  misc_feature: Encodes the peptide sequence at SEQ ID NO. 92372
  misc_feature (841)..(841): n is a, c, t, g, unknown, or other
ccccgcggtggcggccgctctagaactagtggatcccccgggctgcaggaattcgtctcacccctagaaaaacccagtcccccataggccgtagaccagagcagtagaccgccatggcgaaccgcagcaggcagctcgttaccaccgcactgccgctcgcggcggcagcagcagcctcgctcgccgtcgtgctcctgctctgctccacgggctcatcggaagccgacggatacctcgggcgcgtgggtgcgccgtggggccgtaccctcacggtcctcccattcagccccgcggacctgctgcccctcctgccgcggggcgtcgccatggccgcgctccgggcgctccgcggcgtctcggacatcttcccggtgttcgtcggcgccgcgtcggccggcgggtcgggctcggtgcccggcagcggggggacggtgagatggaagggggcctgcttctacgagaacgaggcgtggctggtgttccacaacgagaccgggtccaagtacggcggcggcacgctccatatcaagacatccaaagcgcacagctggacttgcatagatctgtatgtatttgcaacaccatacagagttacatgggattactactttttgggggcgagagcacactctttgatatcaaagaatggggaaagcgattgcttgattatgagttatgtgaaaaacgaaatgggtgggtccaattttccctcaggccccatctgggaaacaaatggggcacaactttccagagcacctccgtgggaaaggtccttccccctcctggtttccaaaaaaaaaaccgggccagtggggggggggaaaaaaaccgccccaaaatn

SEQ ID NO: 92372 - protein, 242 aa, Zea mays
  misc_feature: Ceres CLONE 1581051
MANRSRQLVTTALPLAAAAAASLAVVLLLCSTGSSEADGYLGRVGAPWGRTLTVLPFSPADLLPLLPRGVAMAALRALRGVSDIFPVFVGAASAGGSGSVPGSGGTVRWKGACFYENEAWLVFHNETGSKYGGGTLHIKTSKAHSWTCIDLYVFATPYRVTWDYYFLGARAHSLISKNGESDCLIMSYVKNEMGGSNFPSGPIWETNGAQLSRAPPWERSFPLLVSKKKTGPVGGGKKTAPK

SEQ ID NO: 92373 - DNA, 1145 bp, Zea mays
  misc_feature: Ceres CLONE 1581053
  misc_feature (17)..(17): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
  misc_feature (59)..(59): n is a, c, t, g, unknown, or other
tggtgtttttggggggngcggtggggggggcgggtttttttcanncantttgccgtgtnaatgtttcgacgcacgtccggcaatactggagctcccctcggtggcggccgctctagactagtggatcccccgggctgcaggaattcgtctcaccccctagaaaaacatcgaagcaccggcgccaatgaagacttgaagagggctaaaacgaaaaagatgccaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtccaagaagtcggggcttctcttcgagcggcggctcattcgagcgctacattgaaggaccatgggcaagtgcccccatcacccaagggatgaagccttacctaggggatggatattcggtggcccggtgcaaataaccaaacaaaaggttcgcgtggaagccccacaaggccctttttgccaagggccgggcaaaagccatttttccccagaggaacctccccttttgggggggaattcttttttccaaaaaataacccaaaggttggggggaaatatggcccttcccttccaaagggagccctttttttccccaaaaaattttattgtttgggcccttttttgtggggagaaaggcacaaacccaaaagcccctttaaacccccacccccagaggccatgggggaaccccaaagggaaaccacctttataaggttcccaagtgtgcaaacctctcctatccccaagggcatattggtaacgccccttgtgccctctgtgccccgggggttttttattatacgcccaaagggggttggaaaaggaaagagggaaaaagaaagaattgtaaagggcccttaagaaggccaccctttttgtggggcccccaaacgccgttaaaagaaacagagaattcccacaccattccatagttgtgcaagggagaacttggctcccctggacgagcgtggttgttttc

SEQ ID NO: 92374 - DNA, 844 bp, Zea mays
  misc_feature: Ceres CLONE 1581061
  misc_feature: Encodes the peptide sequence at SEQ ID NO. 92375
  misc_feature (177)..(177): n is a, c, t, g, unknown, or other
  misc_feature (178)..(178): n is a, c, t, g, unknown, or other
  misc_feature (194)..(194): n is a, c, t, g, unknown, or other
  misc_feature (710)..(710): n is a, c, t, g, unknown, or other
ggagctccccgcggtggcggccgctctagaactagtggatcccccgggctgcaggaattcgtctcacccctagaaaattcccacctcccccacccgctgtgttcatccatcgaccgcgcgagccctcgcccgccgattcgacgacgtttgattttttcatttgatttgattgtaacnntaccgcagcaggaggnagggagggattcttggaccgtcgttcggctggatggtggaggcggttcgtcgacttgagagctccgggtttcttggacctgcgtaggtaaaagcaccaccccccatttcctctcggctggcggatggacgcgagggaggtgtgaagcctggtcgctaactgatgctcgtggagcgattcggaggagaggagcgcgccgtgcggaggcggtggaggaggaagcgccgaagatttggacagagaagcgacggaaggggagcagcaggcggacgaggagcgagccgccaggaggacgacggccgccgccgccgccgccgccatgggcgagtcgctgctcaccgcgctctccatggacaccgccacggcccaccatccacaccagggccccttcaccttcctctccatggacaccgcctcccacgaccacttcgacctcttcctcccgccacaggggcccttccgccgctgcctacatgcccgcggcggtcgccccccctgacatcaacctccccctcancgccgaaaccgtctcgccccctccggcgtcgcacgacgccaacgttgacgtgctagatgccgggctcggcgccccgcagcactacgactcggaatcgcccgctgctgcccgggcctgtcttggccccagcagct

SEQ ID NO: 92375 - protein, 59 aa, Zea mays
  misc_feature: Ceres CLONE 1581061
  misc_feature (15)..(15): Xaa is any aa, unknown, or other
MPAAVAPPDINLPLXAETVSPPPASHDANVDVLDAGLGAPQHYDSESPAAARACLGPSS

SEQ ID NO: 92376 - DNA, 887 bp, Zea mays
  misc_feature: Ceres CLONE 1581063
  misc_feature: Encodes the peptide sequence at SEQ ID NO. 92377
  misc_feature (250)..(250): n is a, c, t, g, unknown, or other
  misc_feature (275)..(275): n is a, c, t, g, unknown, or other
  misc_feature (578)..(578): n is a, c, t, g, unknown, or other
ctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtcccggccgggtacntctttcaacgcgctgccgcctacgncttcttcgccggggcccagggggaactgccacccccccccgggaccgggaaaaccgggggggggaaaatccccccaaatttcccggggctgggcccctttccaaaggttccccagaaatagggcccccccttaaaaggcccccttaaaagggggcccccccccccccccccgcggggcggggggggggaaaaaaaaaaactctcccctttttttttggggggggggccccccccctctggaaaaaaaagggggggccccccctctcttgggggggggggggggggggcggtcttttccgcccnttctccaacaaaaaaacgcccccccccccccctgggggggggggggggggcgccccccccacccccaaattattttttttttttgcgcggcccccggggggggggggggggagggggaacaaaaaacccctcctctcttttttttattaacaaatctcccttttctttgttggggggggggacgcgcaagaaaaaatatcttctttttatttgggtggggggggggggtgctctctccccccccccaccccagcggagagaaaaaaaaaatttctttctcctttctctgggtgtgaggagaaaaaaaaa

SEQ ID NO: 92377 - protein, 91 aa, Zea mays
  misc_feature: Ceres CLONE 1581063
  misc_feature (48)..(48): Xaa is any aa, unknown, or other
MASRRVVSSLLRSASRLRAASPAAPRPRAPPHRPSRPGTSFNALPPTXSSPGPRGNCHPPPGPGKPGGGKSPQISRGWAPFQRFPRNRAPP

SEQ ID NO: 92378 - DNA, 1177 bp, Zea mays
  misc_feature: Ceres CLONE 1581066
  misc_feature (1)..(1): n is a, c, t, g, unknown, or other
  misc_feature (13)..(13): n is a, c, t, g, unknown, or other
  misc_feature (27)..(27): n is a, c, t, g, unknown, or other
  misc_feature (60)..(60): n is a, c, t, g, unknown, or other
  misc_feature (61)..(61): n is a, c, t, g, unknown, or other
  misc_feature (65)..(65): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (1122)..(1122): n is a, c, t, g, unknown, or other
nccggggggtggnttgttgcccccacncccgggtgccctctctaacaggggtttgtgttnnaatntnnnnctgcaagctggactccccgcggtggcggccgctctagaactagtggatcccccgggctgcaggaattcgtctcacccctagaaaaatggccagcgggtggatccagcactcctcctccccctctctgcggatcagccaccgaacccacgcgaaaccggcgtccagatcttctcccccgcggttcagatccccggacgcagccggcgccttctgacttgggttggcacagccctacaggttgctttgcgctgaggtggatctcctggcgtggagacataggcctgggtttgggagctcttctggaatccgggcggctcacagtctcgcatcagacgccagcgggctggaattactcttcatccccgcccctctggagctggcttggtcaatagcccgctttttgggcccccccccgggcatggggggggacagaaacttgagtccaccccggaggctttggggctaagtgtccccccctaagaacagaactgtgaaaggggggtccagaaccacggtgggacagggggttgcggtatttcggcggccgggggcgagagaaagacttcttacaccgcgctatttcccacagtatgttttagggatgtgtaggagataggaacaacgtacaccaaggggcgtcggcatgttggtcacccttttaggcggcaggtggtggtataatataggtagagagtttcgcctcggtatatgttgctgagggagtgggcgagcgccttcgtcgggggacaacaaaaaaaaattatacaccgagctttctttagtaattatagagtggtagatgcctaggcgctctaaggaggacacgccaccgtcgttgtgcactaaaaactaggtgaatgagaggaatattgttagagagagaaaaggggaaaaaagccgccgcgtgtaaggggtgttgagtgttgctcgtcttcacttcctgcgagcgagggtggagagggctgagtatgaaggtacgaagtataacaacgccgaccttagtataagggctggtggcttcacgcgcatagccggaggagagagaggagtcnttcttcatgtggggtcgattggtacatccccgtccattcgttcggttagttgact

SEQ ID NO: 92379 - DNA, 2024 bp, Zea mays
  misc_feature: Ceres CLONE 1581071
  misc_feature: Encodes the peptide sequence at SEQ ID NO. 92380
atccagagagacggagcagagcaggcgaagcaagcgaaagccacaaccaccgcaaaagcgaaaggcggaggagcacaaggagatgagacgataccactagactaaagcaaagccgtgggcattagagagagacacagagagaaggcgcgtggggcggccggatggcgatgcacttcggcgagatcacgacggccttcccaggcggcggcggcattgccggggcgtccacggccaggacaacgccggcggcgagcccgtaccaggcggctgttgaaattgaagagcaaatttattccccagcatttggcaacattgaggtccaggatagtcgtggttgctgcagtggtttcacaggcagtgtaacgaagttgctgttcatctttcatctgcttgctttcattgccctcacagcattcctaggcgtccaggcctcttaccaccagaaccctgcctacaagcccttctccaacttcatccctctggtatcctctgtcatagtatccacaattgctgcatgcttctgggttatccttgctgtcacaaacccgccaaaagccatcaagacctctctctgggctgcccctgtttctgcacttgcttgtgatgtagtcatacttcttgttggcaatactgctgcacttggtattggagcgcttgtagttgtatttgcaattgcagcaggattatacagttgttgggccactggcccacgtctcaagcatgcctctgatatgctttccgtttctgtcatcggtgcacatttaccgcctgctacttcatgccttgttgtctatgtccttcttgcaacgtttgggtatatggccttctggacagttgccatcagctgcattgctgctgcagaagggcacttcatggactaccggatggcttatgtggcagcacttctagtgagcatggcatggacaatgcaggtgctgagatacattgtctatgtggcagtggcaaaactggcacatggacgtctcacctatgggattcacgtcctgggcggtgctgtggaagcattctgtgacacgatatttggaccagcctttggggacatatgcatgggtgcaatggctgtgccggtgaactcagcggtgcggggattggctcgagcaatgaaaacggcggctgggggcaacgacgagttcattttgtcaggacagggctgctgctttgctgtatcagagaagatgctgggacgtgctaaccgttggggttttgtgcacgtgggggcgcgggggaaggcattctgtgtggcttcgcgggatgtgtggtcgctttttgttctccgtgggattgcagagcttgttgattcagacctcactggttcgttttgcttcctttcttccgttacatcaggcgcattggcctcattggtttctggatcatgggcactagccatggataaggatcagaagaaactagctttgcccatatccatctatgcgttcctgatcggttattatatgtgccggatgatgatcgcatggccgcaagcatgtgtggctgcgtaccatgtcgcatatgcagagaacccgcagaaccctcagctgggcacgctgataccagaacatctgcgcgagctccaagcaatggctgcagatcaagatcgtcccagagttatccatttttctgatgacattgacaattcatagatccttccattctttcagtcttttcccccctgacccaagagggtagacacctcggcagcagacgtagacggtagacacgtcgttgcagtcttccagatgcatgatgatgggtgttgagtgttgactgctcctgggctgcttgctggtgcagatgatagggtgtgctcagttctgtagatattgggcaagtggataactgagcaaaagaagtggttagatgtcgtataggtacagagtttagcaaagtaaacaaaaatgtagaattaaatacattgttttcagaatttcccggaggcgtgttcttgccctcgcactgacacggaacgctggtgcgattcctgtgccttttcaaaaaaaaaaaaa

SEQ ID NO: 92380 - protein, 499 aa, Zea mays
  misc_feature: Ceres CLONE 1581071
  misc_feature (125)..(489): Pfam Name: DUF580 Pfam Description: Protein of unknown function, DUF580
MAMHFGEITTAFPGGGGIAGASTARTTPAASPYQAAVEIEEQIYSPAFGNIEVQDSRGCCSGFTGSVTKLLFIFHLLAFIALTAFLGVQASYHQNPAYKPFSNFIPLVSSVIVSTIAACFWVILAVTNPPKAIKTSLWAAPVSALACDVVILLVGNTAALGIGALVVVFAIAAGLYSCWATGPRLKHASDMLSVSVIGAHLPPATSCLVVYVLLATFGYMAFWTVAISCIAAAEGHFMDYRMAYVAALLVSMAWTMQVLRYIVYVAVAKLAHGRLTYGIHVLGGAVEAFCDTIFGPAFGDICMGAMAVPVNSAVRGLARAMKTAAGGNDEFILSGQGCCFAVSEKMLGRANRWGFVHVGARGKAFCVASRDVWSLFVLRGIAELVDSDLTGSFCFLSSVTSGALASLVSGSWALAMDKDQKKLALPISIYAFLIGYYMCRMMIAWPQACVAAYHVAYAENPQNPQLGTLIPEHLRELQAMAADQDRPRVIHFSDDIDNS

SEQ ID NO: 92381 - DNA, 815 bp, Zea mays
  misc_feature: Ceres CLONE 1581072
  misc_feature (346)..(346): n is a, c, t, g, unknown, or other
  misc_feature (509)..(509): n is a, c, t, g, unknown, or other
  misc_feature (510)..(510): n is a, c, t, g, unknown, or other
  misc_feature (584)..(584): n is a, c, t, g, unknown, or other
  misc_feature (601)..(601): n is a, c, t, g, unknown, or other
  misc_feature (606)..(606): n is a, c, t, g, unknown, or other
  misc_feature (609)..(609): n is a, c, t, g, unknown, or other
  misc_feature (630)..(630): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaacattccctccctagcccagccagggaaccagtctcagtgaatcccgcgcccggatcaatctcgcccaaggaagcagctcttcacgacttgcttccagatccatccatccatccatccatccatccgaggttgggccgtgggggtgtcggtgcggtgggaaatggggaaggggatcagcggcgacgcccgcctcgccgcggcgccttacgaaaccagtgggggtgccctggcctttaaaaccccccccccccggggggggggttttttttccngggcccccccccccccccggggggggggggggtttaaaaaaaaaaaaagggggtgcgccccccccacaaaggggggggggttttttaaaaaaaaaaaaaaaaattctggcccccccttttttttttttttctggggggggggagagggggggttctcattttnntttttcccccaccgcgcgggtttttttttttttttttttttttttttttaaaaaaaaaaaaaaaaaccacaccnccaggggttgggcgggnggggnggngtttttttttttttttttttnnaaaaaaaaaaaaaaaaaaacaaaaaacccccctcccccctctggggggtggggggggggggggataacaccccccccccccccccccggggggggggggggggaaaaggaaaaaaaaaaacccccccccccccccccaaaaaataataaaaaaaataaaacccccccccgcggggggggggggt

SEQ ID NO: 92382 - DNA, 847 bp, Zea mays
  misc_feature: Ceres CLONE 1581073
  misc_feature: Encodes the peptide sequence at SEQ ID NO. 92383
  misc_feature (214)..(214): n is a, c, t, g, unknown, or other
  misc_feature (217)..(217): n is a, c, t, g, unknown, or other
tggagctccccgcggtggcggccgctctagaactagtggatcccccgggctgcaggaattcgtctcacccctagaaaaaacctctcactaccaccaccactgccccggatccataccagctgcagcagcagcgcgcgcgagctagcttcggtcggtcgatagatcgatcgatcgctcggccatcatggcgcgggaggagcaggcgctgctgtcnacngagatcgtgaaccgccgcgtggagccgtcgggcccggacgccggctcgcgggcttctcggtgcgcgtgcgccgcccctgccggactttctggagtcgggggaactcaagtacgtgcccctcgggaaccctacctccatccccccgggggtgggccgggcccccattccccggttattggggggggggtggggggcccaaaattgggcacccctccccccccaaaaaagttgggcccccaaggggggggggggggggccccctttaaccccccccccccgggggttgccttttcttcggggggtctgccatttataaaaatttggggggaaaaaaaaggaggccaggcccacgggcccgggttcttctcccagcgaattctccgagtggaaaaacggcggggggaaaaaaaatccaggggggttcccaggggagatattttctcccccccgggggaggagtattggggggggtattttatagaagaagaacccccgcgggggtatacaccggcggcccggggggcagagtaaggcggtggttttaacgaaaaaaaataaggtgccccgccgcccgcggggggtggaaaaaaaaataggggacgggtgggggctttaagagggggggggggg

SEQ ID NO: 92383 - protein, 187 aa, Zea mays
  misc_feature: Ceres CLONE 1581073
MAREEQALLSTEIVNRRVEPSGPDAGSRASRCACAAPAGLSGVGGTQVRAPREPYLHPPGGGPGPHSPVIGGGVGGPKLGTPPPPKKLGPQGGGGGAPFNPPPPGVAFSSGGLPFIKIWGEKKGGQAHGPGFFSQRILRVEKRRGEKKSRGVPRGDIFSPPGEEYWGGYFIEEEPPRGYTPAARGAE

SEQ ID NO: 92384 - DNA, 845 bp, Zea mays
  misc_feature: Ceres CLONE 1581075
  misc_feature: Encodes the peptide sequence at SEQ ID NO. 92385
  misc_feature (668)..(668): n is a, c, t, g, unknown, or other
ggagctccccgcggtggcggccgctctagaactagtggatcccccgggctgcaggaattcgtctcacccctagaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagggatcgagagagaaagaaagggagggcatccaccagccggcggcgataagaggggaggagagagaggccagagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatagaccccaccgtcgagcgcttgaagagcgggttccagaagttcaagaccgaggtctatgacaagaagccggagctgttcgagcctctcaagtccggccagagccccaggtacatggtgttcgcctgctccgactcccgcgtgtngccgtcggtgaccctgggcctgcagcccggcgaagcctttcacgtccgcaacatcgcctccatggtcccaccctacgaccagatcaagtacgccggcacaggttccgccatcgagtacgcccgtgtgcgcgctcaaagtgcaggtcatcgtggtcattggccacagctgctgcggtg

SEQ ID NO: 92385 - protein, 155 aa, Zea mays
  misc_feature: Ceres CLONE 1581075
  misc_feature (79)..(155): Pfam Name: Pro_CA Pfam Description: Carbonic anhydrase
  misc_feature: SWISSPROT Homolog: EC 4.2.1.1 Carbonate dehydratase
  misc_feature (97)..(97): Xaa is any aa, unknown, or other
MSSCLCLPKKKEGPAKEKPSTDTPTSSLLQNQKPSQPPPPPSKASSKGIDPTVERLKSGFQKFKTEVYDKKPELFEPLKSGQSPRYMVFACSDSRVXPSVTLGLQPGEAFHVRNIASMVPPYDQIKYAGTGSAIEYARVRAQSAGHRGHWPQLLR

SEQ ID NO: 92386 - DNA, 805 bp, Zea mays
  misc_feature: Ceres CLONE 1581077
  misc_feature: Encodes the peptide sequence at SEQ ID NO. 92387
  misc_feature (581)..(581): n is a, c, t, g, unknown, or other
  misc_feature (706)..(706): n is a, c, t, g, unknown, or other
  misc_feature (707)..(707): n is a, c, t, g, unknown, or other
  misc_feature (755)..(755): n is a, c, t, g, unknown, or other
ggagctccccgcggtggcggccgctctagaactagtggatcccccgggctgcaggaattcgtctcacccctagaaaaaatccccttccccagtccacggctgcacctgcacgcaccgccctaaacgtccacgcactcacgttaaggaacagagtccccgcacgcttctccgcaaccttcccagcactttcccctccgtctcccgcgcctggtctccgcctcccgcgcgcgcccgatgcagatgccgccgtcgcggccgatctgacgccatcggtcgccggccatgaggcctcgccgccgggccctcttcccgttgcacagcgcaggcgctggggcctgcggtgacccgtgggccgactgccagacaccaccgccggttcccagcactcctgattccggccctggcccttccccatcgctgcctccctatggcgatctaccgtgccctcccgttttgtcgccgtcgccgtcgcctgctcccgcgcataacggtaggaggaaccagggagggacgcagggatacggggccccacccggtgcaggcgaccacgaccgacggcacctcgtcaaatacgcgctcantcgccgccggggtgttcgccttcgtatgcctgatcctgctcggtgtctcggtggccgtgcggcgccggcaggtccggcgggaggcggcaggcgctcctcgcaccgcctacccccgaggcgcggcnnaacgtcggcggcggcggcgggcacgaacacgggtgggacagcgcagcngggggtggtgttgcaccacgtctggaaacatcggacgtggggctcgacaa

SEQ ID NO: 92387 - protein, 174 aa, Zea mays
  misc_feature: Ceres CLONE 1581077
  misc_feature (100)..(100): Xaa is any aa, unknown, or other
  misc_feature (142)..(142): Xaa is any aa, unknown, or other
  misc_feature (158)..(158): Xaa is any aa, unknown, or other
MRPRRRALFPLHSAGAGACGDPWADCQTPPPVPSTPDSGPGPSPSLPPYGDLPCPPVLSPSPSPAPAHNGRRNQGGTQGYGAPPGAGDHDRRHLVKYALXRRRGVRLRMPDPARCLGGRAAPAGPAGGGRRSSHRLPPRRGXTSAAAAGTNTGGTAQXGVVLHHVWKHRTWGST

SEQ ID NO: 92388 - DNA, 854 bp, Zea mays
  misc_feature: Ceres CLONE 1581078
  misc_feature: Encodes the peptide sequence at SEQ ID NO. 92389
tggcggccgctctagaactagtggatcccccgggctgcaggaattcgtctcacccctagaaaaagtatcagtccccgccggcttccgtccccaattactcgctcaaaccctagccccaccgcgcgaatggccgatgtgcttgacccggcctccgacgcgccgcgcgcgcgccgtccgccgccacctcccccggatagcccggaggaccgctcgccgcagctgcccccgcctccacccgggggccccccggcggcgagccggaagcggagtcgctctccgccgccgccgccgccgcctccgctgggttcgtcccggccccaaaggtatcgggaccaccgcagcggcggaggggcggggcgggagcagccccagcccgccgccgtaccggggcagccgccgccactcgccgtccaggagatccccgtcgccgccattcaagcggtcgcggagggacgacgggtacgaccgccgcgggggccgcgggagcccgccgcgttacgggtacgatgataggaggcgaggttatgaccatgagcgaggtggcggcagaggtgggtatgaagatgacaggaaccagggcagatatctgaaccgtgctccagattggcctgaattcggggtacggagcggccaatgatggtccaggggtcacccaaaagggaaggtttgatgacatacaaacagttcatgcaagtttcttgaggatgatattttcccccagtgaagcttgaccgccgggtaccaggagttttagaactggagtattatcacttactcagaaaacgcgggctttattttgggatctcccacaagaaaatggaaaaaattggggtttaaaaggaccaagttacccc

SEQ ID NO: 92389 - protein, 167 aa, Zea mays
  misc_feature: Ceres CLONE 1581078
MCLTRPPTRRARAVRRHLPRIARRTARRSCPRLHPGAPRRRAGSGVALRRRRRRLRWVRPGPKGIGTTAAAEGRGGSSPSPPPYRGSRRHSPSRRSPSPPFKRSRRDDGYDRRGGRGSPPRYGYDDRRRGYDHERGGGRGGYEDDRNQGRYLNRAPDWPEFGVRSGQ

SEQ ID NO: 92390 - DNA, 822 bp, Zea mays
  misc_feature: Ceres CLONE 1581080
  misc_feature: Encodes the peptide sequence at SEQ ID NO. 92391
  misc_feature (565)..(565): n is a, c, t, g, unknown, or other
  misc_feature (567)..(567): n is a, c, t, g, unknown, or other
  misc_feature (583)..(583): n is a, c, t, g, unknown, or other
  misc_feature (700)..(700): n is a, c, t, g, unknown, or other
ctccccgcggtggcggccgctctagaactagtggatcccccgggctgcaggaattcgtctcacccctagaaaaaagcccaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcgctccgcgccatgtgcggcgcgctcatcccctcgctgcccgccgacgccgacgccggccgcggcgacccgcccggcggcaaggacctcgagcgcttctacctcgcctccgcggccgactccaccatccccgacgaggtcgcggagctgatggtgacgcggtgcatccncnaggcggtggcgctggncgtgggtggtgcttttgggcgctgagcacgcgggcgggcacgctgctgctgtgcggccggctcagcctcggcgccggctttccctacgtgcgcagggttcgccacatggcgccggancggcgggaggcggccctgcggcgctgggaaccgggtgcgctgggctctcccgcttcgcatcgccttcgccattcgtcagatcctctggcactacttcttctacgccatgtgaaacaagactt

SEQ ID NO: 92391 - protein, 128 aa, Zea mays
  misc_feature: Ceres CLONE 1581080
  misc_feature (115)..(115): Xaa is any aa, unknown, or other
  misc_feature (116)..(116): Xaa is any aa, unknown, or other
  misc_feature (121)..(121): Xaa is any aa, unknown, or other
MAVQGGEERESGKGAAPAVVSGGEAGPPGRRTARGHPLLRGGWRRDRYTHGMRPAQMEALRAMCGALIPSLPADADAGRGDPPGGKDLERFYLASAADSTIPDEVAELMVTRCIXXAVALXVGGAFGR

SEQ ID NO: 92392 - DNA, 1242 bp, Zea mays
  misc_feature: Ceres CLONE 1581081
  misc_feature (1)..(1): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (120)..(120): n is a, c, t, g, unknown, or other
  misc_feature (778)..(778): n is a, c, t, g, unknown, or other
  misc_feature (792)..(792): n is a, c, t, g, unknown, or other
  misc_feature (1044)..(1044): n is a, c, t, g, unknown, or other
  misc_feature (1075)..(1075): n is a, c, t, g, unknown, or other
  misc_feature (1116)..(1116): n is a, c, t, g, unknown, or other
nttgttgggtgcncnnncaaagggaaggtaacaacacctattaatgagggagaggnnnnnngnnnnnnccaagctggagctccccgcggtggcggccgctctagaactagtggatccccncgggctgcaggaattcgtctcacccctagaaaaaaagtgcgctccctctctcgccatccatctcgtgcacgactgggcaaccgttgccgctgtcgaggtgcccaggtcttcatcggtccctcgtcagttcttctccggcccttcgccgccgacaagctccgccaggttgctgtgttaagtcccagcttatcacatggattcaacacaagattttcaacccaggacattttctataaagttgtggcccaccaagtgaaaagcacaccggctcatggcttggtgaggaggatgaccaagaactatggtcgccagaagtccctttttccccgccccaaagattggggccttttgggcgaaggcgggaggggtgccccccccccccccgaaaagggggttttggaaaaacttttgtctttttgcccaaggggttgaatgagacctttttcaaaaaaatggaacccccatatggggggaattggggagaaatttctgtgccttggtccccgggtgatgatggccaaaaaggagaaaataccaggcctccaaaagaagtgatgtgtggggaagaaatgttctcccacagaaaaaaaaatgggccccccgcaagggaggatactacctctcgccccggataaatagtcgcagagaggagcccccncccccctctgctcnaaagatcagattaagcactccgctccaccctctttctgtgtggccctgccccgcccccgaagtatctctctcaccactcccccccgcggtggggtgtgtgtctgctccaaaaataaatacaacccccgtaaccctcagcagaggaagatataatcttcgttgcgtgtggcggggggagaacaacaccgcctcgccttttcttcttcgtcgtgccgggagggccctactgatgtagttcacgacaaagagagngaggctactatcgcgtgtccattgagaatanacgacggatgttgtgctcggtaagagaacagagcggatggngtgttttctccaccttcgtgaaaaaagaaataagatggtggggtggttttttgtagaagtccacagcagagccagctatcgtttatcgataaatatgtaatgcggctccgccctacgatcgaatgt

SEQ ID NO: 92393 - DNA, 779 bp, Zea mays
  misc_feature: Ceres CLONE 1581082
  misc_feature: Encodes the peptide sequence at SEQ ID NO. 92394
  misc_feature (586)..(586): n is a, c, t, g, unknown, or other
  misc_feature (694)..(694): n is a, c, t, g, unknown, or other
tccccgcggtggcggccgctctagaactagtggatcccccgggctgcaggaattcgtctcacccctagaaaaacctctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtccatgattggccagttcggcgtcggtttctactctgcctacctcgtcgccgatagagttgtcgtgaccaccaagcacaacgatgacgagcagtancgtgtgggagtcccaaagcgggcgggtcgttcactggtactcgtgacacgtcaggggagcagcttggcaggggcactaagatcacactggtccttaaagacgatcagnctggagtacctttgaggagcgtcgcctcaagggatctgggtcagaagccactctgagttcatcagctaccccccatctccttggg

SEQ ID NO: 92394 - protein, 188 aa, Zea mays
  misc_feature: Ceres CLONE 1581082
  misc_feature (28)..(167): Pfam Name: HATPase_c Pfam Description: Histidine kinase-, DNA gyrase B-, and HSP90-like ATPase
  misc_feature (148)..(148): Xaa is any aa, unknown, or other
  misc_feature (184)..(184): Xaa is any aa, unknown, or other
MASETETFAFQAEINQLLSLIINTFYSNKEIFLRELISNSSDALDKIRFESLTDKSKLDAQPELFIHLVPDKATNTLSIIDSGIGMTKSDLVNNLGTIARSGTKEFMEALAAGADVSMIGQFGVGFYSAYLVADRVVVTTKHNDDEQXRVGVPKRAGRSLVLVTRQGSSLAGALRSHWSLKTIXLEYL

SEQ ID NO: 92395 - DNA, 1027 bp, Zea mays
  misc_feature: Ceres CLONE 1581089
  misc_feature (259)..(259): n is a, c, t, g, unknown, or other
  misc_feature (260)..(260): n is a, c, t, g, unknown, or other
  misc_feature (266)..(266): n is a, c, t, g, unknown, or other
  misc_feature (268)..(268): n is a, c, t, g, unknown, or other
  misc_feature (322)..(322): n is a, c, t, g, unknown, or other
  misc_feature (334)..(334): n is a, c, t, g, unknown, or other
  misc_feature (1027)..(1027): n is a, c, t, g, unknown, or other
ccccgcggtggcggccgctctagaactagtggatcccccgggctgcaggaattcgtctcacccctagaaaaaccagcagtacccactcacgagaccgtccaggcgtccaccgcgacgcgctctcctgcccgtgcccacctccacgactccacctccgcagcgcccgcggtaacctccccacgccacgccacatcgcgtgcgagccccaaccgtcgccggcctcccaattaagccgcccccgcggcgcgatccggtgtcnncaccgncntgcctccgccggaggaagggggaaggggaagaaaaggggagggggggagcacanggggatgctagnagggaagccggcgttgccgggctccggcgcggcccggggcggcggcgcacaatccacagggtcaaccggaaaggttgggacgggcgcccactaccgggcctacgggtcttgcgtaatcggtcggatcccctattagggggggaaaggaaattctgctttttaccatccctctgccaaggcgcccgagatacccccctccttatattaatcgcgcataccaccttccaggagggggggtcaatggcgcaataacactttgtttatccgttttagaaaaaaaaagaggtttgtggcgccacggcgaggaagggggggggcggcaaacgcgagaggcgcgccacacaccctctcccgaggcggtggcgaatattactcatatgaaagagatgccccctcgcagtttatacaccttggcggaaccgagatgggggtgggaataagagaagcaaccgtgccggtggtggcacgctagaagaagagggtgagggaggggcgggataagtacacgccgcgtgcggagaagagagaaacaacactactagttgaggagacgaggaacaataatcatctcgcacgagaggaggtctgtgagtagcctgcgagtatcttgttcggagattggcggctaatattatgcgaggtggttctatggtatttgagatagtcgcataattaggagggctcaggtaaagn

SEQ ID NO: 92396 - DNA, 820 bp, Zea mays
  misc_feature: Ceres CLONE 1581094
  misc_feature: Encodes the peptide sequence at SEQ ID NO. 92397
  misc_feature (575)..(575): n is a, c, t, g, unknown, or other
  misc_feature (592)..(592): n is a, c, t, g, unknown, or other
  misc_feature (741)..(741): n is a, c, t, g, unknown, or other
ctccccgcggtggcggccgctctagaactagtggatcccccgggctgcaggaattcgtctcacccctagaaaaaaaatggcgtagcctttctctatgacacgtgccccttcccccctcttaagctaagggacccttgggcagcccggcatcttctccaccctctgcccctctcgatttcttcttcccatctcccgatccatcgcaacccaaaccctactccaggcagatctccgtctccgccgccgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccgtatgaccgcatcgccgaagccgtcaacgccaggctccggcggctcgagcacccagacccgcgcttcctccgctacgccagccccgtgccgtcccacgcggaacacatgggcatccttgcggcgccagagacccgggtcnacacactgcccaacggnctgcgcatcgccacggagtcttccctcggcgcgcgcacggctacggtcggcgtgtggatcgatgcgggcagcaggtacgagaacgaggaggccgtcggcgtcccgcattttgtccagcacatgctgttcaagggcacgggggagcgcancgcgccccactggagctggaaaatcaagaactggtgggccaccttaatgcgtacccgtcccgggaagcagacgactaac

SEQ ID NO: 92397 - protein, 180 aa, Zea mays
  misc_feature: Ceres CLONE 1581094
  misc_feature: SWISSPROT Homolog: EC 3.4.24.64 Mitochondrial processing peptidase
  misc_feature (99)..(99): Xaa is any aa, unknown, or other
  misc_feature (154)..(154): Xaa is any aa, unknown, or other
MAFRRILSTAVRRRSAVAAAAAGNAREASTAVAAAPGVLAPDATAVRAPVMPYDRIAEAVNARLRRLEHPDPRFLRYASPVPSHAEHMGILAAPETRVXTLPNGLRIATESSLGARTATVGVWIDAGSRYENEEAVGVPHFVQHMLFKGTGERXAPHWSWKIKNWWATLMRTRPGKQTTN

SEQ ID NO: 92398 - DNA, 852 bp, Zea mays
  misc_feature: Ceres CLONE 1581097
  misc_feature: Encodes the peptide sequence at SEQ ID NO. 92399
tggagctccccgcggtggcggccgctctagaactagtggatcccccgggctgcaggaattcgtctcacccctagaaaaaaaaacgccccacagcgcaagcgagcagatcctcctccctttctgcttcctggcatcctctctgcctccccgcgccgatctcgagcacctggggagaccgcgagacgtgcgcctgatttttctcatcgcagcagccctcaagttccccacctcttttttcttgcagctttcaattaatctggttatttagctacatctttattttactttcattttacctttaatctgtttagttccattgcatcttctgcggttgcggttagtattgctgtttcttgctccttgtttcttgttcttttgcttctaaccatggacgcaggaacctactccatctcatcagagaagagccacacggcggcagcggcgcggccccctcttcaggaggccggcactcggccctacatgccgtcgctgagcacaggatcgcgcaacccgtcggccaagtgctacggcgataggttcatcccggacaggtcggcgatggatatggacatggcgcactacctgctcacggagcccaggagggacaaggagaacgcggtggcagcgtccccatccaagggagcgtaccgggagctgctcgccgagaagttgctcaacaacggacacgcatccttgccctcaggaaacagcccgcctgtgtctgagaacgtctcggcagccatcacagcttcctctcaccatggccagctgggtcaagcagcgtcgacatatttccccagtctggcagagaggaactctggacggcaccagagcttggttgacgactaccat

SEQ ID NO: 92399 - protein, 155 aa, Zea mays
  misc_feature: Ceres CLONE 1581097
MDAGTYSISSEKSHTAAAARPPLQEAGTRPYMPSLSTGSRNPSAKCYGDRFIPDRSAMDMDMAHYLLTEPRRDKENAVAASPSKGAYRELLAEKLLNNGHASLPSGNSPPVSENVSAAITASSHHGQLGQAASTYFPSLAERNSGRHQSLVDDYH

SEQ ID NO: 92400 - DNA, 858 bp, Zea mays
  misc_feature: Ceres CLONE 1581098
  misc_feature: Encodes the peptide sequence at SEQ ID NO. 92401
  misc_feature (772)..(772): n is a, c, t, g, unknown, or other
  misc_feature (809)..(809): n is a, c, t, g, unknown, or other
  misc_feature (836)..(836): n is a, c, t, g, unknown, or other
  misc_feature (844)..(844): n is a, c, t, g, unknown, or other
  misc_feature (845)..(845): n is a, c, t, g, unknown, or other
agctccccgcggtggcggccgctctagaactagtggatcccccgggctgcaggaattcgtctcacccctagaaaaagcgcccgccgcccgcgtgctcctccctcgcgcccgccccgccccgctccgcccctatctatatccattcccgctcgtccccctcaacaaccctcctcaccgcgcactcgtgttcgtgtcatcccgcccgcaggccgcagtccatggccaccgccagcctcgcgctctcgctgcgcctcgcgccgtcctcgcgcccgctgagcctccgccgccggggggccgccggcgtcacctgccgcgccaccaccgccacgttccaccagctcgacgccgtcgcggtgaagggaggaggagtccaggttccggacggcggcggcggagggccgcaacctgctgccgctcacgaggtgcatcttctccgatcacctcacgcccgtgctagcgtaccgctgtctcgttaaggaggacgaacgcgatgcgcccagctttctcttcgagtctgtcgagcaggggtccgagggcaccaatgtggggaggtacagcgtggtcggggcgcagccttctatggaggtcgtggccaaggctaaccatgtgacggtcatggaccatgagatgaagtcgaggagggagcacttcgtgcctgatcccatgaggatccccaggacaatcatggagcagtggaacccgcagattgctgacagcctccctgatgcattttgtggagggattgggttggaatttctctcatatgatacangtgcgttatgttgaaacaaaagagcttcctttcagtnagggcacacatgacgataggaaccttncctgacanntcattaggcctct

SEQ ID NO: 92401 - protein, 68 aa, Zea mays
  misc_feature: Ceres CLONE 1581098
  misc_feature: SWISSPROT Homolog: EC 4.1.3.27 Anthranilate synthase
  misc_feature (65)..(65): Xaa is any aa, unknown, or other
MEVVAKANHVTVMDHEMKSRREHFVPDPMRIPRTIMEQWNPQIADSLPDAFCGGIGLEFLSYDTXALC

SEQ ID NO: 92402 - DNA, 824 bp, Zea mays
  misc_feature: Ceres CLONE 1581099
  misc_feature: Translation starting site: 322
  misc_feature: SWISSPROT Homolog: EC 2.3.3.1 Citrate (Si)-synthase
ctccccgcggtggcggccgctctagaactagtggatcccccgggctgcaggaattcgtctcacccctagaaaaaaggacgacgaccggtcccattctcccccgccccaacttgtcaggactcaagaggctcccctcctccctcgccgcggaacacgcgtcgccgtcgtcgccagcccgggttcatttctccgttccttggtgcgggggtagcctagcgctccggccatggcgttctatacggggcctcaccgcactctcgagactgcgatcacgcatggcgcacgaggccaccacggctggggggtgtgaggtggctgcacatgcagagcgcgtccgatctcgatcttaagtcccaggtgcgagaattgattccggaacgacacgatcgcttaaagaagctcaagtcacgagcatggaaagacctagcttggacacataactgtggatatggtccttggtagaatgagaggtatgactggtatgctttggaaacatccctacttgatcgagagcaggtattcgctttagggggctatcactcgcagaatgcaaaaaatgctgccaacatgcagtaatggccgccgacccatgcctgaaggcctcctttggcctcatttgacgaggaaagtcctaaccggacgagcaaatttatagtcttttcaaaggaaattgcttgggggaaaaaaacggttcccaagtggaggggttattattgaaaaaaaaagggttctcccccgaaaaaagggccctttcccaagggaaaaaagggttaaaccccggggggaaaaaggggggctttccccggggtgggaaaaagggaaat

SEQ ID NO: 92403 - DNA, 831 bp, Zea mays
  misc_feature: Ceres CLONE 1581100
  misc_feature: Encodes the peptide sequence at SEQ ID NO. 92404
ggagctccccgcggtggcggccgctctagaactagtggatcccccgggctgcaggaattcgtctcacccctagaaaaagcgatccagatccaggtacgtcttcctccagccccgcgatttcacctccacccccgcttctcctgcggcaatccatcgctcgcgtcgtccctactgggtgacaagagggcgaccacgcccacctccacactcttcgacctgtccccagcctgccgctgcattttctctatcttccgtccggctatttttttgctgaatggttgttcagcatgggtctggtgaaggaaggcgtcgacatggaggagggaaccctagagatcggcatggagtacaggactgtatctggtgtggccgggcctctggttatcttggataaagtaaagggcccaaagtaccaagaaattgtaaacatccgacttggagatggcaccactcgccgtggtcaagtccttgaagttgatggagaaaaagctgttgtgcaggtttttgaaggaacttctggaatagacaacaaatacacaaccgtgcagtttacaggcgaggttttgaaaactcctgtctcactcgatatgcttgggcgcatttttaatggttctggaaaacctattgacaatggccccccgatattacctgaagcctacttggatatctctggaagttctattaatcccagtgagagaacctatccagaggagatgatccaaactgggatatccaccattgatgtgatgaactccattgctcgtgggcaaaaaatccccctattttctgctgctggactccctcacaatgaaattgctgctcagatctgtc

SEQ ID NO: 92404 - protein, 181 aa, Zea mays
  misc_feature: Ceres CLONE 1581100
  misc_feature (24)..(90): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MGLVKEGVDMEEGTLEIGMEYRTVSGVAGPLVILDKVKGPKYQEIVNIRLGDGTTRRGQVLEVDGEKAVVQVFEGTSGIDNKYTTVQFTGEVLKTPVSLDMLGRIFNGSGKPIDNGPPILPEAYLDISGSSINPSERTYPEEMIQTGISTIDVMNSIARGQKIPLFSAAGLPHNEIAAQIC

SEQ ID NO: 92405 - DNA, 839 bp, Zea mays
  misc_feature: Ceres CLONE 1581103
  misc_feature: Encodes the peptide sequence at SEQ ID NO. 92406
  misc_feature (365)..(365): n is a, c, t, g, unknown, or other
  misc_feature (506)..(506): n is a, c, t, g, unknown, or other
  misc_feature (516)..(516): n is a, c, t, g, unknown, or other
  misc_feature (538)..(538): n is a, c, t, g, unknown, or other
ggagctccccgcggtggcggccgctctagaactagtggatcccccgggctgcaggaattcgtctcacccctagaaaaaatgcgccaccataaagcccggcgcctgtgtcgtgtgagggagcgtctgagctcgccagaaaagaccctgacagtccgacacccgcaagccacaaagtgcagcctcgttgctacaggaatgctgagaaatgtctgaccttgccggaaagcgcaacctgcgcagtggccgcaactgccaccgcaagcacgtcgaggacgggtaggttcatcggtctcgtcgccgggttttcaggtaaagtcaggtcaggccaactctgtcgaagaaggaacatcgaagaaaggaaggangtgggcggcaatggaggatgcgatggcggcggacgggaagagcgtgctgcaggggcggtacgagctgggggcgggtgctggggcacggcaacttcgggcgggtgcacgcggcgcgggacctgcgcacggggcgcagcgtcncggtcaaggntggtggccaagacaagcttgancgcgcggggcatggcggaacaaatcaaagcgggagatcgccgtcaggaaggatggtgtcccaaccccaacatcgtggagctgccccaaggtgaatgcccaccccgctcacaagaatcaacttgcggcttcgagctcgttcgcgggggggggaagtccttttcccgcattcccgcgccccgggggcgggttccgggaagggacctggcccccttttttactttccgggaagctcgttccccccggggtcgactttctgccacgggccccggggggttgtttcccccccaaaaccttgaaagc

SEQ ID NO: 92406 - protein, 82 aa, Zea mays
  misc_feature: Ceres CLONE 1581103
  misc_feature: SWISSPROT Homolog: EC 2.7.11.1 Non-specific serine/threonine protein kinase
  misc_feature (42)..(42): Xaa is any aa, unknown, or other
  misc_feature (45)..(45): Xaa is any aa, unknown, or other
  misc_feature (52)..(52): Xaa is any aa, unknown, or other
MRWRRTGRACCRGGTSWGRVLGHGNFGRVHAARDLRTGRSVXVKXGGQDKLXRAGHGGTNQSGRSPSGRMVSQPQHRGAAPR

SEQ ID NO: 92407 - DNA, 853 bp, Zea mays
  misc_feature: Ceres CLONE 1581104
  misc_feature: Encodes the peptide sequence at SEQ ID NO. 92408
  misc_feature (798)..(798): n is a, c, t, g, unknown, or other
ctccccgcggtggcggccgctctagaactagtggatcccccgggctgcaggaattcgtctcacccctagaaaaaacatcacagtgcgggcggcgggcgccactctcacacctaccaggaaaccaatcaaaacttaaaaccaatcgaaattagaccggcgacgaggattagcgctcgccggcgatggattctgactacggcgtgcctcgcgagctctcggaggtgcagaagaagcgcacgctctaccagcccgagctgcccccctgcctccagcaatgatgatggaccatcttcctgtactcatggatcctaacttaggactcggtagtcgctatcaaattgaccttctcatgtctggaatcacttttgaactctttcatgtctggaatcacttttgaactcttctcatgtctggaatcacttttgaactcttctcatgtctcgaatcacttttgaactctttcatgtctggaatcacttttgaactcttctcatgtctggaatcacttttgaactcttctcatgtctggaatcacttttgaactcgtctatatggctactctcaataattttctgcgtcaaattgacttctcttgtatttgggtccttgggggcaccactttttaactggttcctagatgggaagagcttccaatagatttccagaacaaatttattgtggttttctgactttctgttagagttagcgtccttttcttgtgtttggggccttggggcacttctttaactggttcttatacagggagagttgtcaatagatttccagaacaggatttcntgtgtgttttctggtagagttagctcagtcacacactagggaagtaggaatgtat

SEQ ID NO: 92408 - protein, 31 aa, Zea mays
  misc_feature: Ceres CLONE 1581104
  misc_feature: SWISSPROT Homolog: EC 2.7.1.90 Diphosphate--fructose-6-phosphate 1-phosphotransferase
MDSDYGVPRELSEVQKKRTLYQPELPPCLQQ

SEQ ID NO: 92409 - DNA, 868 bp, Zea mays
  misc_feature: Ceres CLONE 1581106
  misc_feature: Translation starting site: 274
  misc_feature: SWISSPROT Homolog: EC 2.7.9.1 Pyruvate, phosphate dikinase
gcggtggcggccgctctagaactagtggatcccccgggctgcaggaattcgtctcacccctagaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaaagagggtgttccacttcggcaagggcaagagcgagggcaacaaagaccatgaaggaactgctgggcggcaagggcgcgaacctggcggagatggcgagcatcgggctgtcggtgccgccaggggttcacggtgtcgacggaggcgtgccagcagtacccgggaccccgggggcgcccctccccgcgggggctctggggccgaagatcctcgaacggccctgcaagggggttggagggagttccatggggcgcccacccctggggcgaatcggcaaagggccccgccttcctggcttcttccggtcccggcttccggggaggccgggccgcggtttcccatgccccccgggcaagtgaatggggacaaacggg

SEQ ID NO: 92410 - DNA, 845 bp, Zea mays
  misc_feature: Ceres CLONE 1581108
  misc_feature: Encodes the peptide sequence at SEQ ID NO. 92411
  misc_feature (617)..(617): n is a, c, t, g, unknown, or other
ctccccgcggtggcggccgctctagaactagtggatcccccgggctgcaggaattcgtctcacccctagaaaaatccctcgcctatccgctcggccgttggcgctcaccaaaaccacccagaagcctccgcttgaccgcttcactcgctttccgcccgccgcgccatgagcgccgccgcctgcctgttcgctgccgccgtctccctatcattcccgtcgacctccgcaccctcttccgcaagacgccgccgcctccggagccccaccaccctcctccgctgctccccgactcgccgccgtgggccggtccggcggacactcgacgagcggctgctcgaggccgcgccggcggagaccgaagacgtccaaaccgctgttgatgtagaggatggaggagggatcgctgagggcgatgaagtgggaacagaggagatggaggagctggagcagcgaccgccgacgagggctttcgtgaagagcaggcggcagcggcaggaagaggaggaagccgcggcggggcaagaccggttcaagctcatcaatggcaaagagatatttcaagagaaggcttatctggttgggtgttgagtgcaaacggacaggagggaacctgttcngcatagaggagtcccttaaggagctggagcagttggctgatacggcgggccttcctggtagtcgggtcaacctatcagaaagcttctaccccaaatcaagggcttacattgggtcagggaaaggttctgaaatcaggactgccatccaagcacttgatgttgaaactggaaatttaggccatgaggtatcccctggaacacctacctaacctggaaaagtctttttgg

SEQ ID NO: 92411 - protein, 140 aa, Zea mays
  misc_feature: Ceres CLONE 1581108
MSAAACLFAAAVSLSFPSTSAPSSARRRRLRSPTTLLRCSPTRRRGPVRRTLDERLLEAAPAETEDVQTAVDVEDGGGIAEGDEVGTEEMEELEQRPPTRAFVKSRRQRQEEEEAAAGQDRFKLINGKEIFQEKAYLVGC

SEQ ID NO: 92412 - DNA, 851 bp, Zea mays
  misc_feature: Ceres CLONE 1581111
  misc_feature: SWISSPROT Homolog: EC 1.8.1.7 Glutathione-disulfide reductase
ctggagctccccgcggtggcggccgctctagaactagtggatcccccgggctgcaggaattcgtctcacccctagaaaaaggggcagagctggcaagtggcaaggctgcgcagccgcagagggactttttgtgtaaaatgcggtgggaaggtgcgctgcacctgcaagcagaggtgtgctctactgacagagtttgaactctcaagaggaggcgaggcagaaccgcaatcgcgaccgcgacccgcaggtgacatacatacggtgcgagcgccggaagccggaagcaccggtgacgaagccttccgtgtcatcactcatcaggatctcaggtgcatatttcgagcggaacagcttcgtattatttgcgccggcgaaatttctggctcgtttgtccccgcggttctgctgaggccagatttcctcctgcggcgttgaattgcgcgctcgacctagggttttgtttcgtttcgcgggcgttgggaatccatccatggcgaggaagatgctcatcgacggggaggtggcggccgtcgcggatggtgggcactatgactacgatctcttcgtcatcggggcgggcagcggcggcgttcgcggctctcgcaccgccgcctccttcggagctaaggttgcgatttgtgagctcccatttcaccccatcagctcagagtggctaggaagacatggtgggacttgcgtgatacgtggttgcgtacctaaaagatacccgtgtatggtgcatcattctggggagaatttgaggattcgaagattttggggggggaaattaccggagatattaacttcaatgggaaaacgattttggaaaataagactaaagaaattgttag

SEQ ID NO: 92413 - DNA, 834 bp, Zea mays
  misc_feature: Ceres CLONE 1581122
  misc_feature: Encodes the peptide sequence at SEQ ID NO. 92414
ctccccgcggtggcggccgctctagaactagtggatcccccgggctgcaggaattcgtctcacccctagaaaaagcgcccgccgcccgcgtgctcctccctcacgcccggcccgacacgctgcgcccctatctatatacattaccgctagtaccgctcaagaaccatcctcaccgcgcactcttgttcttgtcatcccgccggcacgccgcaatacatggtcaccgccagactcgggctctcgctgcgcctcgctccgtcctagctcccgctgagcctccgccgccggggggccgccagcgtcaactgctgcgccatcaccgacacgttgtaggagctctacgacgtctcggtgagggaggaggagtccaggaacctgaccgtcgcggcggagggcaccaacctgctggcgctgacgatgagcatcttcaccgatcacctacactccgtgctagcgtacctgtgtctcgttaaagaggatgaacgcgatgcgcccagctttctcttccaatctgtagagcatggccagagcccccccaaatggggcggaggtacagcgtggtcggggcgcagccttctatggaggtcgtggccaaggctaaccatgtgacggtcatggaccatgagatgaagtcgaggaaggagcacttcgtgcctgatcccatgaggatccccaggaacatcatggagcagtggaacccgcagattgctgacagcctccctgatgcatttgtggaagatggggtgggatcttctcatagatacagtgcgttatgttgaaacaagaagcttcctttcagtaggcacacatgacgatagaaactttctgacatta

SEQ ID NO: 92414 - protein, 79 aa, Zea mays
  misc_feature: Ceres CLONE 1581122
  misc_feature: SWISSPROT Homolog: EC 4.1.3.27 Anthranilate synthase
MGRRYSVVGAQPSMEVVAKANHVTVMDHEMKSRKEHFVPDPMRIPRNIMEQWNPQIADSLPDAFVEDGVGSSHRYSALC

SEQ ID NO: 92415 - DNA, 826 bp, Zea mays
  misc_feature: Ceres CLONE 1581124
  misc_feature: Translation starting site: 385
  misc_feature: SWISSPROT Homolog: EC 4.2.1.1 Carbonate dehydratase
  misc_feature (538)..(538): n is a, c, t, g, unknown, or other
aagctggagctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcgataagaggggaggagagagaggccggagaagaggaggaggagaagaagaagatgagcagctgcctctgccttccgaaaaaaaaggaggggccagcgaaggagaagccgtccacagatacccccacctcgtcactccttcagaaccagaagccctcccaacctccacctcctccctccaaggcttcctccaagggcatggaccccnacgtcgagcgcttgaagagcgggttccagaattcaagaacgaggtctatgacaagaagccggagctgttcgagcctctcaagtccggccagagccccaggtacatggtgttcgcctggttccgactcccggggggtgcccgtcggtgacccggggcctggaaccccggggaagggctttaaccggtcggaaaaattgcctcccatgggcccccccccttggaaaaaaataaaatttcccccgggccaagggggcccccccactccaaaaaaaccccgtgggtgcccct

SEQ ID NO: 92416 - DNA, 1147 bp, Zea mays
  misc_feature: Ceres CLONE 1581127
  misc_feature (5)..(5): n is a, c, t, g, unknown, or other
  misc_feature (15)..(15): n is a, c, t, g, unknown, or other
  misc_feature (29)..(29): n is a, c, t, g, unknown, or other
  misc_feature (61)..(61): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
ttttncccccccttncccctacccactcncaaccaacccaccaaaaacccgatatgaaganannnataannnnncccaaactggaactcaccgcggtggcggccgctctagaactagtggatcccccgggctgcaggaattcgtctcacccctagaaaaaacgcacgtcagcgcctccaccttcctccccagccgcaagcagagcaagaaccggagctggggatcgattccgcgccgcctgatctgcgatcgggactcgatcgtgcataatccgaggttcttcctctctgtcgactccgatccagacgggtgtgcctggtctgcatcttcatcctctgcaagaaatcacacatctcgtggcgcaccttgcatcagccgcggccggcacctctactctcgcccgccccctatgtcgtaagcgcgcaatcagaactcccgatcacccgcacgcttggtgcgccagtgtcgtcttcgccaccatgaactccatcgagcccttcaacaggctggtgaaagctggcggcccgcggcctttctacgaataacgtccccaatgaaagggcgaccaacccaggcccaaagaactttccccgcgggggaacaaacccgcgggcatgggccccttccgtcccaccctgggaacccccctcccccccaaaaacgaaaccggtgggggttccccaaagaggggaaaggaattttgggcctaaaaaggacaattgggaaaggcctcccccccctccgaaaaaaaactagctgtgggcaaattctccaaaatttttatccccgcgttttttctctatctggtaaaacaggggagaaaaaaaaacctttttgtccccacacagggggggatatatcattcccgtaaaagagggggatcttagcgccaaaaaaaaaatatgcctcaaaaagccgcccatataattttgttttttccaagccttttccttaaatagaccggggtctaaaaaaaatatgtttgccgccccagggaaacggggtgacaaaagagaaaatcttttaaaaaatcgccgcccccaacagttttcatacctcgcggagccccggagagaataattttccccccaaaaaaataccgcaattcctctccaaggaagaccccgactctaccccccccaagaaa

SEQ ID NO: 92417 - DNA, 1999 bp, Zea mays
  misc_feature: Ceres CLONE 1581128
  misc_feature: Encodes the peptide sequence at SEQ ID NO. 92418
accctcctctcctctgctgacccctcgtctcctggtatggattccaccaagccgtgtccaccaaccggccaccacccccgctgccggctcgcccctctctgcgccgtgctcagatttgcccccctctgcctgcctgcttctactacctgctgacacggcggtgcgggtcgtgctcggtggacgccagggggctacccctacccgggatccaggatcgtgctgtctgctcgccctctcctgctccttcaatcccatcggagatccgtgctggcgtttcctccctttcagcgcccaattgtttggtttgaagaaatcaagttcagatgggctccattctaagtgctactagtactacggctaagtctatggatcagcatgaggcatctggaacagatcctaataagagggtgaagatatctacttatgagtatgggtcaaacccaaggataattccaactcttcctgatgagctctcactccagatcctggcaaggtcaccacggatccattaccttaacttgaagctggtttgccgagcctggaaggcagcaatcatcggctatgaactttcccagctgaggagagagcttggtgtaagtgaggaatgggtgtatgtactgaccaaggctgaggcatacaagctccattggtatgccctggatccagtgtttcagaaatggcagaggttgccaccgatgccttctttcgtcaatcaggaggaatccaatcggacagcatcttcggcgttctggatgtggaatgttgtgggatcaagcattaggattgctgattacgtgaggggcttgttttggcgcaggaacagtttggaccagatgcccttctgcggttgttcagtgggtgttgctgatggttacttgtatgtcattggcggtttttccaaagctgttgccctgaatcgcgtttgtagatacgacccttttctcaatttgtggcaggaagtgagcccaatgatgactgggcgggctttctgcaaggcggcatttttgaatggcaagttatatgtagttggtggagtcagcaggggtcggaatggcttgcttcccctgcgttcagctgaggcgttcgaccctaaaactggattgtggagcgacctaccagaaatgcctttcgcaagagcgcaggtactccccactgctttcttggtcgatgtgctgaagcctatcgccacaggaatggcaccctacaagggaaagctgtatgtccctcagagcctgtactcatggccattcttttttgacattggaggtgagatctacgacccagatctgaatgcctggtcaacgatgccggatggtctcggcgatggatggccagccagacaggcaggcacaaagttgggtgttgtgatcgatgacagactttacacgctagagccttccagctctttggacagtggtaagataaaaagatacgactccgaggaggacgcatgggtaactatcaccccacaagttccagttaatgatttcactggtgcagaggccccttatttactcgctggcctcggtggaaggctccatgttataacaaaggcggcgaacaacactcttcaagttatgcaggctgtggtgcagaataactcggtatctgaagaaaatgtggtatggacaacagtggcttctaggaactttgggacggctgagcttgtcagctgccaggttctagatgtttaaaatgtgggtcgcaagttacgctttgtagaggatatagtatgccatagaccaacgatttagccaagaaaaatattacatagtttttgctttgtgtgtgtgtggaacaagagttcaatttgacgtggagggagatcaattacagatattcagatatgtataactgtataagctaactcatttgctgggagactgtgtatagacatacgatcgacgtgttaatgtacagtgctcaattctagtttcctttttttaaaaacatgtttctgatccttaaaaaaaaaaaaaaaaaaaaaaaaaaaaaaaaa

SEQ ID NO: 92418 - protein, 456 aa, Zea mays
  misc_feature: Ceres CLONE 1581128
  misc_feature (172)..(217): Pfam Name: Kelch_1 Pfam Description: Kelch motif
  misc_feature (219)..(268): Pfam Name: Kelch_1 Pfam Description: Kelch motif
  misc_feature (41)..(88): Pfam Name: F-box Pfam Description: F-box domain
MGSILSATSTTAKSMDQHEASGTDPNKRVKISTYEYGSNPRIIPTLPDELSLQILARSPRIHYLNLKLVCRAWKAAIIGYELSQLRRELGVSEEWVYVLTKAEAYKLHWYALDPVFQKWQRLPPMPSFVNQEESNRTASSAFWMWNVVGSSIRIADYVRGLFWRRNSLDQMPFCGCSVGVADGYLYVIGGFSKAVALNRVCRYDPFLNLWQEVSPMMTGRAFCKAAFLNGKLYVVGGVSRGRNGLLPLRSAEAFDPKTGLWSDLPEMPFARAQVLPTAFLVDVLKPIATGMAPYKGKLYVPQSLYSWPFFFDIGGEIYDPDLNAWSTMPDGLGDGWPARQAGTKLGVVIDDRLYTLEPSSSLDSGKIKRYDSEEDAWVTITPQVPVNDFTGAEAPYLLAGLGGRLHVITKAANNTLQVMQAVVQNNSVSEENVVWTTVASRNFGTAELVSCQVLDV

SEQ ID NO: 92419 - DNA, 892 bp, Zea mays
  misc_feature: Ceres CLONE 1581129
  misc_feature: Encodes the peptide sequence at SEQ ID NO. 92420
  misc_feature (783)..(783): n is a, c, t, g, unknown, or other
ggagctccccgcggtggcggccgctctagaactagtggatcccccgggctgcaggaattcgtctcacccctagaaaaagtgccagcttgagcattccactttgctagccagcatatacttacacgtagctagcttaataatcagcagctggtgcagcaagagtaacagctagcgacgacgaccatatggcggcgaagcagccagtcgtcgctgctgctgcctccggccaccccaagatgggggaggagaagctgatcatccggccggagaaggtgcggttcatagacgtgctgtcgatgctgctcctgaggcgccccatcaccagctacgcattcgaggaggccggcgaccggaccgccgccgacctgggcagcacgcccggcgactggctcgtcgcgctcacgcaggtcatccagaaggcgctcgccggcgcctactacccggctctcgtggtcggcgccgtcgtcgagttcctcctcaacttcgtcgcgctcaacaatggcatactcggcatctttctcaacctcttcagatgtaagctggtgatcccactgaaccgggaggcgcccaacttccggtccatgatcgggatgatcgacgggaggactgagctgaagccgctgccagccagcggcggcccaaaagaccggcggctgcagggggtggggcgtctccgccgccaaccggatccggcggcgaagaatacctacttgaacttgaagagcggtcaacacgggcggggcccccttggtgcaccaaacaggtccgtggaacgggaggggnttggtccggccctccgaaacaattcttccttggttccggaggttggaacaatgaatgggcccccccaagaatatccccctcaccaaagaaaccgcccgccccttacaaa

SEQ ID NO: 92420 - protein, 235 aa, Zea mays
  misc_feature: Ceres CLONE 1581129
  misc_feature (200)..(200): Xaa is any aa, unknown, or other
MAAKQPVVAAAASGHPKMGEEKLIIRPEKVRFIDVLSMLLLRRPITSYAFEEAGDRTAADLGSTPGDWLVALTQVIQKALAGAYYPALVVGAVVEFLLNFVALNNGILGIFLNLFRCKLVIPLNREAPNFRSMIGMIDGRTELKPLPASGGPKDRRLQGVGRLRRQPDPAAKNTYLNLKSGQHGRGPLGAPNRSVEREGXGPALRNNSSLVPEVGTMNGPPQEYPPHQRNRPPLT

SEQ ID NO: 92421 - DNA, 824 bp, Zea mays
  misc_feature: Ceres CLONE 1581131
  misc_feature: Encodes the peptide sequence at SEQ ID NO. 92422
  misc_feature (537)..(537): n is a, c, t, g, unknown, or other
ccccgcggtggcggccgctctagaactagtggatcccccgggctgcaggaattcgtctcacccctagaaaaaatcggttccctttccaaactcaacggccgcggcagggagcaggcacagtcacctccctgacccgttgagccgtcaattttatcccgccccgcgatttcctacagctgccgatcgaggaggaggcgcattgcccgcattcttctccgcttccaccgagagggcctcgcctgatcggcgccgccttggcccccatgacgtgtgtgcgcgccgaggacgccgtctcgcccgccgccgccgacgacgtggcggctgccctggtttccaggggcggcttgatccagaaggtggctgccggcggcgggcggagaccggcaggctcggcgcgctcgctgcagcgctcagcacatctggccaccggggacggcaacgctccggcgccggcggtggaagccagttgctcctggtcggggatgggatagggtagagcaacggtggtgggaagagagatgatagacacaggatgcngcagtacaggtcgcagctcgaacaggaggtcagaaattgcgaagcagcttgaaaaaaaggtgatctgcccgtgccgttggcggatgcgttacaaaaaggtcgcccttaccggaaaccttcatagaagttcccccaaggggccgggggcctgggttaaaatcccccccgggggaaaatcccgtttcacccctttaaaaaaacaaaaaagtttggttccccccctttttccaaaaaaaaaaaaaaggttttttttaaaaaaaaaaggggggggttgccccccccccccc

SEQ ID NO: 92422 - protein, 75 aa, Zea mays
  misc_feature: Ceres CLONE 1581131
MTCVRAEDAVSPAAADDVAAALVSRGGLIQKVAAGGGRRPAGSARSLQRSAHLATGDGNAPAPAVEASCSWSGMG

SEQ ID NO: 92423 - DNA, 847 bp, Zea mays
  misc_feature: Ceres CLONE 1581132
  misc_feature: Encodes the peptide sequence at SEQ ID NO. 92424
ctccccgcggtggcggccgctctagaactagtggatcccccgggctgcaggaattcgtctcacccctagaaaaactttcaataccttcacatgtgtggcggatctttacatgctgctttgcctgcatgcgctagctacctgccttcggtcgatagatcgtatcgatcgtctcgaacatcctggcacctgaggatcacgtcctgttctcatacagagatctggaatttcagcttgtatccccctggcccagactccaggtcttcagccttgtctacgcactcgcactctcgcctgacagacttcattggcattgtgacagtcatacacctgcccctcgggcaacactacctcatctctcatggtggtgcctggacaccattctcatcttctacgcttgtgagcggaatcgagaatgttagtctcaacctcgatgacctgagtcataaggggtgtaggtgagggtaccataccatgcatcacttggctcttgttccacgtgtcccatctgctgcatcgacgccgtctacctcatgtccgggtccatggtcgagaacctcctctactatgcaactactaacgcggagggaggggatattttttccaggggcggagttcatccaactgggcgcgcaagtccaggcagttcgacgaggacagcctggcgtttcagtcgcgtctgctggccaagtccgcatcggcgacgagtcgtacagccggcgctgcgtgttcgagcccaacgccagctgcgctacaattaaaggagggacgcgccgaggcgtcacggacatgttcgcggcgctggacgagctgttcaacaaagtgcgcgtccgggccaaggaagttgggg

SEQ ID NO: 92424 - protein, 94 aa, Zea mays
  misc_feature: Ceres CLONE 1581132
MQLLTRREGIFFPGAEFIQLGAQVQAVRRGQPGVSVASAGQVRIGDESYSRRCVFEPNASCATIKGGTRRGVTDMFAALDELFNKVRVRAKEVG

SEQ ID NO: 92425 - DNA, 834 bp, Zea mays
  misc_feature: Ceres CLONE 1581133
  misc_feature: Encodes the peptide sequence at SEQ ID NO. 92426
  misc_feature (630)..(630): n is a, c, t, g, unknown, or other
acccgcggtggcggccgctctagaactagtggatcccccgggctgcaggaattcgtctcacccctagaaaaaattcctccgcgccgccactagctgtcctaaaccctaccatcacttgagcctccaccttctccgcgtctcaccttcttctccgttctccttccgctcccctcttcacaacgaagccctagtgtcccgcgacatggcatctggtctggaggagaaactcgcggggctctcaacgggcggcgacgggcaaaatcctccgccggcgggtgagggcggagaggagccgcagctctcgaagaatgcgaagaagagagaggagaagaggaagaagctggaagaggagcggaggctcaaggaggaagagaagaagaacaaggctgcggctgccagtggaaaacctcagaaggcatctgctgctgacgatgatgacatggatcccactcaatactatgagaataggctcaaggctcttgattcactgaaggccacaggtgtaaacccctatccccataagttcccggttggcatttctgtacccgaatacattgagaagtacaggaccttgagcgagggggagaaacttacagatgtgggcagagtgtttagctggggaggatcatngaacagagaacatcgtcgtcgaagctattcttttatgatctttatgggtgtgggcatgaaggttcaagtgattgctgatgccaggacttcggagttggatgaacctgaattttctagtaaccactcagggtggaagcgaggtgaaatggttggcatattgtggaatttcccggaaaagcaaccagggggagactttaggtattc

SEQ ID NO: 92426 - protein, 210 aa, Zea mays
  misc_feature: Ceres CLONE 1581133
  misc_feature: SWISSPROT Homolog: EC 6.1.1.6 Lysine--tRNA ligase
  misc_feature (143)..(143): Xaa is any aa, unknown, or other
MASGLEEKLAGLSTGGDGQNPPPAGEGGEEPQLSKNAKKREEKRKKLEEERRLKEEEKKNKAAAASGKPQKASAADDDDMDPTQYYENRLKALDSLKATGVNPYPHKFPVGISVPEYIEKYRTLSEGEKLTDVGRVFSWGGSXNREHRRRSYSFMIFMGVGMKVQVIADARTSELDEPEFSSNHSGWKRGEMVGILWNFPEKQPGGDFRY

SEQ ID NO: 92427 - DNA, 910 bp, Zea mays
  misc_feature: Ceres CLONE 1581134
  misc_feature: Encodes the peptide sequence at SEQ ID NO. 92428
  misc_feature (735)..(735): n is a, c, t, g, unknown, or other
gcggtggcggccgctctagaactagtggatcccccgggctgcaggaattcgtctcacccctagaaaaaagaggagagagtcgctctgcactgcacgactcctcccccatctaccactacctgtctacctacccagcccatcgactgcccctcgcaacgcaatggcgctcgccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcgacagctggaagtcgaagaaggcgctgcagctcccagagtacccaaaccaggaggagctggacacggtgctcaagaccatcgagacgttcccgcccggtgggtgttcgccggagaggcgcgtccacctccaggagcgcatggcccgaggccgccatggggcccgcgccctttcatccttccagggcggcgaactgcggccaagaagctttcaaaggagtttccaccgccaaacaacattcggggaaaacccttcccgtaattctgccttcaaaaatggggccccccgtgctccatgtttcgggggggtcaaggggcccggtccctccagggngggggaaaggaaaggcttggcccaattttgcccaaaaccaagaggtccaaaacctttttggaaggaaaaagggaaccgggcttttaaggttggccaagagctataagggggggagaaaaaaacgttaaaggggggggaaaaaaatcttcccccaaaaaaaaaaacccgcccggcg

SEQ ID NO: 92428 - protein, 226 aa, Zea mays
  misc_feature: Ceres CLONE 1581134
  misc_feature: SWISSPROT Homolog: EC 2.5.1.54 3-deoxy-7-phosphoheptulonate synthase
  misc_feature (192)..(192): Xaa is any aa, unknown, or other
MALATNSAAAAAAAVSGGAASQPHRAATFLPLKRRTISAIHAADPSKNNGPAVPAAAAAKSSASAVATPEKNPAAPVKWAVDSWKSKKALQLPEYPNQEELDTVLKTIETFPPGGCSPERRVHLQERMARGRHGARALSSFQGGELRPRSFQRSFHRQTTFGENPSRNSAFKNGAPRAPCFGGVKGPGPSRXGERKGLAQFCPKPRGPKPFWKEKGNRAFKVGQEL

SEQ ID NO: 92429 - DNA, 849 bp, Zea mays
  misc_feature: Ceres CLONE 1581135
  misc_feature: Translation starting site: 489
  misc_feature (792)..(792): n is a, c, t, g, unknown, or other
tccccgcggtggcggccgctctagaactagtggatcccccgggctgcaggaattcgtctcacccctagaaaaaactctgtctcttcctcagtcccggcatcagcgctcaaaccctaacacgccacgcgatcccgatgcgcaggggtctgggcagcgaggcatcgttgcgccggcggcgcgggccggcgcggctttgggtggcagtggcggcgctggtggtcggcaccgtgtgcctcttctcctcctcttcggtcggcctgttgggcgcctcttacagggtccagattcaaatggttggagagcatcttctgcaccacgcacctactggcctcccccaccaactgaatctgagagcaatggctacttgcgcgtccggtgcagtggtggcttgaaccaacaacgtagtgcaatatgtaatgctgttgttgctgcacggatcatgaatgctacactggtgctgccagaattagacacaaattcattctggcatgatgaaaggtatttatgatgttccccacttcatcaagacactgaaatatgacgtccgaattgttatgagcattcctgaaatcactacaaatggaaagaccaagaagctcaaaggccagcagcttcggccaccaagagatgcaccggtatcttggtatgcaactgatgctttggagacgatgaagaagtatggagctatatatttaagtccattttcacaccgtttggcagaagatattgataatccagagctccagagattgagatgcagagtgaattaccatgcactacgattcaagcaantatcatgaaaaacagcagtgagatagtgaaacagctccgctcagaaggccatttcat

SEQ ID NO: 92430 - DNA, 843 bp, Zea mays
  misc_feature: Ceres CLONE 1581137
  misc_feature: Encodes the peptide sequence at SEQ ID NO. 92431
  misc_feature (241)..(241): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (533)..(533): n is a, c, t, g, unknown, or other
  misc_feature (628)..(628): n is a, c, t, g, unknown, or other
aaagctggagctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgnaaccgcggcgtggagccgtcgggcccggacgccggctcgccggccttctcggtggggcgcctgcgnnnnnnnnnnnngacttcctgcagtcggtgaacctcaagtacgtgcgccggannnnnccactacctcatcagccacggcgtgtacctggccaccatccccgtcatcgtgctggtgtgcggcgccgagctgggcaccccaagggagggggnnnnnnnnnnnnnnnnnnnnnnnggaggccacctacgaccacctcaccgtgctctcattcctagccgacctcgcctangacagtttccgtacatatcatgaacagggaccaggcccgtggtacatcatacgacttcgcgtgctacaagccggccgaagagcctcaacgtgtcnaaggggggagttcatcgaccttggcgcgcaagtccgggaagtttcgacaaggaaagcctgggcgttccatccgcgtcttgctgggccaattccgggatcgggggacaagtcgtaaatgcccgcgcctggctggttcgaagccccaaggccagttggggcccccctattaaggaaagggcggcgccaagagggtcccacggggccttgtttttggt

SEQ ID NO: 92431 - protein, 81 aa, Zea mays
  misc_feature: Ceres CLONE 1581137
  misc_feature (26)..(26): Xaa is any aa, unknown, or other
MNRDQARGTSYDFACYKPAEEPQRVXGGSSSTLARKSGKFRQGKPGRSIRVLLGQFRDRGTSRKCPRLAGSKPQGQLGPPY

SEQ ID NO: 92432 - DNA, 835 bp, Zea mays
  misc_feature: Ceres CLONE 1581138
  misc_feature: Translation starting site: 282
tcaccgcggtggcggccgctctagaactagtggatcccccgggctgcaggaattcgtctcacccctagaaaaaaggaagctgagatggagtagctagctctctgattcgaggcctgagcgagcgagctgaggactgcagcctatataatatctagactagagtacaccacaacgacgaggcacatatatatacacgcggcggcggtcagatccatcttgggatagacgtaatagatatacgcgcacgatgggccagcgccggcggcggtggcgagagcaagatggagagcccgctgctgggtgcgtcctccacaggccacagcgaggttgtggtgagcgggaaacaggatagcatgctgggggacgcgtccgtgccgtgagggacgcagatggcctcggcatccagggtggatatgcggctgatggtgcgccagggaacacacgcgatgctcgtgtagatgatcaactacgtcaagtagatgtccacgcatatcttctaggagcagctcggcacgcgtcgagctcgtgcgatcgccatgctcgggaaatgcggggtaggaggtcttcgcctagcggctcatgctggtcatggtgagcgcggtggagactctatgcgggcaggcgtacggtgctcacatgtaagacatgcattgaaactacgctcaggtgtctaccatcctgctgatgggtacgggtgtgccgcctggggccctatactacttctgcagcccctcctggtcttgatgggggattctaccgagatcgcgtgggccaccgtcctaatcgtgtagggggggggcccaaaatgacgcgacgctgcaagatttccttcgga

SEQ ID NO: 92433 - DNA, 1236 bp, Zea mays
  misc_feature: Ceres CLONE 1581140
  misc_feature (12)..(12): n is a, c, t, g, unknown, or other
  misc_feature (72)..(72): n is a, c, t, g, unknown, or other
  misc_feature (1120)..(1120): n is a, c, t, g, unknown, or other
  misc_feature (1149)..(1149): n is a, c, t, g, unknown, or other
ggaccccccttnttcttattacaatcaaccataattacaaagacacagggtaagggttgggcaaggaaaaancccaaaactggaactccccgcggtggcggccgctctagaactaatggatcccccgggctgcaggaattcgtctcacccctagaaaaaactgacgaccagacgcgccagggtttcaggcttccacgaatctccccgccgccctcaattcccctcggcgccgccgcctcctcccctcgcttcggtcctcggttagttaaccatccaggttctgtcaagatgtctgatacccatgagactgacacgaacattgagatttggaaaattaacaaactgatcaacgtattggaatcaagccaaaggcaatggcacaagcatgatctctcttgatcatgtctccacgtcatcagggtgctcaagtgtctaaaatcgtcgggcgatgaaaatgctactgcttcgcacatcaagagtggagttaatccctacaaattatgttggggcgagcacatctcctcggctcagacccacgtttgaaactcctgccaccaaagcggccttccaaacggaaatggggtccggttcactcggaaaccaattgctcccccaccccaccggaaaaagaaaaaaaaaagggttccctccattttctttttggggaccctttccaaggcccttttgaaatgggaaagaactttgtaccccttttgtgaaaaaaaacccaggttttccacacactctcgggagggctcttaaaaaaagggggagcttccctttttgaaaaatcccttaaacgaaacaacaacaggtatggggcgggtgatcctaatagggggttgaagaggagaaaagggggagaacaaggcgagtaacccccctcctcttctataggggcacaagcataatactggcgtcggccgcaaagatccccacgcggtaagaaacagcggtctctttttacgctgaaacgaaacacccgatgtgtgggggaatacaccctcccacgcaaagaaagaaagaaacaccctctctgctataatcggcggtgagggggcgggcgcccttcaccgcctcgtcgtcccgctattgtattagaaggagccccgcgagtcgnttatcagacgaagggcggggcgagagatntcccccctcgctaataataataatatttgtctccctgcctaaaaaagacagaaggtctgtgagaaaaatctctggtggacccaaccc

SEQ ID NO: 92434 - DNA, 875 bp, Zea mays
  misc_feature: Ceres CLONE 1581142
tcaccgcggtggcggccgctctagaactagtggatcccccgggctgcaggaattcgtctcacccctagaaaaaattcacgttggctctttctcgctttctttcacccgttcacgcctgctctacctgcgataggttcgtctctctcgagttaaccattggccgccgccctcttcctcacccccgcccccgcgcatgttcccaggtcttcgccggtcccttcaccgccaaagagcacccactaggttaaatctgcctgcaagacatctccatcaagtgactggtgctaattatgcgatcttcatgggctgactcagttgcaaacaccgaagaatcgactcccgcgactgctgctgacaacggctctgttgcaaatcgtagcaactcgcgcaggattgcccacctcactaattggcctccctcatgttcctggaccgctccaactaggtgctccctgttgggagtccccccatgggcttaaaggagccaccaatttccagggtgggaccccctttgctttttgggcttgagggcaaaaaactttctttgccctggggcccaaataatggggtggacctttccacggggctgggcattttacaaaaggttttttggggggtggaaaaaacgtttgggacaccacctccccccggggtaaagggggtggaaaaaccaggggggccctaaacaccttgtgggagagtaggcccccccccggacataatctcctttttggtttccccacaaaaagttttgtataccgggggcttttttgtgcctcaataaaattttttgacacacgagttgtttttattcccgcagagaaaaagaaagagaaagccctttcttaaacacaagggggggccgccttttatca

SEQ ID NO: 92435 - DNA, 759 bp, Zea mays
  misc_feature: Ceres CLONE 1581143
  misc_feature: Encodes the peptide sequence at SEQ ID NO. 92436
ctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcggggagtcccacgcagcaaacactgggagggtctgctggaccccatcgacggcgtgctcctccaggagctcatccgctacggcgaggttcgccaggcccacctacgaacagcttcgaatacgaaccgctttcttccccctactgggggaagcttggaaagtaacccgggggaaaaaaccttttttttccaaaaaaaatttggggccctcgggggggggttttggggtttaaaagaagggaaacccccgggtttacctttttttaagcccca

SEQ ID NO: 92436 - protein, 170 aa, Zea mays
  misc_feature: Ceres CLONE 1581143
MAATVSSCLSLVPTVHHRAGGFPSSVALTNTLQRRRRSRRYLVVASATRAEQEAAPVTIEDVDLSSHQAAADDGELAARWRGVPRSKHWEGLLDPIDGVLLQELIRYGEVRQAHLRTASNTNRFLPPTGGSLESNPGEKTFFFQKKFGALGGGFWGLKEGKPPGLPFFKP

SEQ ID NO: 92437 - DNA, 858 bp, Zea mays
  misc_feature: Ceres CLONE 1581144
  misc_feature: Translation starting site: 134
aagctggagctccccgcggtggcggccgctctagaactagtggatcccccgggctgcaggaattcgtctcacccctagaaaaaatagccatcccctcccgcggcaagtctctctgaattgtgggtctccggcgatggcggctctagctccatccaagattctgggcaccaagctcaacttcaccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaagatctacctgccggatgggctcttggaccgctcggaggtaccggagaacctcaccggagaggtccctggagactatggctacaacccttttggcctgggcaagaagccagaggacttctccaagataccaggcctacgagctgatccatgccagatgggccatgctcggtgccgctggcgctgtcatcccagaggcgtgcaacaagttcggcgctaacagcggccccagacgcgtctggttcaagaccggcgccctgctcctggacggcaacaccctcagctatttcggcaacagcatcaccatcaacctggtggtcgcggataccccgggggaggacgacccttcgtcggcagctcccatgtactaccgggtcatcaacagagtgggagctcgaggacaagctgccgccccggaggaccctgtcgaccccatgggattggccagtgaccccaaatccggacgccgatcttcgagggtggacggatatcatgaacggccagcctcaacttgta

SEQ ID NO: 92438 - DNA, 814 bp, Zea mays
  misc_feature: Ceres CLONE 1581149
  misc_feature: Translation starting site: 529
  misc_feature: Pfam Name: DUF895 Pfam Description: Eukaryotic protein of unknown function (DUF895)
  misc_feature: SWISSPROT Homolog: EC 2.7.11.1 Non-specific serine/threonine protein kinase
ggagctcaccgcggtggcggccgctctagaactagtggatcccccgggctgcaggaattcgtctcacccctagaaaaaatcaagctgcccattgcctcgtgacagcgcagctgcctgcctgctccgaggcgccacccagctcttactcgccccaacagacgtttctcgagatccttttcactatcaccaccagtggtacatagaccgcatctgccgtgctctgcgctcctcagactcgactagaaggttcatccatccagctgccaccagagcccggaggtcgatcatctacctatctgaccgagcgtggaagctcccggaccggacattccattttccgttccgaagggggggtgagaaggcggggaatgagtacaaccaatgtgaagagacgtgtgggcaagtatgagctcggtcggaccataggagagggcaccttcgcgaaggtcaggttcgcgagggacaccgtcaccagcgaggccgtggtcattaagatcctgcaccaggagaaggtcctcaagacacaagatggttgagcagatcaagccagcgggctccgcggtcgtgcggtggatgagaatcaagcgcgcgctcgtggtcggcacctccagttatctcttctttatcgcagcgaacctcctaccgtcctggtacacaatggtgccagcttcactctacctaggttttaccgcatcgatcatttgggttgggcagggtacaataccttacatcaactgccctcagtcacgcgaaaaaaaataattttgcccccagggtgccaactttagggaaagcttcaatggggagtttttga

SEQ ID NO: 92439 - DNA, 837 bp, Zea mays
  misc_feature: Ceres CLONE 1581156
  misc_feature: Translation starting site: 139
  misc_feature (416)..(416): n is a, c, t, g, unknown, or other
  misc_feature (536)..(536): n is a, c, t, g, unknown, or other
ccccgcggtggcggccgctctagaactagtggatcccccgggctgcaggaattcgtctcacccctagaaaaagtctgccagcgccagactgccagtggactgcgagggagcgcctccgcctcagatccaaccccaccgatgcgagctccggcgatgctccgctgggccgcggcggcgctcgcggcgctcctcgccgcctcaccggccgccgcgttctatctacccggcgtggcgcccaacgacttccataagaaagatccacttttggtgaaggtgaataagctgacatccacgaagacgcaacttcctactcatattactctcttcctttctgtaaaccaaacacgatagttgacagtgcagagaatcttggagaagttctgcgtggtgatcgcattgagaactctccttatgtngttgagatgggggaacccaagatgtgccagattatctgcaaagcaaaaattgatgataaacaggcaaaggagctcaaggaaaaatagaggatgagtatcgggtgaacatgattcttgacnatctccccctagtttgttctcctgccaggcaaggaagggggtgctactgttttaccaggctgggaattcatgtttgggggtcaaggccccaaacccctgggtacaatggataagaaggcccttttccccaatccctctgggatttttttgggaaaaaccccccaggggtgaaacttcccgatcttctcttaaaattgttggggatttgggggcaaaaccttttggattcaaaaccccccattttaaagggcccccgggaaaaagaaaaaacacccccttttaaaccccgggggagcccccc

SEQ ID NO: 92440 - DNA, 833 bp, Zea mays
  misc_feature: Ceres CLONE 1581159
  misc_feature: Encodes the peptide sequence at SEQ ID NO. 92441
ggagctccccgcggtggcggccgctctagaactagtggatcccccgggctgcaggaattcgtctcacccctagaaaaaattcctccaccaccagtccaccgcctccatccagcactctccaccgcagcgacccctaaaatcctcgtcgctacgaccaggggatccctcccccaatgcggctgctcccgctcctcctgctcctcctcgccggcgccggcgcccgcgcctccgacgaccccttcctctccggcgcggcgaaccacagctacaacatcgactgcggcggggtggcggacttcacctcggccttcgggcggcggtggctcgccgaccggttcttctccgcgggcggggccgccggcatggtggcggagccgcaccgcttcccgcagccgcaggagcgcacgctccgcttcttcccgccctcctcggccggcaagtcctcgtgctactcgctcccgcttccccccggccgctactacctccgcctcttctccgtctacgacaactacgactccaagctgcgcacgccctccttcgacgtctccgccgccgccacgctcgtgctctccttccgctcgccctggcccgagcccgccgcgcgctacggggcctactccgacctcatcttcccctccgccaccgaagccgcctccgaactctgcttctactcgctctccacggacgcgcccgccgtcgcctccatcgaggtctcccccgtccacccgctcgcctacgacggcgccaccacgggcgccgaactcgtcctcgtcaactacggccgggtcaactgcgggaacaagctctttcgcccccggattaccagggaacgc

SEQ ID NO: 92441 - protein, 220 aa, Zea mays
  misc_feature: Ceres CLONE 1581159
MRLLPLLLLLLAGAGARASDDPFLSGAANHSYNIDCGGVADFTSAFGRRWLADRFFSAGGAAGMVAEPHRFPQPQERTLRFFPPSSAGKSSCYSLPLPPGRYYLRLFSVYDNYDSKLRTPSFDVSAAATLVLSFRSPWPEPAARYGAYSDLIFPSATEAASELCFYSLSTDAPAVASIEVSPVHPLAYDGATTGAELVLVNYGRVNCGNKLFRPRITRER

SEQ ID NO: 92442 - DNA, 804 bp, Zea mays
  misc_feature: Ceres CLONE 1581162
  misc_feature: Encodes the peptide sequence at SEQ ID NO. 92443
  misc_feature (456)..(456): n is a, c, t, g, unknown, or other
ctcaccgcggtggcggccgctctagaactagtggatcccccgggctgcaggaattcgtctcacccctagaaaaaagtaccgcaccaccaccaagcaccgcaaccggagccggagccagaggagggcgagaggccgaggggagaggagcgaaggaggccgccgaccgaccgtgcgtccggccccgcggcggcgtcggcaggtcgtagacggcagacgaggagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcgacacgctgcgccggatcctggcagacaacgcctgcgccgagtacctccgctgccggggcctcgcgggccgcaccgacgccgccagctttcgcgcctgcgtngcgctcggcacggacggcgacatcgagccttacattgcgcgtatcgccgacggcgacacgtcccccgtggctcaccgcaaagcccattaccttcattctccctcagcttccgggacgaccccaggggaaagcccaagttcccttggcctttcaaccagggagttccgtcaaggtcccccaatggccgaattttcccggggaattttccttgggcccctttaaggaaaaaaggggggggttttccccccgggggaaagaaaaagggccaaaggggccctttttccattttttttattttttcagcgggggacaccccggggggagattttctcctccccccgccggggg

SEQ ID NO: 92443 - protein, 139 aa, Zea mays
  misc_feature: Ceres CLONE 1581162
MPEKEAQAAAFCGEAVIAEFESLTRDAAAVQRDTLRRILADNACAEYLRCRGLAGRTDAASFRACVALGTDGDIEPYIARIADGDTSPVAHRKAHYLHSPSASGTTPGESPSSLGLSTREFRQGPPMAEFSRGIFLGPL

SEQ ID NO: 92444 - DNA, 827 bp, Zea mays
  misc_feature: Ceres CLONE 1581163
  misc_feature: Translation starting site: 203
  misc_feature: Pfam Name: eRF1_2 Pfam Description: eRF1 domain 2
  misc_feature (632)..(632): n is a, c, t, g, unknown, or other
  misc_feature (709)..(709): n is a, c, t, g, unknown, or other
acccgcggtggcggccgctctagaactagtggatcccccgggctgcaggaattcgtctcacccctagaaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaagatgttaggtgatgaatatggtactgcttcgaacatcaagagtagagttaatcgtcaatctgtgttggctgccatcacctcagctcagcagaggttgaagctctacaacaaagtgcctcctaacggattggttctgtacactggaactattgttactgaagacggaaaggaaaagaaagttactattgattttgagccattcaagcctatcaatgtatcactctacctttgtgacaacaagttccacactgaggctttaaatgagctcttggaatctgatgacnaagttggggtcattgttatggatggtaatggtactctttttggcacactaagtgggcatacccgtgaagtgcttcancaattcactggtgacctccaaaagagcatggtagaggagggcagtctgctctgcgttttgctcggcttcggatggagaaacgccctactatgtccgcaaacagctgaccttgctacct

SEQ ID NO: 92445 - DNA, 805 bp, Zea mays
  misc_feature: Ceres CLONE 1581164
  misc_feature: Encodes the peptide sequence at SEQ ID NO. 92446
  misc_feature (727)..(727): n is a, c, t, g, unknown, or other
  misc_feature (733)..(733): n is a, c, t, g, unknown, or other
aaagctggagctcaccgcggtggcggccgctctagaactagtggatcccccgggctgcaggaattcgtctcacccctagaaaaaaactcccaagatctcatctcttccccttccgtcctgcgccctgcccctgcggcctccctctcctacccggcaggcagccaggcacccatcccttccacgagctattagtacccgccacgccatcgtccccgcttcgccgcctgcctctccggactcccactctccaagccacctaccttcctacacccaagtaggagtacctacctgcgcagagcccacgacggctcggactccgccgtgtcgacaccgctcctgtcggagcatcgaggctacattaccaagtagtaggaaaccatgggccctgcgccgagggagcccatgaagcagcgcgtgaaccgctgcctgctgcgcctctcggaccgggacacggaggcgatggccgcggcggagctggacgcgatcgcgcgcgagctggacgccgacgagctgccggtgttcgtggccgcggtctccgacgcgcggcccaccgacaggacgccgctgcggcggcactcgctccggctgctggcgctcgtcgccggggagcacccgcgggacgccgtcgcgccgctcgtgcccaggctcctgggcgccgcgctgcgccgcgtccgggacccggactcctccgtgcgcgccgcgctcgtcgacgcggcccgcgcgcggntggggnccccaaggagagaactcccgtcggcgatgggcccaaaaaaacggactccgtgcgtcaaaaacaaggagcagg

SEQ ID NO: 92446 - protein, 142 aa, Zea mays
  misc_feature: Ceres CLONE 1581164
  misc_feature (117)..(117): Xaa is any aa, unknown, or other
  misc_feature (119)..(119): Xaa is any aa, unknown, or other
MGPAPREPMKQRVNRCLLRLSDRDTEAMAAAELDAIARELDADELPVFVAAVSDARPTDRTPLRRHSLRLLALVAGEHPRDAVAPLVPRLLGAALRRVRDPDSSVRAALVDAARARXGXPRRELPSAMGPKKRTPCVKNKEQ

SEQ ID NO: 92447 - DNA, 841 bp, Zea mays
  misc_feature: Ceres CLONE 1581165
  misc_feature: Encodes the peptide sequence at SEQ ID NO. 92448
  misc_feature (809)..(809): n is a, c, t, g, unknown, or other
ggagctccccgcggtggcggccgctctagaactagtggatcccccgggctgcaggaattcgtctcacccctagaaaaaaccaccgccgcctccttccagctgggtggaagaaacatgtcgcgaatggcgcccccgtctccgcctcagtccctgaagcccccgacgctgcccttctccccgcccaaaaagccaccgccgatgccggtgtacaaggacctgcacttcaaccgcgacctctccgccaccaagaagctccaggccggagtggacctggtggcacggttgttgggggtcaccctggggcccaaggggaggaacgtggtgcttggcaacaagtatggccctcccaagattgtcaatgacggggagaccgtccttaaggaggtcgaattggaagatccattagaaaatcttggagtgaagctggtccgacaggctggagcaaggaccaatgatattgcaggagatggttgtaccacatccataatccttgcccaaggcctcattgctgaagggatgaaggttcttgcagctggaatcaacccagttcaggtcgcacgtggcattgagaagactgctgctgctttggtgtctgagctcagactgatgtcgcggggtgattgaagaccatgaaattgcacatgtggctgcagttagtgcgggaaatgattatgctgttggaaatatgatttatgatgcttttcaaagagtaggtagacaaggaatggtgagaattgaaaaatggagaggcaccgagaacagtctgggaggttctggaaggaatgcaatttgaacgccggtacctctcntcttacttttggttaccgatcgtgggtacatg

SEQ ID NO: 92448 - protein, 166 aa, Zea mays
  misc_feature: Ceres CLONE 1581165
MAPPSPPQSLKPPTLPFSPPKKPPPMPVYKDLHFNRDLSATKKLQAGVDLVARLLGVTLGPKGRNVVLGNKYGPPKIVNDGETVLKEVELEDPLENLGVKLVRQAGARTNDIAGDGCTTSIILAQGLIAEGMKVLAAGINPVQVARGIEKTAAALVSELRLMSRGD

SEQ ID NO: 92449 - DNA, 779 bp, Zea mays
  misc_feature: Ceres CLONE 1581166
  misc_feature: Encodes the peptide sequence at SEQ ID NO. 92450
  misc_feature (523)..(523): n is a, c, t, g, unknown, or other
ggagctcaccgcggtggcggccgctctagaactagtggatcccccgggctgcaggaattcgtctcacccctagaaaaagcaatcacgaagagtcatcacgccatacgacacggaggacaccgagccggaggcgaagccggtgcgcagcgcgagagtagcggcgagtcggcgaccatcaagcaactgcatggccgcgttacccgccagcgcccccgcccccgcccccgccccctccgaggcggcggagctcgtgccgacgctctcctcgctggagccggtctacggcgcgggcgcgcagctcgacgaggcgcgcctccgcttcgcccgcctcggggaccgcttccacgccgtctacggcgcccgccccgcgctcttcgcccgctccccagggagggtcaatctgatcggggagcacatcgactacgagggctactcggtgttgccgatggccatccgccaggacatgatcgtcgccatccgaagggcaacggcgcccaggtgaagggtcgcaacgtcgacgacnagtaccccctctgcgtctaccccgccgaacccagacaggaaaatgacgtaaaaatcacaaatgggggcactatttcatgtgtggatacaggggagtttatgaatactgtagatcaaaagggatagatctgggcaaacctgttgcgcttgaagtccttgttgatggccaattccctcaggctctggactgtcaagctcagcagcctttgcctgttcagcaacattggtttcatggggaatcttggacaaaactttca

SEQ ID NO: 92450 - protein, 104 aa, Zea mays
  misc_feature: Ceres CLONE 1581166
  misc_feature: SWISSPROT Homolog: EC 2.7.1.6 Galactokinase
MAALPASAPAPAPAPSEAAELVPTLSSLEPVYGAGAQLDEARLRFARLGDRFHAVYGARPALFARSPGRVNLIGEHIDYEGYSVLPMAIRQDMIVAIRRATAPR

SEQ ID NO: 92451 - DNA, 840 bp, Zea mays
  misc_feature: Ceres CLONE 1581169
  misc_feature: Encodes the peptide sequence at SEQ ID NO. 92452
  misc_feature (689)..(689): n is a, c, t, g, unknown, or other
  misc_feature (771)..(771): n is a, c, t, g, unknown, or other
ggagctccccgcggtggcggccgctctagaactagtggatcccccgggctgcaggaattcgtctcacccctagaaaaagaacaggagctcggtgacttttgtgaggggcgcctgatggaggagcgccggctcgacacgccggcgatgaggagaatcagcgagtggattctttcactagagttcccaagcgatattaccatccaggttggggaggcgaccttcaacttgcacaagctcccgttggcatcgaggtgcggctacataagggagcaggtgtcggggatcaatggctccagggtcacccacatcgacatcacgggcttgccgggcggcgccgcggcgttcgagctcgtcaccaaattctgctacggcgagaacttcgagctcacggaggacaacgtcgccatgctgcggtgcgccgccgagcacctggagatgaccgacgacgacagcaggggcgggaacctggccggcaggaccgaggcctacctggaggcagtggcgctcatgagcctcgcgggcgcggtcaccgtgctccggaggtcggaggacctcctcccggtgtccgaggaggtggacctcgtcggcaggtgcgtcgacgccatcgcctacttcacctgcaacgacagtcagttcagcatgtccaacggtaacggcatggacgtgtcgtcgtcccaggtcatcatccnatgaatggttggctgaagagctgacgtccctgcggaatgacacattccagaaagtcgtaaatgctatgaaagccgagggggntcaaggggcatgcttctgggcacgctcatcaggctctaatgctcaaaattccctgccaaaggctggaca

SEQ ID NO: 92452 - protein, 191 aa, Zea mays
  misc_feature: Ceres CLONE 1581169
  misc_feature (17)..(114): Pfam Name: BTB Pfam Description: BTB/POZ domain
MEERRLDTPAMRRISEWILSLEFPSDITIQVGEATFNLHKLPLASRCGYIREQVSGINGSRVTHIDITGLPGGAAAFELVTKFCYGENFELTEDNVAMLRCAAEHLEMTDDDSRGGNLAGRTEAYLEAVALMSLAGAVTVLRRSEDLLPVSEEVDLVGRCVDAIAYFTCNDSQFSMSNGNGMDVSSSQVII

SEQ ID NO: 92453 - DNA, 732 bp, Zea mays
  misc_feature: Ceres CLONE 1581170
  misc_feature: Encodes the peptide sequence at SEQ ID NO. 92454
  misc_feature (46)..(46): n is a, c, t, g, unknown, or other
  misc_feature (63)..(63): n is a, c, t, g, unknown, or other
ggagctccccgcggtggcggccgctctagaactagtggatcccccngggctgcaggaattcgntctcacccctagaaaaagttccatcgccccccattgctcgccaagagttcttcttgtttaggcaaaggcaaaagcaggagcaaaaaggtttcgttggcgatggcgagctcgtggacgcttcctgaccacccgaagctccccaaggggaagccggtggctgttgtcgtgctggacggatggggcgaggccaaccccgaccagtacaactgcatccatgtcgctcagactcctgtcatggactcgttaaagaatggtgctcctgagaaatggagaactagtgaaggctcatggaaacagctgtggggtctccccatctgaatgatgacatggggcaaacaattgaaagttgggtcaccaagggcaccttgggtggcctgggtccggaatttttccccccccaaggggggcctaaaagctttgggttggaattcaaaccttcctttggccctccggggaaaaaaaaatttttttttaaattgggaaaaaaatgggggttttcaaaaactttaaccttttaaaaaaaaaaaatcttttttttttggaaaaaaaaagggggggaaaactcttctttttcacacccccttttttaaattgtgggggggtgttttggttttttttaaaaaaaattgtgtaaaaaagggtggggtggggggtgggggggtccccccc

SEQ ID NO: 92454 - protein, 72 aa, Zea mays
  misc_feature: Ceres CLONE 1581170
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRTSEGSWKQLWGLPI

SEQ ID NO: 92455 - DNA, 855 bp, Zea mays
  misc_feature: Ceres CLONE 1581171
  misc_feature: Encodes the peptide sequence at SEQ ID NO. 92456
  misc_feature (46)..(46): n is a, c, t, g, unknown, or other
  misc_feature (47)..(47): n is a, c, t, g, unknown, or other
  misc_feature (64)..(64): n is a, c, t, g, unknown, or other
  misc_feature (70)..(70): n is a, c, t, g, unknown, or other
  misc_feature (71)..(71): n is a, c, t, g, unknown, or other
ggagctccccgcggtggcggccgctctagaactagtggatcccccnngggctgcaggaattcgntctcanncccctagaaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctgggcttgttgagcaaaccgggggggcaacagcagcgggattccccgtgctggtcgaacaagaacgacccgcttcgccctcgaatcgttttctaaccatcacctctggtgaaacaaggcaagggcgcctccctaaaactttgaaaagggaagggctcccagaccctactttcgggggcttacgaaaggaggggaaagcgcttctggcctcccctcaaaaaaataagggcccgacctttttttcctcggggaatttggtttaataaccgggggggccccctgggggaaaaaaaatttggggttccctggttaaacggaaaacctgttttttttgtttttccggggaaaaaggggaaaagaaatcccttggggggctccccgcccccttggtggaaagcccataaaaaaattttctcacaaaagagggccccctctttgtggggcggtgttgtttctccgttgttcc

SEQ ID NO: 92456 - protein, 157 aa, Zea mays
  misc_feature: Ceres CLONE 1581171
MKGGTQAISLMVHLAVPWLCLASWAALLPALASGNVGAAAPILRADYIKLNFSTASATPDKYKSFIASVRAGLVEQTGGATAAGFPVLVEQERPASPSNRFLTITSGETRQGRLPKTLKREGLPDPTFGGLRKEGKALLASPQKNKGPTFFSSGNLV

SEQ ID NO: 92457 - DNA, 924 bp, Zea mays
  misc_feature: Ceres CLONE 1581172
  misc_feature (655)..(655): n is a, c, t, g, unknown, or other
ccccgcggtggcggccgctctagaactagtggatcccccgggctgcaggaattcgtctcacccctagaaaaaagccggacgcttcttgttgccaaagaattccctcccctagccgccgccgccgctcgtctccctgagaggtgacgggaccgacgaactggccgagttctaggtagagaatcggttttgcttgtctcagcccggggtctgctgcgtctggtggtggtgaaggggagaaattcggagatctgttccggatcacgcgtgcgagctcaggaatcatgggtttcacccatagcctccggcaattttaaatttcgatgtccctaatggagtctaccgggtggccaaaaaagggaaagccaataggtcgttccatgattttcttaaacctccccttgggctccccccattgacggggcgtcccccccttcccggtaggagtgaaaaaaaattccccaggcggggggggttttccccaaatcgggggggagagagagcccccctgggaagaaaccccctttttggggcgtcccccccatctttaaaataaccttgaggggaagtttgtgttttttttgtaaaacccattttgattttttttttacacagcatgtttctcaaggggggggggcgggggagtgtttttcccggngggaaatatcccgccccgcgggtgtcccccccgttcttgtgggggcctccttgagaacacgcccgggggcaaaatgagaaacgctcccccggatatatgaggttccccccaatgggctcccccctccccccccaggggggcgttgttttttttttccagcgcgggtgtggcgaatcttttctcggagggggccacacctattttttttgggatgttgcgcgcgctctttgtagagaacgcgcccccctcaaaaaacacctcccttcttc

SEQ ID NO: 92458 - DNA, 798 bp, Zea mays
  misc_feature: Ceres CLONE 1581176
  misc_feature: Encodes the peptide sequence at SEQ ID NO. 92459
ctggagctccccgcggtggcggccgctctagaactagtggatcccccgggctgcaggaattcgtctcacccctagaaaaaataccacagcacaaacgcaacgcgacgcaccaagctctgagagtcgcaatggagagatcagctgagagctggtgggtgcttcccatgaccttgatcccggccatctccggcgagcaacacggtaacatggctaccgtagccactagcttcgcctacctcgccatcttcgcgtgcctcgcatgggtgggcgcgtccctgctctactgggctcacccaggcggccctgcgtggggcaagtactggagggcgagggggaagaagccgtcggcggcgatcccagggcctaaggggctcccggtggtcggcagcctcggcctcatgtccgggctggcgcatcgctcgctggccgacgaggcgtcgcgccgcccgggggccaagcggctcatggcgctgtcgctcggccccgtccgcgcggtcgtcacgtcccacccggacgtggccaaggagatcctcgacagcccggcgttcgccgcccgccccctgaaccacgccgcgtacggcctcatgttccaccgctccatcggcttcgccgagcacggcccgtactggcgcgcgctccggcgcgtcgccgcgggccacctgttcggcccgaggcaggtcgaagccttcgcgccgtaccgcgcggccgtcgccgagggcatcgtcgcggccctgatgcgcgccggctccggcggcgccgtcgtccaggtgcgcggcctcttgcggcgggcgtcgctct

SEQ ID NO: 92459 - protein, 223 aa, Zea mays
  misc_feature: Ceres CLONE 1581176
  misc_feature: SWISSPROT Homolog: EC 1.14.13.68 4-hydroxyphenylacetaldehyde oxime monooxygenase
MERSAESWWVLPMTLIPAISGEQHGNMATVATSFAYLAIFACLAWVGASLLYWAHPGGPAWGKYWRARGKKPSAAIPGPKGLPVVGSLGLMSGLAHRSLADEASRRPGAKRLMALSLGPVRAVVTSHPDVAKEILDSPAFAARPLNHAAYGLMFHRSIGFAEHGPYWRALRRVAAGHLFGPRQVEAFAPYRAAVAEGIVAALMRAGSGGAVVQVRGLLRRASL

SEQ ID NO: 92460 - DNA, 866 bp, Zea mays
  misc_feature: Ceres CLONE 1581177
  misc_feature: Encodes the peptide sequence at SEQ ID NO. 92461
ctctccgcggtggcggccgctctagaactagtggatcccccgggctgcaggaattcgtctcacccctagaaaaaatgtccaggtaaaaggaaaaatcgctccatcccctgactatcactggctcactgcccttccacctccaggttccagcggccatggtgaagaagcccaacggtgtcgccaaggccacggcgacctctgctgacgtggcagcccagccatccaaggagaatccgtccacccctgggttggtcaaggcctcgaagtttaagaggagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacctgtggtgcaaacgccaaagtcaaccacttttgctgaggcatcacctgtggcacagacgcagaagccagccactgatgctgaaggattggtgcctgcaccaataccaatcactgctgtagcatcagcttcgtcgccaaagccaaaaccagctcaaagctaatgcttgatgctgcagctgcaatttctgccagcaagggcaatgatgtgggtgcttgataatagtaggggtgatggtgagataaagaacccgaaagagagggccctgagtgacaaggggaaagaggttattggaggagggagaagtaggggaaaggggtaagggggttaaggttctcgagaaatccccttgctctgggtgagagcggttcttcttgcgaagagggcggtccggttttatagaaaaaagaggaaatttctcggctcttgatatagagcctacacccat

SEQ ID NO: 92461 - protein, 141 aa, Zea mays
  misc_feature: Ceres CLONE 1581177
MVKKPNGVAKATATSADVAAQPSKENPSTPGLVKASKFKRRKVKANRAKQAVAAAAIDEVAPVGAGTGDGDASASAALPQPSDVAEALPVVQTPKSTTFAEASPVAQTQKPATDAEGLVPAPIPITAVASASSPKPKPAQS

SEQ ID NO: 92462 - DNA, 810 bp, Zea mays
  misc_feature: Ceres CLONE 1581178
  misc_feature: Encodes the peptide sequence at SEQ ID NO. 92463
  misc_feature (615)..(615): n is a, c, t, g, unknown, or other
  misc_feature (621)..(621): n is a, c, t, g, unknown, or other
  misc_feature (623)..(623): n is a, c, t, g, unknown, or other
  misc_feature (624)..(624): n is a, c, t, g, unknown, or other
  misc_feature (747)..(747): n is a, c, t, g, unknown, or other
agctccccgcggtggcggccgctctagaactagtggatcccccgggctgcaggaattcgtctcacccctagaaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcggtgagcggtaggaggcgcccgtacaactgaggggacgggcaatggcggccgtggcaggcccactctgcacgtggctcgtcgccgcgtgcttgtctgcggcttgcgacgcagaagagtacaagcagaagcattgctgccccggcggaagcggcgctgggggcggcgtcatgctcggcctgcgccgccgcctcggcgcgcggcgtcgcggcttggcgcgctctggaatggctatggctngtgccntnnacagctgaaagagtgtcatttgaaagaaagaacccgatatcaaacaaagggaggggtggtgtcactggccatgggtgtagtgacaccattggggcatggatcccgacgtcttttacaacatcnttcttggatggtgttagcggaataatggaaaatgaaaagtttggactgtcccacttccccaca

SEQ ID NO: 92463 - protein, 70 aa, Zea mays
  misc_feature: Ceres CLONE 1581178
  misc_feature (66)..(66): Xaa is any aa, unknown, or other
  misc_feature (68)..(68): Xaa is any aa, unknown, or other
  misc_feature (69)..(69): Xaa is any aa, unknown, or other
MAAVAGPLCTWLVAACLSAACDAEEYKQKHCCPGGSGAGGGVMLGLRRRLGARRRGLARSGMAMAXAXXS

SEQ ID NO: 92464 - DNA, 815 bp, Zea mays
  misc_feature: Ceres CLONE 1581179
  misc_feature: Encodes the peptide sequence at SEQ ID NO. 92465
  misc_feature (640)..(640): n is a, c, t, g, unknown, or other
  misc_feature (782)..(782): n is a, c, t, g, unknown, or other
  misc_feature (788)..(788): n is a, c, t, g, unknown, or other
ctccccgcggtggcggccgctctagaactagtggatcccccgggctgcaggaattcgtctcacccctagaaaaagtgctttccagccctctgcccgctgtgccccacccccacgcccggcgacccgcaggccgcacccacccacccacccgcacccagcgccatgtccaccgcggccaccgcgtgcgccacgcgggcggcggcgcgtccgcccctcaacacggctccggcacgccgcgcgccgccttctgccgtgcgcccgccatcggccacccccgcccgccgcgccgccggctgttgcttctgcgccgccgcctcctcggcgtcgtcgccctccacctgggattggacccgatggagccgccacttcgacgaggtcgaccaggcggagagctacgcatccctcctccagttccagctagaggaggcggtggagaacgaggatttcgcggaggccgccaaactcaagagggacatcatagaggccaccggaaacgacgctgtagcccacgtcatggccgagctcaagaatgctatagaggaacagcggtaccaggacgcgtcaaggttgacaaggcttgctgggaccagcttggtaggttggtgggggtggggatatgctaaggacactgatgattccnatcgggagaattgtacgaataagccctggtgtcgggagatatgtggcgaagagctacaacccaaggcaattggtcactgcatcttcaggaactcccattatttgaaattttccttgtcaaagaagatgatgagacatatacnatgaanggtggtacacatgcgaccaacaaaagg

SEQ ID NO: 92465 - protein, 206 aa, Zea mays
  misc_feature: Ceres CLONE 1581179
  misc_feature (160)..(160): Xaa is any aa, unknown, or other
MSTAATACATRAAARPPLNTAPARRAPPSAVRPPSATPARRAAGCCFCAAASSASSPSTWDWTRWSRHFDEVDQAESYASLLQFQLEEAVENEDFAEAAKLKRDIIEATGNDAVAHVMAELKNAIEEQRYQDASRLTRLAGTSLVGWWGWGYAKDTDDSXRENCTNKPWCREICGEELQPKAIGHCIFRNSHYLKFSLSKKMMRHI

SEQ ID NO: 92466 - DNA, 874 bp, Zea mays
  misc_feature: Ceres CLONE 1581181
  misc_feature: Encodes the peptide sequence at SEQ ID NO. 92467
  misc_feature (547)..(547): n is a, c, t, g, unknown, or other
acccgcggtggcggccgctctagaactagtggatcccccgggctgcaggaattcgtctcacccctagaaaaagtatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcaacaggggacgacgacttcgccttctactactcctacctccaggacgccgacgccgccgccgcctcagcgacgtcgacgctcgccctcgccgtcgacgactccaaccccagcgccgcagggatgacgaacggccggcgacggaagcagcgcggggcaaaagacgcctgagccgccaggggaggtgaggaggctgcccanaaagacggcaaaaaccggtccatcgccaagctgctccctccctgggggggctggaggcggagagcactccaacgggggggggcccgggaaactttccaggagggaagtggcctttttaaaataaaacccaaaacccgcccggggggcccaggggaaatctcccccaaagggggaaggggttttccacccccccggaaattccgggagggcccccccggttaaaaccccaacaaggtttccttttgggggccccccccgggaactcttgggggggggagagagagaagtttggggggggggggcccccccccgcggggggcgctccca

SEQ ID NO: 92467 - protein, 78 aa, Zea mays
  misc_feature: Ceres CLONE 1581181
MRPPTANDRPPSGGGGAAAAGAATGDDDFAFYYSYLQDADAAAASATSTLALAVDDSNPSAAGMTNGRRRKQRGAKDA

SEQ ID NO: 92468 - DNA, 773 bp, Zea mays
  misc_feature: Ceres CLONE 1581182
  misc_feature (149)..(149): n is a, c, t, g, unknown, or other
  misc_feature (180)..(180): n is a, c, t, g, unknown, or other
  misc_feature (181)..(181): n is a, c, t, g, unknown, or other
  misc_feature (194)..(194): n is a, c, t, g, unknown, or other
  misc_feature (594)..(594): n is a, c, t, g, unknown, or other
  misc_feature (595)..(595): n is a, c, t, g, unknown, or other
  misc_feature (755)..(755): n is a, c, t, g, unknown, or other
tccccgcggtggcggccgctctagaactagtggatcccccgggctgcaggaattcgtctcacccctagaaaaaattgcattgtgcattgcattgcataaacctctcgtgggaagtgcaaacaccaaatccgcaatctatctatctatcnagccattcagggcctgcaggctgcagctctnnctccactgcacanctagagcgagctgccacagacaaaggacacaaatgccaccccatacccaaagaggaggcgaaagcatctcctgggtcctccctaaatttgtcgccatggcggctggcccaaccggccggcccaaccggcccggccgggggaaaccggtccccccctttcctaacccccggttcccgggcggggaaaattcccgggcccggccccggccccggggggaaaaaattttggggaaaaaaagggggcaacccccccttttttttaaccccccccggggggaaaaaaatctttttttgtgggcccccttgggggttctaaaaaaaaaaacacacctttccgcgcggggggggaaaaaaaaatccccccccccccggggggggaaaacccccctttttttctcccnncaccaaaaaaaaaaaaaaaaaaaggggcgcggtttttttttccccccccgggggggggaaaaaagaaatttgtttattatttcttttttttttgtgttccccccccggggggcgccccccccttttttttaaaaaaaaaaaaaacaccggggggtacacnccccgggggcccgagggg

SEQ ID NO: 92469 - DNA, 838 bp, Zea mays
  misc_feature: Ceres CLONE 1581183
  misc_feature: Encodes the peptide sequence at SEQ ID NO. 92470
ccccgcggtggcggccgctctagaactagtggatcccccgggctgcaggaattcgtctcacccctagaaaaaattctccatttctccttccgccgccgcacttgtcccctgaccctaggtcaaagtatcgccgacttcgccagccggatcatgtcgaccagcgccaacccgaaactgaagcggcggcgggggggcttgcggaagcagggtcctgggtaccccacggtggccaccacgggggcaatgtttgcccatgaggtgggcgccgaagggccacggagggacacgaggcaaggacccgcgttgcctagggtggttgccacctcgaccaggggaggaggtgccattgagcagggcgctgacggaatggaaggttcggcgtcgaaaactgataggagcgttcacgaggcagttggcgtcgatggcacgtacctcaccgagacacggtttgatcaatgtgccatttctccactgtcactgaaagccatcaaagatgctggatatgagaggatgactcgggtgcaggaggctactctgccaataattcttcaaggaaaggatgttcttgcaaaagcgaagacaggaacagggaaaacagttagcctttttggtactccttgcctaaagcccaactgatcaatttgactgtcgtagcagttttctcagcgatataactactggattaacccatgtgactgagttctaatttcttttagcttccagccatcgaaggtctctctgcattacttcgttcaactgctataaatttgctgggtgatgtgcccctacaggggagctggcaaaaccaattggctgctgaggccaggaagcttcctac

SEQ ID NO: 92470 - protein, 161 aa, Zea mays
  misc_feature: Ceres CLONE 1581183
MSTSANPKLKRRRGGLRKQGPGYPTVATTGAMFAHEVGAEGPRRDTRQGPALPRVVATSTRGGGAIEQGADGMEGSASKTDRSVHEAVGVDGTYLTETRFDQCAISPLSLKAIKDAGYERMTRVQEATLPIILQGKDVLAKAKTGTGKTVSLFGTPCLKPN

SEQ ID NO: 92471 - DNA, 832 bp, Zea mays
  misc_feature: Ceres CLONE 1581184
  misc_feature: Encodes the peptide sequence at SEQ ID NO. 92472
  misc_feature (353)..(353): n is a, c, t, g, unknown, or other
  misc_feature (380)..(380): n is a, c, t, g, unknown, or other
ctccccgcggtggcggccgctctagaactagtggatcccccgggctgcaggaattcgtctcacccctagaaaaaaagcgcgcggacgagaggcgaagagagcagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagcctcggccagtacaagtacgtgctgctggggcctctggtgtggaanggtgctgcagaatggcgggagcaggcnggcctgccgctcggctcctggtggctgcacctgctgctgctgttcgcggcgcgcggcctcacctaccagttctggttcagctacggcaacatgctcttcttcacccgccgcccgcgcgtcgtccccgaacgggtcgacttccgccagatcgacgcccaagtgggactggaacaattttctcggggctgaaaagcttgattgggggccccgggggttaaaaagccaactgtttcccggggctgggggaacttttgcctgtgggaacccccccggttggggcccttcccccctgttctggaaatggggggttttccaaaaacggggttttaacttgggcccccggggcccctcccaagggggcccgcttttttgcccggttataaaggcggggaacaaattttttgggggggttacccaaccccttaaaaaacccgggtgtttggagaacccct

SEQ ID NO: 92472 - protein, 99 aa, Zea mays
  misc_feature: Ceres CLONE 1581184
  misc_feature (28)..(28): Xaa is any aa, unknown, or other
MAPPPLSSWPWASLGQYKYVLLGPLVWXGAAEWREQAGLPLGSWWLHLLLLFAARGLTYQFWFSYGNMLFFTRRPRVVPERVDFRQIDAQVGLEQFSRG

SEQ ID NO: 92473 - DNA, 867 bp, Zea mays
  misc_feature: Ceres CLONE 1581192
  misc_feature: Encodes the peptide sequence at SEQ ID NO. 92474
ctggagctccccgcggtggcggccgctctagaactagtggatcccccgggctgcaggaattcgtctcacccctagaaaaaatccatcaccaccacctcctcctccttcccacgactcccgagcgctttctccgcctgcgtgtggcggcagcatggcgactgcgaacgggagcagcaaggggccgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtggggcgtggtgggccacatcgtgccctggaactaccccaccaccatgtttcttcttcaaggtaggggccctgcgctcgccgcaggccttgcgcccgtcgtcgttcaagccccgccgaagcaaaacgccgctgttccggcgctctttctacgcgcaccttcgccagggagaggccgggcgttcccccgccgggcgttgctccaacgtcctttgcccgggaatttcgggccccccgggc

SEQ ID NO: 92474 - protein, 180 aa, Zea mays
  misc_feature: Ceres CLONE 1581192
  misc_feature: SWISSPROT Homolog: EC 1.2.1.3 Aldehyde dehydrogenase (NAD(+))
MATANGSSKGPFEVPKVEVRFTKLFIDGKFVDAVSGKTFETRDPRTGEVIASIAEGGKADVDLAVKAAREAFDNGPWPRMTGYERGRILHRFADLIDEHVEELAALDTVDAGKLFAVGKARDIPGAAHLLRYYAGAADKVHGATLKMAQRMHGYTLKEPVGRGGPHRALELPHHHVSSSR

SEQ ID NO: 92475 - DNA, 886 bp, Zea mays
  misc_feature: Ceres CLONE 1581195
  misc_feature: Translation starting site: 151
ctggagctccccgcggtggcggccgctctagaactagtggatcccccgggctgcaggaattcgtctcacccctagaaaaaagggtttcgcggaccgagagggaagcggggagaggagagggcgggtagggtttccgcgggcgggccccgcatggcctctgcggcagcggcggcggtggcgccggccgcggaggagaagaatggcgcgggcgggccggtcacgggggacatggtcagcgcgggcttcgcggagctggagcggcagcagcggctgctcgccacctgcacgcgcctctaccagcacctgtccgaccacatcggctcgctcgagcgcgggctcgccgcgcgctccgacgcgctccgcgtccgccgcagggcattcgacgcgcgcacccaccgcgcgctcgactcgctccaccgccgcgaggcctccatcgacgcctccgtctcgcgcgcgctcgaccacctccactccatctccgccaaggggtcaccgccggctccggatccggcacacgccgccggcgccggcgcggccgagggcctgcgcgccctctgcgcgcggatggactccgccgcgttcctgggcttcgtggtggcccgcccgcaaggaggccgacgcgctgcgggcggagatgccggcggctctcaagctctgcgtggatccggccaagttcgtcatggacgcccgtcgccgaacttcttccccgttcaacggccgcgaaggcccgggagccccgccggacctggccctggggccttgcgtggctccatccttccgaaggcccgcccgtggccccgccgcttcgcccgaaccccgggaaccccgggaaatttggggtcccccgggggggcccccggcttttgttgcccccccggggggcggg

SEQ ID NO: 92476 - DNA, 834 bp, Zea mays
  misc_feature: Ceres CLONE 1581196
  misc_feature: Encodes the peptide sequence at SEQ ID NO. 92477
ccccgcggtggcggccgctctagaactagtggatcccccgggctgcaggaattcgtctcacccctagaaaaaatcctctcccactccctcgtccctccccctcgtccagttcactcccattgggcgagaagccgagaatgacaggcagggagcgagagctagccaggccgtcccgtccagagccgctatgtccggcggcgcgcccctcctggccctgctgctgctggcggcggcggccatgatcgccccgtcgccggccaatgccgccgtgtcgtacgaccacagggccgtggtcatcaacgggcagtgccacatcctcatctcggggtccatccactacccgcgaagcacgccggagatgtggccggggctgctgcagaaggccaaggacggcgggctggacgtggtccatacctacgtgttctggaacgggcacgagccggtgcgtgggcagtactacttcggcgaccgctacgacctcttccgcttcgtcaagctcgccaagcaggccggcctctacgtccgcctccgcatcgggccatacgtctgcgccgagtggaacttcggccgttgccccatgtggatcaagtacgtccccggcatcatcttgcgcgccgacaacggcccctttcaagtaggaaatagaagggttcggtggagaagaacgggtccctggatgcaactcgcgagggggctgtttcgaagtgggcaggacggggcccagtcctcccgtgggacaagggggggaaaaaccgagatacgggggccctcggggagaatttccgattcatggggaggggcgcgggggctctaaaagcccttcttcaggaccaa

SEQ ID NO: 92477 - protein, 208 aa, Zea mays
  misc_feature: Ceres CLONE 1581196
  misc_feature (34)..(209): Pfam Name: Glyco_hydro_35 Pfam Description: Glycosyl hydrolases family 35
  misc_feature: SWISSPROT Homolog: EC 3.2.1.23 Beta-galactosidase
MSGGAPLLALLLLAAAAMIAPSPANAAVSYDHRAVVINGQCHILISGSIHYPRSTPEMWPGLLQKAKDGGLDVVHTYVFWNGHEPVRGQYYFGDRYDLFRFVKLAKQAGLYVRLRIGPYVCAEWNFGRCPMWIKYVPGIILRADNGPFQVGNRRVRWRRTGPWMQLARGLFRSGQDGAQSSRGTRGGKTEIRGPSGRISDSWGGARGL

SEQ ID NO: 92478 - DNA, 847 bp, Zea mays
  misc_feature: Ceres CLONE 1581198
  misc_feature: Encodes the peptide sequence at SEQ ID NO. 92479
gcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtgagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaaggccaagatccaggacaaggagggcatccctccggaccagcagcggctcatttttgctggcaagcagctcgaggacgggcgcacgctggccgactacaacattcagaaggagagcaccctccacttggtgttgcgtctcaagggcggcatgcagatcttcgtgaagactctgactggcaagactatcacccttgaggtcgagtcttctgataccattgacaatgtcaaggcccagatccaggacaaggagggcatcccttcgggaccagcagcggcttcaatttttgcccgcaagcaaactcgaggacggggcgccacgcttgccggactaccacatttcagaaagaaaagcacccctccactttgggtgcctgcgtctccaaggggg

SEQ ID NO: 92479 - protein, 156 aa, Zea mays
  misc_feature: Ceres CLONE 1581198
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLKGGMQIFVKTLTGKTITLEVESSDTIDNVKAQIQDKEGIPSGPAAASIFARKQTRGRGATLAGLPHFRKKSTPPLWVPASPRG

SEQ ID NO: 92480 - DNA, 846 bp, Zea mays
  misc_feature: Ceres CLONE 1581199
  misc_feature (525)..(525): n is a, c, t, g, unknown, or other
  misc_feature (632)..(632): n is a, c, t, g, unknown, or other
  misc_feature (747)..(747): n is a, c, t, g, unknown, or other
  misc_feature (798)..(798): n is a, c, t, g, unknown, or other
ccccgcggtggcggccgctctagaactagtggatcccccgggctgcaggaattcgtctcacccctagaaaaatatcattccctattgatgatcgtggtactgttaagactgtggtgcaatacttcctggagacttatggctttaatattcagcacaccactttaccttgtttgcaagtgggcaatcagcaaagaataaattatctgcctatggaggtctgtaagatagttgagggacagcgttactcaaaacgactcaatgagaaacagatcactgctctactgaaggtgacttgccagcgtccccaagagcgtgagaaagccatcttgcagactgtgcatcacaatgcctactccgaggatccttatgcccaggaatttggtataaagattgatgagcgtcttgcatccgttgaagctcgtgttctgcctcctccaaggctgaaataccatgatagtggcagagagagggatgtattgccaagagttgggcagtggaatatgatgaataagaaaatggtcaatnggtggtagagttagcagctgggcatgcattaacttctcacgaaatgtgcaagatggtgctgctaggagtttctgtcatgaatctcgctttgatgtgccaagtatcanggaatggatttttgcacttgaacctgtgctgccccctgtctatgcgaggcctgaacatgttgaaaagagcactaagagacttttatcagatgccatgagcatactcaggcctcanggccgagagcttgacctgctgatgggtatactggctgacaataatgctctnctttacggggatcttaaaagaatatgtgagacctgatcttggaatggg

SEQ ID NO: 92481 - DNA, 845 bp, Zea mays
  misc_feature: Ceres CLONE 1581200
  misc_feature: Encodes the peptide sequence at SEQ ID NO. 92482
  misc_feature (813)..(813): n is a, c, t, g, unknown, or other
ccccgcggtggcggccgctctagaactagtggatcccccgggctgcaggaattcgtctcacccctagaaaaaaagagcgtttcgcctcggccaccctcaattgccaacggcccaccaccaccacggccagactcgctttctattaccttccgcatcatcgattcgccgagctccccatcccggagcgcggcacaccgtagccccacaccccagcggctggccggtatgaaaagcatgtggaaacatagcggcggcctggtgtgcgccgacgccggccccctcagccctctcggaggccgctcgcggcgccacatgaggctgacgctgtacgcggtcgcctttgctttcgcagcgttgaccgcctaggtcgccttcgcctcgcctccctccgcgggcgccggcacctcgtgtttcggtggagtgtacgcttccacggcgccgtaccgctcgcagatttccagcctcttctcgtccatcttgcccgccgactcgacggccccctcgccagagccgctgcgcgtcacgttcggcggatcgggcggaggctgtggccaggagacccctgatgcctgccactgtgcaatttgggagcacggctgtaagcatcagctctgccaaggctgggtctagaaaccagcttgggaactgataggcggctgctcctatcggcaatgcgggctctcggaagggacctccgggcgtccattttcccaggcactgaaatttgccggaggctgcgactccaacaaaaagttccccccttaggggggcgggtgcctccaaacaaccctcggtgggaccggaaataacccnaaaccccccgagaggccgtttttccacacaga

SEQ ID NO: 92482 - protein, 46 aa, Zea mays
  misc_feature: Ceres CLONE 1581200
MKSMWKHSGGLVCADAGPLSPLGGRSRRHMRLTLYAVAFAFAALTA

SEQ ID NO: 92483 - DNA, 837 bp, Zea mays
  misc_feature: Ceres CLONE 1581201
  misc_feature: Translation starting site: 461
  misc_feature: Pfam Name: DHBP_synthase Pfam Description: 3,4-dihydroxy-2-butanone 4-phosphate synthase
  misc_feature: SWISSPROT Homolog: EC 4.1.99.12
  misc_feature (680)..(680): n is a, c, t, g, unknown, or other
  misc_feature (782)..(782): n is a, c, t, g, unknown, or other
  misc_feature (791)..(791): n is a, c, t, g, unknown, or other
ccccgcggtggcggccgctctagaactagtggatcccccgggctgcaggaattcgtctcacccctagaaaaaacccgcgcccgcgcccacgcccacggccgcaccaaccaccagccccgatttcctcctaatcaatcacacccccaaaccaaaacccaaacagcacttctcctgcaatcgccgacgtcgccggaggcttcgccggccggagcagcgccgacgggtgcaattcttcaaagggtgcagtgtatccaaggagacaaagggaccggtccgcagtttcttcactgcaaattcaaagagcaccaaggtgaaatcagcgggcttgaaagtagcatcatccttcaaaaatgatggtggttatccagctggcggtgtctcttggaaggacgacactctattgccaaaaagcacaaccattcgtggccaggaccatccggttgctgaccccgtactcccaatggattccatgattacgccagaaatcctctctgctaatgtggaacgtgttatagacatgtttgcagatgatgacactgatactgaacttgatttggatagcccgacagagggcttcgcatcaattgcagaagccattgaggacatacaacaaggaaaacttgtgattgttgttgatgatgaatcaagggaaaatgaaggagatctgataatggctgccntccttggttaccccagaggctatggcttttatagtaaggcatgggacaggaattgtttgtgtcagcatgaaagaagatgatctggaaagactgagccttccntttgatggntacacaaaagaaaatgaggaggagctatgcactgctttcactggta

SEQ ID NO: 92484 - DNA, 888 bp, Zea mays
  misc_feature: Ceres CLONE 1581204
  misc_feature: Encodes the peptide sequence at SEQ ID NO. 92485
tggagctccccgcggtggcggccgctctagaactagtggatcccccgggctgcaggaattcgtctcacccctagaaaaaacctctgtccatccatcacagcttcgagactcgtcctccatgggttctggcggcgtcagatggaaggctctgccgctgtgcctagctctcgtggctctgcaagcatgcctccctgctcgcggggcagctcccaagacttacatcgttcagatggccgcgtctgagatgccgagctcgttcgatttccaccacgaatggtacgcatccactgtgaaatccgtgagctctgtgcagctggaaggagacgcggacgaccattacgccgcgaggatcgtctacaactacgagacggcgttccacggcttcgcggcgaagctggacgaggacgaggccgagcggatggccgaggcggacggcgtggtggccgtgctcccggagacggtcctgcagctgcacaccaccaggagcccggacttcctgggcatcagcccggagatcagcgacagcatatggtccgccggcctggccgaccacgacgtcgtcgtcggcgtgctcgacaccggcatctggcccgagagccccagctttagcgaacaagggcctcggccctgtcccggccagggggaagggcctgtgccaaaacgggcggcgggcttcaccgtagccagcttccaaccgcaagatcatcgggcgccccgcattcttctaacaagggctaacaaggccttctttcggggcccccattcaacaaagaacggccgaaagcttcaaattcttccccggggaacccaggaacggcccaccggcaccccaaacccgtggggccccaccctccccccggggccccgcccccgttgcccggaaacccc

SEQ ID NO: 92485 - protein, 256 aa, Zea mays
  misc_feature: Ceres CLONE 1581204
  misc_feature (32)..(119): Pfam Name: Subtilisin_N Pfam Description: Subtilisin N-terminal Region
  misc_feature: SWISSPROT Homolog: EC 3.4.21.25 Cucumisin
MGSGGVRWKALPLCLALVALQACLPARGAAPKTYIVQMAASEMPSSFDFHHEWYASTVKSVSSVQLEGDADDHYAARIVYNYETAFHGFAAKLDEDEAERMAEADGVVAVLPETVLQLHTTRSPDFLGISPEISDSIWSAGLADHDVVVGVLDTGIWPESPSFSEQGPRPCPGQGEGPVPKRAAGFTVASFQPQDHRAPRILLTRANKAFFRGPHSTKNGRKLQILPRGTQERPTGTPNPWGPTLPPGPRPRCPET

SEQ ID NO: 92486 - DNA, 2324 bp, Zea mays
  misc_feature: Ceres CLONE 1581205
  misc_feature: Encodes the peptide sequence at SEQ ID NO. 92487
acctcccttccccctctcttcaccgccgccgggaaggccgcagcttccactccaatccttgtctccacttgcccgcgattcctctcaccctcgactcactcactcacccttttctccacttgtgtatccgcggcggcggcggcggcctccactccactccgtccggtccactccctgtccctgggccggacgtttcgtcggtgaatcctcgagctgccgccgtcacgtatgaggaactggagcatcggggccgttgcggccgtcgaatttgcgctctggagctccgtctggtgcttcctggtcgtctccgtcacctgtttctgagccgggatcctactcctcttctcgcgctactatcagtgcagtgcagtaggccactggactgctgtcgtgccggggtagttgcggccaaaggaacaagccaccttctccgagttggaattaggtgcggccctccgcatcaaaagggctcgtttggtgggaactttcgcttgcctactcgctgctgcctgcttcggtggtcctccgtgacgggggattgctggaattggggttggaaggacattctgactgaattgctcgagtgaggggtggggtttcggcacccgttgcttgaggatggaggagaggccatcgtccgaggcaggcgcgggcaactcgagggccgaggacgacttcaggagctgctgcggggacgaggaagagtgggaggacacggaggagtcgttcacggccggtgtcgccaagggggagctggacgaggcctcggtgcgactcttcttcaagggcgtgtcgagccctgaggcggaggggaagaagctgtctgggatcggagtcgtcatggagaggtcgcccggggtgcctgttcttaaggtgcagaagaagctggatttctatgtggaggagctcgtggctgatcacctcgccctcatggatgggctgcttgtcgctctgcagaatgggatcacgaagatcttcgcctttactaattcggagaagctctactttcagatagcagaagctgaaattcttgaagaccagcttttggtagctctaggacacaggattcttgaactggtggataagttggaagactttgatttgatattgcttcctagctttgaactagagaggcccttgcagttggctaaagaagctataggcatcagatatctgtctccctacgaggttggtacctgcccgatttgccgtgaggagaaactaggttctcagatgatcaaggcaggttgttctcacacatattgctataattgcctgactgggtatgttgaagagaagctgctgacctcgaagctgcctataaggtgtccacaattaaggtgtaaatacattattcccgctagtgagtgcaagtcgttccttccagttagcagctatgattccctggagagagcatttgcagaagctggcacctcaggaatggaaagattttattgtccctttccaaactgttcagtgctgttagaccttagtcagcacttctccagggcaagttcatcaagccagtcagatctcagttgtgtcgagtgcccagaatgccatagagatatatgtatcaactgtggagtgccgtggcacatcatgatgggctgtgatgagtaccagagcttgcccgctgaggaaagagatgctggagacctatctttgcatcggcttgcacagaacaataggtggaggcgttgccagagatgtcgacgtatgattgaactgacacagggctgcttccatatgacttgctggtgtgggcacgagttctgctactcctgcggtgctgactacgctagcggcgttcaaacatgccaatgcgtgttctgggacgatgaagccatggagccctcctctgccgcacggtccacccaagcagcgtccgagatctgggcgtgggacacatttgactgcatgccgaccgccgtggaggggtactcggaacaggagagagcgcagctggcgctcatccagaggttcctcgccggggggttcagcctgggtgataacccctgccaatcgccgccccgctgcgccgactcctacatcgtcgacaccatgaaggacctccaccagctcccgtggcttgagcggttcgtgtcggtgatcagcgacacatacaacgatgactacatgcagtgaagagagggagggagggagagacagttatagatagcagtaaaagaaacggcacatactgagtcctccattcagaataatttgtttccatgcccctgtcggcaattggcgcagggaaaaatgatatgctttcatcatgaatacactggtgttgtttcctccaaaaaaaaaaaaaaaaa

SEQ ID NO: 92487 - protein, 509 aa, Zea mays
  misc_feature: Ceres CLONE 1581205
  misc_feature (261)..(332): Pfam Name: IBR Pfam Description: IBR domain
MEERPSSEAGAGNSRAEDDFRSCCGDEEEWEDTEESFTAGVAKGELDEASVRLFFKGVSSPEAEGKKLSGIGVVMERSPGVPVLKVQKKLDFYVEELVADHLALMDGLLVALQNGITKIFAFTNSEKLYFQIAEAEILEDQLLVALGHRILELVDKLEDFDLILLPSFELERPLQLAKEAIGIRYLSPYEVGTCPICREEKLGSQMIKAGCSHTYCYNCLTGYVEEKLLTSKLPIRCPQLRCKYIIPASECKSFLPVSSYDSLERAFAEAGTSGMERFYCPFPNCSVLLDLSQHFSRASSSSQSDLSCVECPECHRDICINCGVPWHIMMGCDEYQSLPAEERDAGDLSLHRLAQNNRWRRCQRCRRMIELTQGCFHMTCWCGHEFCYSCGADYASGVQTCQCVFWDDEAMEPSSAARSTQAASEIWAWDTFDCMPTAVEGYSEQERAQLALIQRFLAGGFSLGDNPCQSPPRCADSYIVDTMKDLHQLPWLERFVSVISDTYNDDYMQ

SEQ ID NO: 92488 - DNA, 855 bp, Zea mays
  misc_feature: Ceres CLONE 1581210
  misc_feature: Translation starting site: 197
  misc_feature: SWISSPROT Homolog: EC 1.4.1.2 Glutamate dehydrogenase
aagctggagctcaccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcctgggcccggtgagaagccaatgatagttgttcagcacaagggggaggagaaacagtttgcagccgaagagatctcctccatggttctcatcaagatgcgtgagatcgctgaagcttaccttggcagcacgatcaagaatgctgttgtcacgggtcctgcctacttcaacgactcacagagggcaggcacgaaggatgctggggtggattgctggcctcaatgtgctgcgtatcatcaatgagccaaccgctgctgctatttgctatgggtcttgacaagaagcaaccagcgtcgggtgaaaggatgtcctcatctttgacctttgggagggggcaccttcgatgcctccctcctaacaaatgc

SEQ ID NO: 92489 - DNA, 1282 bp, Zea mays
  misc_feature: Ceres CLONE 1581214
  misc_feature (15)..(15): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (94)..(94): n is a, c, t, g, unknown, or other
  misc_feature (1223)..(1223): n is a, c, t, g, unknown, or other
  misc_feature (1282)..(1282): n is a, c, t, g, unknown, or other
gggggtttgggtttnattaaaatacagaatattaagcaacaaaaagaaaaaggacaattttggtggggggnnnnnaacaagctggagctcaccncggtggcggccgctctataactagtggatcccccgggctgctttgattcgtctcacccctagaaaaaaccacaccaccactccctccctgccctctcactcccgatccctcctccaccaccgcttcctccgcgtcacccctctcgtcgtcgcctcacgaggcgaccagcggccggaccctccgcgtcacaaccatggggctcttcactgtgactaaaaaggccaccataaccttcgacggccagaaaccaggcacctctgtgtgaaaccaagaaagttacggtataacaaaaaaaaatcagcttttataaacctatcccgtgaatgtataaagtaaccaccttttttttgcaccaaaatcgcatgcgcaaggttgattacacgagaaagaaagaaggtcccccccgtcttttatgcaaaaaaactgaaacagaagccagccacccgtatttatgaatagatcatactacaaccacagagaaaaggacgcctaaaacataaaacgccaacacacaaatctatagggaagcctttaccagtaggcgaataaacaacacacgaacaaaaaaccacgagcaaaatccacgaccaattaaacagtacacccaacaaacaataatccaacttaacccaattccctaaatctcaagtgcagaagtgcggtaacttgcagaagaaaggacagcggcgaggaggagctaccattgagtgtctctggggtggttaacacatacgacgggtatacaatgaaaaaaagtaaatactgtagtgtatgcacgcttaaaatgagggatcatcatcagtaaaacaggtgggcgcgcggcgccgccctacgaatacggacgaggaggtaaacaatataaaatatcgcgaaaatgacattgtgcagtgagattatctttccacactctcgcaaaggtcataaccgacgagcccgcgtattagatccgcgcggttatacaactaacatacttgtcaacagaaactataaaccataaacactacgtcacagaagcgcaaatcagactggaggttgattcagcaccctacccctaaacatataatcatactcgagtgactaggttgtatgtgttgacataggtactcaaatgagccctaaataaatgatntgtgtgtctgcactaagggtatcaacactaatatactagacaatggagcaccatactan

SEQ ID NO: 92490 - DNA, 844 bp, Zea mays
  misc_feature: Ceres CLONE 1581216
  misc_feature: Encodes the peptide sequence at SEQ ID NO. 92491
ctccccgcggtggcggccgctctagaactagtggatcccccgggctgcaggaattcgtctcacccctagaaaagtcgccgccggctgccaacacagtggatcgtccgccgctgaagatgagggaagtatcacggcgcgtcacgcctacacctcggcccactcgctgtcgtcggctgcctacacagggagcccccgccgccgaagaggagggaggtcttgcggcacgggactcggcgacggcgccccctaacacatcgactgggaggtctgcctcactgctgccacactcatcgccagttgaaatccaatttactatgctcaattgcccatcgtgaagaacatataatttatgaatcttgaacttcagaagttcttcatttaccgtcttatgaaacatgaggacaggtttcacaacacattttgacattatatctttatcaagtcagttgtggtgaactgtgaacaaatgtgcttgttatgcatatcaacacctcttgtatttgtattcttcccctagcagtaaggtcaatggcactcagatgggaaataaccgaagcatcttatgccatggcagttgcgctcttcttctttggccactgactcttactttctctttctggtcaaatcttcattctttcagacctctatgctgggttgaacatatgtcgttggacaatgaaactggattagacaaacctggaaatagggtcaggtcagtcacaggccttgttgcagcaaactattttgtccctagatattttggtttggggctgtcttattgcccatttagctcgtattggatatgaagaaagaccatgtacatgggtgcataatgaatgggagg

SEQ ID NO: 92491 - protein, 88 aa, Zea mays
  misc_feature: Ceres CLONE 1581216
  misc_feature: SWISSPROT Homolog: EC 2.3.1.158 Phospholipid:diacylglycerol acyltransferase
MGNNRSILCHGSCALLLWPLTLTFSFWSNLHSFRPLCWVEHMSLDNETGLDKPGNRVRSVTGLVAANYFVPRYFGLGLSYCPFSSYWI

SEQ ID NO: 92492 - DNA, 827 bp, Zea mays
  misc_feature: Ceres CLONE 1581220
  misc_feature: Translation starting site: 643
  misc_feature: SWISSPROT Homolog: EC 4.1.1.50 Adenosylmethionine decarboxylase
ccccgcggtggcggccgctctagaactagtggatcccccgggctgcaggaattcgtctcacccctagaaaaagctcccatctaaaaataaaattttctcacagcgccaccgcgtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaaccacctgcattttcattttgatctccctaatccctccggctagctgctttccagtgaccaaaagatatcaaagaccacttcccgtcttcctcccgtggctgtctgtcatctggctctgaaacgatggcagtcctgcaagttgctgctgctgcccctccccctgtctctgtgattgggttcgagggatttgagaagcgccttgagatcagcttctctgaagcacctgtcttggctgaccccagcggaaggggactgcgttgcgctctcgcggtgccagatcgactctggttcttgaccttgctcggtga

SEQ ID NO: 92493 - DNA, 874 bp, Zea mays
  misc_feature: Ceres CLONE 1581224
  misc_feature: Translation starting site: 215
  misc_feature: SWISSPROT Homolog: EC 1.11.1.6 Catalase
ctccccgcggtggcggccgctctagaactagtggatcccccgggctgcaggaattcgtctcacccctagaaaaacctactccccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggaaacagcgaggtcaaaatccttcctttgaggatatcatctaatcgaaaagcttgctcagttcgacagagaacgtatccctgaacgtgttgtgcatgcacggggaggcagttgcaaagggtttctttgaggtcactcatgatggcccctcacctaaaatggggcgaatttctcccgggccccggggggcccaaaaccctgttatgggtcgtttttcccacagttggggcataaaccggggaccccccgaaaacctttggggggaaccccccggggtttttccggtccaaaattctcccccccggaaggggggaaacttttgaccccccgggggggaaaaaaaaaggccccgggggttttttcttcccccaagaagggggggggaaaaatttcccctggaaaagggggccccccccttttttttgggccggcgaatccccaaaggaacctttttttttttggggggaaaaaaaggggggaaaaaaaaaaaaagaatttttttttcccccctctcccccccccccccaaggaagggcccccccacagagatgttgttcc

SEQ ID NO: 92494 - DNA, 816 bp, Zea mays
  misc_feature: Ceres CLONE 1581227
  misc_feature: Encodes the peptide sequence at SEQ ID NO. 92495
ggagctcaccgcggtggcggccgctctagaactagtggatcccccgggctgcaggaattcgtctcacccctagaaaaaacacaccacagcactaaaatctgttcatctctggctccccaaattcagctggagagcactttttcccatcatggataagaactacggtgaactctacaacatcctcggattgggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccaacaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcacgacatggttaggttcggccagcaatggaactatgggctcgatgctggctccaagccagaactgctcatcgacgtgagctgccttcccgtcaccggaagccgaccccaaggccgtacttgaatctgcaaacggctaccaagaccacggactaaaattgggctctgtgttctttggcacggggcagggggcctgaacccccgtcatcctggtctccaaattggaaggaaaaagcctggccctccctccccctcaccaaattaaaagaaacctgtgaaaaaaaaaactggccaaaaaacaaccattgtccgaggcccccaaaaaaa

SEQ ID NO: 92495 - protein, 154 aa, Zea mays
  misc_feature: Ceres CLONE 1581227
  misc_feature: SWISSPROT Homolog: EC 4.1.1.19 Arginine decarboxylase
MDKNYGELYNILGLGEEYFAVNTEGHLSVKPFGRWTEPGQEIDVHSVIVEALATQPNDSTNKSQFPMILRFPDVLKNRIETLHNAFNSAMESTGYTSRYQGVFPIKVNQNKHVVHDMVRFGQQWNYGLDAGSKPELLIDVSCLPVTGSRPQGRT

SEQ ID NO: 92496 - DNA, 843 bp, Zea mays
  misc_feature: Ceres CLONE 1581228
  misc_feature: Encodes the peptide sequence at SEQ ID NO. 92497
  misc_feature (530)..(530): n is a, c, t, g, unknown, or other
  misc_feature (577)..(577): n is a, c, t, g, unknown, or other
  misc_feature (655)..(655): n is a, c, t, g, unknown, or other
ccccgcggtggcggccgctctagaactagtggatcccccgggctgcaggaattcgtctcacccctagaaaaaaccctttcttcctcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcaccccaccttctcccaaggtgctgttggtgccccaggtggaggcaactggcgaagtgtgtgcgttctttgcttgatcaactaggttaagccatttcttgccccagtgttctccgattcatggttgtggaactagtccgagaatagctggagctgctcgttttcccttccagaagacgaangcggggggcgaggcgatcgtttgagcggtacctgttgcgcgcctgangcggtgcaatcaatgtcgtcttcctgcataccgaccggcctgcggctggacctggacatggtgaaggcgggcgcgtcnccgggtgggcgcgcactcgtcgccgctgcggccggcgcacaactcgtcggcgtcctcgacgctgtcgtcggaagggttcaacggcctcgtcatcgtcgggcgacctcggtgtcgcttaaggcgggctcccgcgccgcggaaacgggccaacccaggggtacaacgaggccgccgggcctggtcgcgtc

SEQ ID NO: 92497 - protein, 84 aa, Zea mays
  misc_feature: Ceres CLONE 1581228
MSSSCIPTGLRLDLDMVKAGASPGGRALVAAAAGAQLVGVLDAVVGRVQRPRHRRATSVSLKAGSRAAETGQPRGTTRPPGLVA

SEQ ID NO: 92498 - DNA, 835 bp, Zea mays
  misc_feature: Ceres CLONE 1581232
  misc_feature: Encodes the peptide sequence at SEQ ID NO. 92499
ggagctccccgcggtggcggccgctctagaactagtggatcccccgggctgcaggaattcgtctcacccctagaaaaagtgtccgatggctcgcccccgccgcctcctctgacggtctgactgacccccgcctccccggagagcggctccgctgtctcgccggatatggcgccgcctcgtccccctcctaacccggcgggggagcagcagccgcagctccacggggtggtcatcatcacgctccctcccgcggaccagccctccaagggcaagaccgtcaccgccttcgcctacaccaacgaccccccgccccctcgctcgcccccggatccggttatggggtacccggcggcaacggaggctaggcggcggccgaggcgggcgctctcgacgcggcgggtggcgacggcggcgctcgtgctgggcgcgctcgcggtcgccgcctactactgcttctactcggacgtggccgtgcagttcctggggatggagcaggaggaggagcagaggaacgagaccaggtctttcctgctgccgctctaccccaaggcgcgtcagggccgcgccctgcgcgagttcggggacgtcaagctcgccgccaggagggtagacgacggcggaagaaaggctaggaacaggatggaggtcgcgaaggcggccacggccgaggacaatttcacggcgttgctcccgatcaagggcaatgtcttccccgatggccagtattacacatctatctttattgggcacccctccagaccatactttccttgatgttgatcctggaagcgacctggccggggattcagtggtgatggcccctggtaccaaccgg

SEQ ID NO: 92499 - protein, 202 aa, Zea mays
  misc_feature: Ceres CLONE 1581232
MAPPRPPPNPAGEQQPQLHGVVIITLPPADQPSKGKTVTAFAYTNDPPPPRSPPDPVMGYPAATEARRRPRRALSTRRVATAALVLGALAVAAYYCFYSDVAVQFLGMEQEEEQRNETRSFLLPLYPKARQGRALREFGDVKLAARRVDDGGRKARNRMEVAKAATAEDNFTALLPIKGNVFPDGQYYTSIFIGHPSRPYFP

SEQ ID NO: 92500 - DNA, 799 bp, Zea mays
  misc_feature: Ceres CLONE 1581233
  misc_feature: Encodes the peptide sequence at SEQ ID NO. 92501
ccccgcggtggcggccgctctagaactagtggatcccccgggctgcaggaattcgtctcacccctagaaaatcccactccggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcgccgggcctcggccgtccgctgctcgctcgacagtaacgtctccgacatgggcgtcaacgctcccaaagggttattcccacccgagccagagcactacaggggcccgaagctcaaggtggccatcataggggcaggccttgcgggcatgtccaccgctgttgagctcttggaccagggccatgaggttgatttgtacgagtcccgtccgtttatcggtggtaaggttggctcctttgttgacaggcaaggaaaccatatcgagatggggctgcatgtgttcttcgggtgctacagcaatctcttccgcctcatggaagaaggttggcgctgataaataatctgctggtgaaagaaactaccccatacttttgtaaataaggggggcacgaatgggtgaacttgatttttccgttccccggttgggagcctcggttacatgggcattccaagcattccctaaaaaactaattcacccccagggttttttgaatacacccaaagaaattggcgttg

SEQ ID NO: 92501 - protein, 139 aa, Zea mays
  misc_feature: Ceres CLONE 1581233
  misc_feature: SWISSPROT Homolog: EC 1.14.99.30 Carotene 7,8-desaturase
MASVAATTTLAPALAPRRRARPGSGLLPPRRASAVRCSLDSNVSDMGVNAPKGLFPPEPEHYRGPKLKVAIIGAGLAGMSTAVELLDQGHEVDLYESRPFIGGKVGSFVDRQGNHIEMGLHVFFGCYSNLFRLMEEGWR

SEQ ID NO: 92502 - DNA, 901 bp, Zea mays
  misc_feature: Ceres CLONE 1581234
  misc_feature: Encodes the peptide sequence at SEQ ID NO. 92503
tccccgcggtggcggccgctctagaactagtggatcccccgggctgcaggaattcgtctcacccctagaaaaatctgcctttatgctccccagtccccacctaacccaaaccgaaccggcccttcgcacttccgcagaacgagcactcgtggaccaaatatttggcacaagttacctttgcctgtttcttgcgtgtagatccctcaaggtttctccgccgcgcgcccgtgcccttcgccggagcttgccatatgaatggtcaaaccccgatggggctcgccgccgtagcagtgaggccgtgctgcagccgcctcatctcgtccgcctccgccgccgcggcgtcaaagacggcggcgggcaccgcgacctcgctcttccccagattgccccacccgcaccaccccccgtacggtcggcgcctccccttcctcgtctccgcggcggtccagtcgcagggcgacccgggcactcctcccacccctgtaccagtccccgtccccctcgaccccccgcgctgccgtttccgggaaccatccctttcttcaaccgcgaaccttttttcggacttctttcccgccttaaaacccccgccctctaaagaaggaaggaggaccccggccacccattaaaaacttatgaagggggtggggcccggccctcccccttttagggaaagaaccggacaactaagaaggcaggcgtggaatggtctgcttcccaaagggccatcccttcccttaactgggggcaaacccctttggggaaaagttgcgcttgggaaaggcccctcaaaagggccccccaaattctttacttaaagaacccgttcttttttcctttagtgaattatagagggcgcgtcaacagcttaagctcctccccacctggttgggcgagagaa

SEQ ID NO: 92503 - protein, 125 aa, Zea mays
  misc_feature: Ceres CLONE 1581234
MNGQTPMGLAAVAVRPCCSRLISSASAAAASKTAAGTATSLFPRLPHPHHPPYGRRLPFLVSAAVQSQGDPGTPPTPVPVPVPLDPPRCRFREPSLSSTANLFSDFFPALKPPPSKEGRRTPATH

SEQ ID NO: 92504 - DNA, 1218 bp, Zea mays
  misc_feature: Ceres CLONE 1581236
  misc_feature: Encodes the peptide sequence at SEQ ID NO. 92505
  misc_feature (15)..(15): n is a, c, t, g, unknown, or other
  misc_feature (72)..(72): n is a, c, t, g, unknown, or other
  misc_feature (74)..(74): n is a, c, t, g, unknown, or other
  misc_feature (839)..(839): n is a, c, t, g, unknown, or other
  misc_feature (844)..(844): n is a, c, t, g, unknown, or other
  misc_feature (865)..(865): n is a, c, t, g, unknown, or other
  misc_feature (971)..(971): n is a, c, t, g, unknown, or other
  misc_feature (1010)..(1010): n is a, c, t, g, unknown, or other
  misc_feature (1017)..(1017): n is a, c, t, g, unknown, or other
  misc_feature (1156)..(1156): n is a, c, t, g, unknown, or other
tttgttttttttttnttgtttttatgcttgcggcatgcgagctgcggggggtattgtttagatcaatataananaaaagctggaagctcccgcggtggcggccgctctagaactagtggatcccccgggctgcaggaattcgtctcacccctagaaaaaagcattgaacaatctgctccgggcaccatggagaggatcagtgggccgagcctcgatgtcctgctcgctctcgccatcctcaccgccgtcgccgcagcggacacggacgaggtgcgcgcgcagtccacctacatgctggacctcgccccatgccacccggcgctgaccacagcgcgcgacaacagcggcgacaaggcggccctacgccgcctcctcgcgcgccccctgggcgcgccgaggccgcgcgtgctccgctcctaccagcacgctgccacgtgcgtcaccgcgcggctcacgccccaacacgccggcccacaccgcgcccaggggagggcagtactgaccgctgtacccctaacccagtcgccgggcagcttgcacaccacccaaggccccggttcttgtcctccccgcactaaaccccaggcactcgggggccaacctccccggcctggctaacagggggggggcgcttttcagatcttcccagaccggtccgtctcgaaaactgtcctctaatcacccacgggggctcctctataatccccataatggtttccgggatccgcccatgatattgcatgcacaaaaccaacacacgggaggggttcaaggggacccgccaatagacctcagccccggtttacccttgttttattgagcgagagggaatagtgganttatntcattccgccggaggaaacancctctataacaaaagaaggtgttcataggccgctgatacgtgtgaagaattagaccaaagagccatataatatcggggtgggcgcacagaggatatattttaaatntcaccatagcgggggtgggtgagaaaaaagacgggtatnatccgtngagccgccaccccacctaactcacaatgtataataccacaaagggtgagcactcgtaagatctccgcgcctcttatagaaacaccattagtgggcggcgccctagatgtatcaggggcagcaaccccacacatccaccnccggggcgcagcctattgtatcttacccaccaggtggtgagcccctcacgatgcgcggaaaa

SEQ ID NO: 92505 - protein, 143 aa, Zea mays
  misc_feature: Ceres CLONE 1581236
MERISGPSLDVLLALAILTAVAAADTDEVRAQSTYMLDLAPCHPALTTARDNSGDKAALRRLLARPLGAPRPRVLRSYQHAATCVTARLTPQHAGPHRAQGRAVLTAVPLTQSPGSLHTTQGPGSCPPRTKPQALGGQPPRPG

SEQ ID NO: 92506 - DNA, 867 bp, Zea mays
  misc_feature: Ceres CLONE 1581240
  misc_feature (867)..(867): n is a, c, t, g, unknown, or other
ctggagctccccgcggtggcggccgctctagaactagtggatcccccgggctgcaggaattcgtctcacccctagaaaaagccgttttcgtctcaatcgcacacttcgacgtggtgttcgcgttgacgctcctccgtcacagtgcagcagcacctcagagtgatcctcgcagacgctattagcactgctctcgccgtcctcgactcccgctcggatagtagggtaactccgcgagcgtggtatccgctcgtcacggaaagggcggacagcccgcgcggggcttgcacaggcgcccacgccggtctccgattccgatatgaccgtccgataggatgccgtgccgtgactccttgccacagagagatagcttcatgagagtctgctgaagatgttctgatgaggcgtactcagcgagaatgatctgtctaggcaacctcagtccaagttcagagagtgtcctcttgagcacgttctcacagtcaggctcactgtgactgctagctcaagcatccggtgtacgaacattttggccaaaacacggggctagctgctggtattctggctacgcccagcacgggcttgcagattgtgcggacttatcaggccttggaggaatactccccttccagcggctttgtctgcctccagcacaggaagagtctgtaccctcatgctgccaggaggccttgaggtgacttctcttcaatgactctgtcatcgcaaaggggaattgcagaagcagtttatttgatggcgaacccacatttatttcttagatcgaggacgagcttccattcgggacagaagactccactgtgaggcatacatcgggtatcttaaaaccgcggcacttattgtactggactn

SEQ ID NO: 92507 - DNA, 854 bp, Zea mays
  misc_feature: Ceres CLONE 1581246
  misc_feature: Translation starting site: 140
  misc_feature: SWISSPROT Homolog: EC 2.2.1.6 Acetolactate synthase
  misc_feature: SWISSPROT Homolog: EC 4.1.1.47 Tartronate-semialdehyde synthase
  misc_feature (854)..(854): n is a, c, t, g, unknown, or other
acccgcggtggcggccgctctagaactagtggatcccccgggctgcaggaattcgtctcacccctagaaaaactcccactccgtgtccgtggcacccaccccaaaccctcgcgccgcctccgagacagccgccgcaaccatggccaccgccgccgccgcgtctaccgcgctcactggcgccactaccgctgcgcccaaggcgaggcgccgggcgcacctcctggccacccgccgcgccctcgccgcgcccatcaagtgctcagcggcgtcacccgccatgccgatggctcccccggccaccccgctccggccgtggggccccaccgagccccgcaagggtgctgacatcctcgtccagtccctcgagcgctgcggcatccgcgacgtcttcacctaccccggcagcgcgtccatggagatccaccagacactcacccgatcccccatacatcgccaaccagctcttccgccacgagcaatgggaggcctttgccgcctccggctacgagcgctcctcgggccgcgtcggcgtcagcatcgccacctccggtcactgcgccaccaacctaatcacttcgctcgccgacgcgctggtcgattccgtacccatggtcgacatcacagggacaagtgccgcgactcatgattggcaccgacggtttacaagatacacccatagtcgaggttacgctttccatcactagcacaactagctgaggcctcgacgtccactgacatcacccgaatcctgacaggaggcttttcttactaacactcgtctggttcaaccaagggccgggtgcttgcccgaacatccccgatggacatccaaacagcacaaggccgggtggccn

SEQ ID NO: 92508 - DNA, 840 bp, Zea mays
  misc_feature: Ceres CLONE 1581249
  misc_feature: Encodes the peptide sequence at SEQ ID NO. 92509
ctccccgcggtggcggccgctctagaactagtggatcccccgggctgcaggaattcgtctcacccctagaaaaactagaaaaaatcctctctaacccacggaagcaagacaaaagctcgtgctggacgacatctcccctgtcgatccacgaccatgatgcagcagctccgtcacagccagccgagcccgtgcctctgcggcctgcgggcggcacggcctatgctcgccctcggcgcagcagcatcccgttcgcggcccgccggaaaactgcaaccgagcgtctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtggccggcgtgtgtcaaggaagaaacgccgagcgccctgctcaagtaccgggaggacgagctcggcgcgctccggggagacggcgagacgacggagcgaccgttccagccgtggggacgcgtgtacgactacgcgctgtacaacgacctggggaacccagacctgcgccagggactggcgcgccccgtgctgggaaggatcccaggagtacccgttaccctcggcggtacaaagacccggccgaccagccgccaaaacagaatcctcggttccgaaaaacaaaagcgccgctgggacgaaaaaaatttacgttccccttgcgaacaaagggcggttgggttttcgcaggtatccccgggggcgggagcgct

SEQ ID NO: 92509 - protein, 152 aa, Zea mays
  misc_feature: Ceres CLONE 1581249
  misc_feature: SWISSPROT Homolog: EC 1.13.11.12 Lipoxygenase
MSEASCCCRTSPPTASSGSSSPSSLSAPPWPACVKEETPSALLKYREDELGALRGDGETTERPFQPWGRVYDYALYNDLGNPDLRQGLARPVLGRIPGVPVTLGGTKTRPTSRQNRILGSEKQKRRWDEKNLRSPCEQRAVGFSQVSPGAGA

SEQ ID NO: 92510 - DNA, 811 bp, Zea mays
  misc_feature: Ceres CLONE 1581251
  misc_feature: Encodes the peptide sequence at SEQ ID NO. 92511
  misc_feature (773)..(773): n is a, c, t, g, unknown, or other
  misc_feature (811)..(811): n is a, c, t, g, unknown, or other
ctccccgcggtggcggccgctctagaactagtggatcccccgggctgcaggaattcgtctcacccctagaaaaagcgtgctttccagccctctgcccgctgtgccccacccccacgcccggcgacccgcaggccgcacccacccacccacccgcacccagcgccatgtccaccgcggccaccgcgtgcgccacgcgggcggcggcgcgtccgcccctcaacacggctccggcacgccgcgcgccgccttctgccgtgcgcccgccatcggccacccccgcccgccgcgccgccggctgttgcttctgcgccgccgcctcctcggcgtcgtcgccctccacctgggattggacccgatggagccgccacttcgacgaggtcgaccaggcggagagctacgcatccctcctccagttccagctagaggaggcggtggagaacgaggatttcgcggaggccgccaaactcaagagggacatcatagaggccaccggaaacgacgctgtagcccacgtcatggccgagctcaagaatgctatagaggaacagcggtaccaggacgcgtcaaggttgacaaggcttgctgggaccagcttggaggttggtgggggtggggatatgctaaggacactgatgattccatcgggagaattgtacgaataagccctggtgtcgggagatatgtggcgaagagctacaacccaaggcaattggtcactgcatcttcaggaactccattatttgaaattttccttgtcaaagaagatgatgagnacatatacaatgaaaggtggtacacatgcgaacaacan

SEQ ID NO: 92511 - protein, 165 aa, Zea mays
  misc_feature: Ceres CLONE 1581251
MSTAATACATRAAARPPLNTAPARRAPPSAVRPPSATPARRAAGCCFCAAASSASSPSTWDWTRWSRHFDEVDQAESYASLLQFQLEEAVENEDFAEAAKLKRDIIEATGNDAVAHVMAELKNAIEEQRYQDASRLTRLAGTSLEVGGGGDMLRTLMIPSGELYE

SEQ ID NO: 92512 - DNA, 871 bp, Zea mays
  misc_feature: Ceres CLONE 1581255
  misc_feature: Encodes the peptide sequence at SEQ ID NO. 92513
  misc_feature (806)..(806): n is a, c, t, g, unknown, or other
ctccccgcggtggcggccgctctagaactagtggatcccccgggctgcaggaattcgtctcacccctagaaaaaacactcctcttctccccccaaaaaaatcttgtagtagcagcaagcctcgacgtaatattaggaggaggagaccatcccaatcccccacggacattcgccgcgaacccttatttgcatgccgtgccatggccgctgccgccgccgccgcggtcgctcatctctccatccacggtcgcttacgcacgtctcatccggatcatcggctgtctatcaccaccaccacgcacgttctccttttctccgtccgctgactgcccgtccttgctgcggtgccgcgcgttcaagcaggacgccagcgacagcgacgcgggtgaggccgacgcgctcaagcgcaggaagggcccgctgtacaagctcaaagcagcgatccagggcctggcgggatcatgctccgccgccggcgatgtgtacggaggagagtactagtatgagtgcgccgtccagaaggcggaggagatattcttctcggttgctactcagctaggcagatatgttatcactatgatgagcatcggtgttgtacttgggggttggaattcacgctgtcatgcgggagacagccaaatgagcgaactaatttggtatagcctggcttggtggggttgattatcttcacaaagataagtgccaaaagttgtctaagatggaacatcgtcaaaggtggggaggtggtcaatgcacgaccataacttgggaatcccaacgatggggtaagggacaacgcgcttggcntcccttgaggtttctttcttttcctgggagacaccgggttagtaaattaacgttcattaaaaagt

SEQ ID NO: 92513 - protein, 165 aa, Zea mays
  misc_feature: Ceres CLONE 1581255
PRGGGRSRTSGSPGLQEFVSPLEKTLLFSPQKNLVVAASLDVILGGGDHPNPPRTFAANPYLHAVPWPLPPPPRSLISPSTVAYARLIRIIGCLSPPPRTFSFSPSADCPSLLRCRAFKQDASDSDAGEADALKRRKGPLYKLKAAIQGLAGSCSAAGDVYGGEY

SEQ ID NO: 92514 - DNA, 797 bp, Zea mays
  misc_feature: Ceres CLONE 1581257
  misc_feature: Encodes the peptide sequence at SEQ ID NO. 92515
  misc_feature (614)..(614): n is a, c, t, g, unknown, or other
ggagctccccgcggtggcggccgctctagaactagtggatcccccgggctgcaggaattcgtctcacccctagaaaaagctccctccacccggattccgccaggattgagttaatcgcatcgcatcctctctcttcctccccccgattgttccatctgggtcgcgttgcttctttcttcccgatttgccgccgccatccacgtcttgcaggagtaggactccgccctgtccgtcctatccacctgtcctcgcttccgtccacgccatcgccgcgctctctctccctgctgctgctttcttgggccggtccggggcttcgtccctgccgggcgtaaatgcgcgtccgtgcagcggatcccagccttcgccgctccaagtcctgtcctcgtctgattccaactaggagcaggaggaggagaatcttctgcgcatgctaatcctagcagcggtggccagagatgacgaaatcgttctgacttcacctgcgctggcggctgctcagctccgagccccgagtactgagcccctccactgctatggacatcttcttgatccgcgcctgtctcctccggctgctgctggtgctcttcgccgcccgcccgccactctcgggnggcggcgcagtcgcagcccgcggtcgccccgcaggatactcggacgcggcgctgcaaggactacgcgttaccgggccctttggggggcccccgaaacggggatggtcttaaaaggcccccggcttccgggggaaccccttcccgggattttgccgggtttccccggggtccccccttgggaaa

SEQ ID NO: 92515 - protein, 62 aa, Zea mays
  misc_feature: Ceres CLONE 1581257
MDIFLIRACLLRLLLVLFAARPPLSGGGAVAARGRPAGYSDAALQGLRVTGPFGGPPKRGWS

SEQ ID NO: 92516 - DNA, 861 bp, Zea mays
  misc_feature: Ceres CLONE 1581258
  misc_feature: Encodes the peptide sequence at SEQ ID NO. 92517
ctccccgcggtggcggccgctctagaactagtggatcccccgggctgcaggaattcgtctcacccctagaaaaaagaagcccactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggccccctccatctggggattcattcgcggcaccttccccaggaaatattgcaggggaatcaaaatggagacgtttcaatggaatcataccctcgcctacaaggaaaaacgtccattctcttgaaaagttttgacctttgatgcgctcccggtttctcattctcaggggcccagaatcttccccggaaggggaagggaaaattcattcccaaaagggggggccgatttcccataattttgataaaaatatttcctcttttgcaaagggggtgaaccccttatataaaccccttttccccaaaagaattctccctccttgggcctgaaaaaaaaattttgtgggggggggggtttaccccccaaaaaagggggggaattttttttaacaacaacaataggcgattctttttttttttataaaaatctccgggggaaagctcttcttaaaaacg

SEQ ID NO: 92517 - protein, 110 aa, Zea mays
  misc_feature: Ceres CLONE 1581258
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASTNGRGPLHLGIHSRHLPQEILQGNQNGDVSMESYPRLQGKTSILLKSFDL

SEQ ID NO: 92518 - DNA, 828 bp, Zea mays
  misc_feature: Ceres CLONE 1581259
  misc_feature: Encodes the peptide sequence at SEQ ID NO. 92519
  misc_feature (631)..(631): n is a, c, t, g, unknown, or other
  misc_feature (739)..(739): n is a, c, t, g, unknown, or other
ctccccgcggtggcggccgctctagaactagtggatcccccgggctgcaggaattcgtctcacccctagaaaaagtcatagagagagccactggccacaggtaggcaggcaggaggacgagtcggcaaggaagctgcctgctttcagaaagagtcatagagatagttattaagatggcgttgcttcggctgcttgccctctccctgctcttcgcagtggccactcctgtcagggacatcgcccacgatgcctgctcgtcagaagtgaaggatttccagcacctgaacaacagctcggggctccacctgacgctgcaccacccgcagagcccctgctccccggcgccgctgcccgccgacctccccttctccgcggtgctcgcccacgacggcgcgcgcatcgcgtcgctcgccgcgcgcctcgccaagacgccgtcctctcggcccaccttgcttgacgagagccgcgcggggtcgtcgtcgtcgtcccccgatgacgagtccctcgcgtccgtgccgctcggcccgggcacgtccgtcggcgtcggcaactacgtcacccgcatgggcctcggcacgccggccaagtcgtacgtcatggtcgtggacacggggtcctcgctcacctggcntcagtgctccccctgcgtcgtgtcgtgccaccgccagtccggcccggtgttcaccccaaggctgtcagctcctacgccctcgtgtcctgctccgcgcagcagtgaagngacctcacaacgccacgctaaaacccgcctctggctccactcaacgtctgcatttaccagccagctacggggaacagctctttttcggg

SEQ ID NO: 92519 - protein, 218 aa, Zea mays
  misc_feature: Ceres CLONE 1581259
  misc_feature: SWISSPROT Homolog: EC 3.4.23.12 Nepenthesin
  misc_feature (153)..(153): Xaa is any aa, unknown, or other
  misc_feature (189)..(189): Xaa is any aa, unknown, or other
MALLRLLALSLLFAVATPVRDIAHDACSSEVKDFQHLNNSSGLHLTLHHPQSPCSPAPLPADLPFSAVLAHDGARIASLAARLAKTPSSRPTLLDESRAGSSSSSPDDESLASVPLGPGTSVGVGNYVTRMGLGTPAKSYVMVVDTGSSLTWXQCSPCVVSCHRQSGPVFTPRLSAPTPSCPAPRSSEXTSQRHAKTRLWLHSTSAFTSQLRGTALFR

SEQ ID NO: 92520 - DNA, 802 bp, Zea mays
  misc_feature: Ceres CLONE 1581260
  misc_feature: Encodes the peptide sequence at SEQ ID NO. 92521
ctccccgcggtggcggccgctctagaactagtggatcccccgggctgcaggaattcgtctcacccctagaaaaaagattgctgattgtcgatgatggtgctgggcctttcagtcgcttgccctcagtggctgagtacctcctggactcttcccccttagagtccgccgcccccgctgctgggcgaatctcctccggtccccgccgaaggctccggtcctcgcgggtatgcctgttcagacggactacctgtccatgccctgcttggctgtctcacacagtatgctaactgctgccctatcccacatcaacgaaacgatctctgctggtgggcatcccctggtccctgctgctcctgccgatgctgctccgatacctggcaacgtcggcgtcctggtccgcgacataacataccggaagctgcccgcgcaggattccggactcggtcaggacggctctgggagtgctgacctcgacgatctgcttcatttcgtctacgtcccatgataggagacactcgctacgtgcgtgtcacaaggactcgcccgccgtcacggatgtgaggtcatcgagctccgccttggatggatgcctatccgggctgtctcgtatccagtttgtaccgaggactagtctccgttttatgacttcgtaatcagatgacgaacgtcatcgctgatgtatataccaaagcgtatgggcaacattcatacacttttagcacattctattgatcgcttacggaatgattctatggtgttgacaatggaaactttgagcccctttggatgtttttcactccta

SEQ ID NO: 92521 - protein, 42 aa, Zea mays
  misc_feature: Ceres CLONE 1581260
MYIPKRMGNIHTLLAHSIDRLRNDSMVLTMETLSPFGCFSLL

SEQ ID NO: 92522 - DNA, 774 bp, Zea mays
  misc_feature: Ceres CLONE 1581263
  misc_feature: Encodes the peptide sequence at SEQ ID NO. 92523
  misc_feature (283)..(283): n is a, c, t, g, unknown, or other
  misc_feature (764)..(764): n is a, c, t, g, unknown, or other
ctccccgcggtggcggccgctctagaactagtggatcccccgggctgcaggaattcgtctcacccctagaaaaaaaagaaaggctcacaatacccacctccatttagctactactactccctcgctgtcttccccaaccaacaaatcgacctagctaggcacaagagcgctagacgccgcagcgcagcacgcaccacccaaccgagcggcggcggaagcagggcaatccgcagggagcagaggcgcgcgcgcggcatggcgcgcggtgcacggcgcctcgccntgtctcctgctcctggtggggcaggggccgcccccagtgaacgcccccaggaaaccaaattgccgaccacggggtccggggctaccggggcaacgggggccgaagtcaactcccaaccccgtgcctggggggcccggggggaattccccccaacacaggaaagttgggcggaaaattggggggaaaaaaagggccttttccccccttgggaaaaacccgggggggggaaccccccccctggggagaaaaaaaaaaaaaaggggttacccatttttttttttgtccgccccccgcaaaaaaaaaaaagagccctcttttgaaaagggggggggacccctttttacccccccgcaaatttttaaggaggcccccctccctccttttgggaggggaaaacgccgcgggaaaaaaaaatttggggtgggggcttcccgaagaggggcgagcgatgtttctgtgttttaaaataaaaaggaggggncggcccccgc

SEQ ID NO: 92523 - protein, 115 aa, Zea mays
  misc_feature: Ceres CLONE 1581263
  misc_feature (10)..(10): Xaa is any aa, unknown, or other
MARGARRLAXSPAPGGAGAAPSERPQETKLPTTGSGATGATGAEVNSQPRAWGARGEFPPTQESWAENWGEKKGLFPPWEKPGGGNPPPGEKKKKKGLPIFFFVRPPQKKKRALF

SEQ ID NO: 92524 - DNA, 886 bp, Zea mays
  misc_feature: Ceres CLONE 1581264
  misc_feature: Translation starting site: 267
ggagctccccgcggtggcggccgctctagaactagtggatcccccgggctgcaggaattcgtctcacccctagaaaaaacggacgagcgaggcagccccgcaggtcgcagccacaacccaagcgcagcgatctgcctccgctccggctcagctcccgccctgcctccgccttccattccgccgcgcggcgctgccgagtgccgacgtcgtccccgccggagtttctggtttctgggttggatctctcggagtcggagcgagcgaggatgggcggcggcaacggtgaaaccacccagctgggggagccactgctggcgaagaaggcgaaggcgtaccgccctaggtgccccggctgccgggtggaccgcctcaacgcggagcgggagggggtcttccctctcaaggacctcttcctcatctggctcgtcaccatcacctgcaccctgccgatccagtctctgttccccttcttgtatttcatgataagggatctgcatattgctaaacaaacacaagaccttggattttatgctgggtttgttgggcgcttcatatatgtgggggagggcagtctcctcaacagtatggggaatcggggctgataagtatggaaaggaaacagttatcgtacggacccttaattgcaatagttatcttcaatactaggtttgggacaaggctcaaactattgggatgggatttaatccccccaatgcctggcttggaaaacagggggggggttacccccgggccccaattaagggcttaagtgcctaaacaaaatgttggcccaaaaaaaaaaaacacactttccgggcccttttgggaagtgtgtttttcctttcccccccggaaggggcaaatggggccctcactatattagagg

SEQ ID NO: 92525 - DNA, 840 bp, Zea mays
  misc_feature: Ceres CLONE 1581265
  misc_feature: Encodes the peptide sequence at SEQ ID NO. 92526
  misc_feature (477)..(477): n is a, c, t, g, unknown, or other
  misc_feature (480)..(480): n is a, c, t, g, unknown, or other
  misc_feature (488)..(488): n is a, c, t, g, unknown, or other
agctccccgcggtggcggccgctctagaactagtggatcccccgggctgcaggaattcgtctcacccctagaaaaaaaaaggtcgggaaaaatccgaaatggccgctagtggcctcggtctctccacctccttcctccccggccacgacaccctcctccggcgccggcgccggcggccggcgggccacgccgccgcgtcgttccggccggtgacggcggagctcggcggcgtcgcgacggagctgggccgccagctggtggaggcggtgggcgtggggctcccctgcaccgtcatgcagtgcggcgacgtcatctaccgcagcacgctcccccggaacgacgggctcaccatcacggcccccggcgtcgcgctcgcgctcgctaccgtgtcgtacctctggtccacgcccggcgtcgcgccggggttcttcgacatgttcgtcctcgccttcgccgaacgcctcttccgcccttccnttncgcaaggnatgattttggtaattttgggaagaaagccttggggaagggggccatttccgggggtcccggttttaaaggggttttccctgggggaaaaaccccccaaaaagggggggaaaaaaaaaaaaaaggggggattttttgtgctcccttttaaaaaaaagggccccccccacattttgtgtggggggcgcgcggggggaaaatattttttggtaaaaaaaaaaaaaaaaaaaatctttttttagggggggggggggagggcccccccccccccaaaaaaaaaattttggggggggggggggagggtattttttatttttttttttgtttgtgggtttgtttttctttttaaacaaa

SEQ ID NO: 92526 - protein, 209 aa, Zea mays
  misc_feature: Ceres CLONE 1581265
  misc_feature: SWISSPROT Homolog: EC 2.7.11.1 Non-specific serine/threonine protein kinase
  misc_feature (127)..(127): Xaa is any aa, unknown, or other
  misc_feature (128)..(128): Xaa is any aa, unknown, or other
MAASGLGLSTSFLPGHDTLLRRRRRRPAGHAAASFRPVTAELGGVATELGRQLVEAVGVGLPCTVMQCGDVIYRSTLPRNDGLTITAPGVALALATVSYLWSTPGVAPGFFDMFVLAFAERLFRPSXXQGMILVILGRKPWGRGPFPGVPVLKGFSLGEKPPKKGGKKKKKGGFFVLPFKKKGPPHILCGGRAGGKYFLVKKKKKKIFF

SEQ ID NO: 92527 - DNA, 838 bp, Zea mays
  misc_feature: Ceres CLONE 1581266
ctccccgcggtggcggccgctctagaactagtggatcccccgggctgcaggaattcgtctcacccctagaaaaaatcgacctcctcgatccagacagcaggcagcagccatgtccaaggtcttcaccctcgacgcggtcgccaagcacaactccaaggaggattgctggctcatcatcggcggcaaggtatacatctccgtctcctcttccacttcccctcccccattcccttacggtggatggatggtcgatgcctcctgttctcttcctccccagccagccatggctcccttgccaaagatcagattttgcgtctcctagccacgccgacgggccctgctcgattttggtgctaggtagccttgttctgtccaagatggattctccttgattctgcgtgtgctggcgacgagcccgcagatccggtggagaccatcgtgattgatctgtccggtgcttgtttcccgcgtagactcttgcactagcgactggtctctgttctcggggcggccgattcagagtcagatagcctctcgttgtttcagctgacgactcgcggctgctccggtggatgtttacagtccagtgcctgcgcacccacaaaccaatcgaatctgcgtgtgtttcgttcgtatctgcaagcagaccccctacttcggcaattgcctgcacctttgtgcttgtgatgtcatcttttatcctgatgtctccttgtaatgactaatgaggaaattccctttctgcaagtgccatagcgcggtcagaatgttggctatgtcctgtgtcaccccatgcgacagccatcaaacatcagcaacaattccttgaatagaatgg

SEQ ID NO: 92528 - DNA, 850 bp, Zea mays
  misc_feature: Ceres CLONE 1581270
  misc_feature: Encodes the peptide sequence at SEQ ID NO. 92529
ccccgcggtggcggccgctctagaactagtggatcccccgggctgcaggaattcgtctcacccctagaaaaaagaagacttcccttcgtctgcttcccagagacccagccatggcgatctcccagatctcacgcatattcctggccatccttctcctggccgccgccttcgccgccgccccagctgcgcttgcggacggcgacgacgtggtggcccttaccgaatccacgttcgagaaggaggtcggaaaggaccgcggcgccctcgtcgagttctacgccccctggtgtggtcactgcaagaagcttgctcctgagtatgaaagacttggtgcaagttttaagaaagctaaatctgtcttgattgctaaggttgattgtgatgagcacaagagtttgtgcagcaagtatggagtttccgggtatccaacaatccaatggttcccgaaaggatccttggagcccaaaaagtatgaaggacaacgcactgcagaagcccttgctgaatttctcaatactgaaggaggcacacatgtaaagctggcaaccattcctgtcagtcgtgtggttctcaccccagagacctttgactcaattgtccttgatgacaccaaagatgtcctttgttgagttctatgcccccatggtgtggtcactgcgagagtcttgcaccgacgtatgaagaggggggcatctggtttcaagttggatgaaggagttgtttatgctaaaccttgacgctgacgaacacaaggattttgctgaaaaagaatgaaagtaaggggacttcctaactttgaagttttttccaaagggaaaccaaactgggtgaagaatatgatcggtgataa

SEQ ID NO: 92529 - protein, 172 aa, Zea mays
  misc_feature: Ceres CLONE 1581270
  misc_feature (32)..(137): Pfam Name: Thioredoxin Pfam Description: Thioredoxin
  misc_feature: SWISSPROT Homolog: EC 5.3.4.1 Protein disulfide-isomerase
MAISQISRIFLAILLLAAAFAAAPAALADGDDVVALTESTFEKEVGKDRGALVEFYAPWCGHCKKLAPEYERLGASFKKAKSVLIAKVDCDEHKSLCSKYGVSGYPTIQWFPKGSLEPKKYEGQRTAEALAEFLNTEGGTHVKLATIPVSRVVLTPETFDSIVLDDTKDVLC

SEQ ID NO: 92530 - DNA, 924 bp, Zea mays
  misc_feature: Ceres CLONE 1581272
  misc_feature: Encodes the peptide sequence at SEQ ID NO. 92531
tccccgcggtggcggccgctctagaactagtggatcccccgggctgcaggaattcgtctcacccctagaaaaactagaaaaaatcctctctaacccacggaagcaagacaaaagctcgtgctggacgacatctcccctgtcgaatccacgaccatgatgcagcagctccgtcacagccagccgagcccgtgcctctgcggcctgcgggcggcacggcctatgctcgccctcggcgcagcagcatcccgttcgcggcccgccggaaaactgcaaccgagcgtctgcctcggcctcggccatgtagccccagccgcggcgagaggacagccccgtccccgtgccgttgccgactcggcgctgggagcatcgcctacgagcgtgcatgtcggaggcaacctgctgctgcagaacttcgccgccgacagccagcagaggctcaagctctccatccagcttgtcagcgccaccgtggccggcgtgtgtcaaggaagaaacgccgagcgccctgctcaagtaccgggaggacgagctcggcgcgctccggggagacggcaagacgacggagcgaccgttccagccgtgggaccgcgtgtacgactacacgctggtacgacgacctgggggaccccagacttgcgccaggaacctggcgcgcccccgtgctggggaggaaccccagggataacccgatacccttctgggttacaaagaaccgggcctacccagctcgccaaaaccagaatccttcgggttcggaagaacaaaaaccgccggctggggacccaacaaaaatcttacttttccccttgtgcaaccgaagacggcgttcgcggtttttcgcccaaagcatatctcgcgggtgccggaaacacctttttcccacccccgtgtggggcggcggggctcacttttcggggggctcct

SEQ ID NO: 92531 - protein, 100 aa, Zea mays
  misc_feature: Ceres CLONE 1581272
  misc_feature: SWISSPROT Homolog: EC 1.13.11.12 Lipoxygenase
MSEATCCCRTSPPTASRGSSSPSSLSAPPWPACVKEETPSALLKYREDELGALRGDGKTTERPFQPWDRVYDYTLVRRPGGPQTCARNLARPRAGEEPQG

SEQ ID NO: 92532 - DNA, 683 bp, Zea mays
  misc_feature: Ceres CLONE 1581273
  misc_feature: Encodes the peptide sequence at SEQ ID NO. 92533
  misc_feature (369)..(369): n is a, c, t, g, unknown, or other
  misc_feature (380)..(380): n is a, c, t, g, unknown, or other
  misc_feature (408)..(408): n is a, c, t, g, unknown, or other
ctggagctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcanctgtggagacngcggcggcggcggcggcggcggcggcancggccaacggaaaaagcgtgctgccacgccgccaagggggcccgggtaccgccacgccggctggaggcccatggagaaagggccccaagggaaaaagtttggtctacgttcacctgcggtctacaacggggacctggaaattaacaagccgggattacctttgccaacggggggaattttggattcccaaggtttttcttaaattacttccccaggttgaattcccccggggtttcccggggtcacccccacattttgggggaaaaaaagaattt

SEQ ID NO: 92533 - protein, 110 aa, Zea mays
  misc_feature: Ceres CLONE 1581273
  misc_feature (6)..(6): Xaa is any aa, unknown, or other
  misc_feature (19)..(19): Xaa is any aa, unknown, or other
MAGAAXVETAAAAAAAAAXANGKSVLPRRQGGPGTATPAGGPWRKGPKGKSLVYVHLRSTTGTWKLTSRDYLCQRGEFWIPKVFLKLLPQVEFPRGFPGSPPHFGGKKEF

SEQ ID NO: 92534 - DNA, 677 bp, Zea mays
  misc_feature: Ceres CLONE 1581275
  misc_feature (381)..(381): n is a, c, t, g, unknown, or other
ggagctccccgcggtggcggccgctctagaactagtggatcccccgggctgcaggaattcgtctcacccctagaaaaaccgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccagcagccgcggtaattccagctccaatagcgtatatttaagttgttgcagttaaaaagctcgtagttggaccttgggccgggccggccggtccgcctcacggcgagaaccngacggctcgacccttctgccggcgatgcgctcctgggcttaactgggcgggtcgtgcctcggcgcgttactttgaagaaatagagtgctcaaagcagccatcgctcggatacttagcatgggatactcataggattccggtctattgtgttgggcttccggatcgaattaatgattaaaagggaaaggtcgggggctttcctattttctagccaaaagggaaaattctttggattttggaaaaaacaaaaaaactggcaaaaacctttttccccaggggattttttcccataaaaa

SEQ ID NO: 92535 - DNA, 857 bp, Zea mays
  misc_feature: Ceres CLONE 1581276
  misc_feature: Encodes the peptide sequence at SEQ ID NO. 92536
tccccgcggtggcggccgctctagaactagtggatcccccgggctgcaggaattcgtctcacccctagaaaaagagaatccccaatcatttctcggtgcatttggccccgctccaccatcaccgaaatctccaagaaaactcatcccgaatccgcccccgcccccaaatcggccctacaccgcaccagatcacagctcataattccagtgagaattcggaaaggaggggagcaatgacggaggtggcgctcctccggggcccgaccaacctcgcttccaccgcaagccgcgcccccgcctccccctccccctccccctcctcctcttcgctgcggtatttagccaatgccgacagcgacgtgctccaaggaagcggcagcccggagcgcactgcgggatctgcggggagccgacgactccttgaactgcgcggacaagaggcggcggaggaggaagaggagcggtggtccttcttggcgctgctctttgagctactgcggaagtcgttgctcgggtgcaggaccgtgggcggcggcgaaggcgaacacggcggctgcgggatggagattgggttgcccacggacgtgcagcacgtggcgcacgtcacgttcgataggttccacggattcctagggcctgcccgttggatttcgagccgaagtgccccgcccgtgctcccagtgccagtgcaagttgtcttcggtgtttcaacagaaatcaatgcagtggttcctatgattgcccgagggaacagtgttccaacaatcctttttgatgatgcagagacgccttttatgaaacagggtgggccttccagggcaaaaaggtaatctttccggtataaatggcagaaaaaa

SEQ ID NO: 92536 - protein, 198 aa, Zea mays
  misc_feature: Ceres CLONE 1581276
  misc_feature (111)..(146): Pfam Name: PBD Pfam Description: P21-Rho-binding domain
MTEVALLRGPTNLASTASRAPASPSPSPSSSSLRYLANADSDVLQGSGSPERTAGSAGSRRLLELRGQEAAEEEEERWSFLALLFELLRKSLLGCRTVGGGEGEHGGCGMEIGLPTDVQHVAHVTFDRFHGFLGPARWISSRSAPPVLPVPVQVVFGVSTEINAVVPMIARGNSVPTILFDDAETPFMKQGGPSRAKR

SEQ ID NO: 92537 - DNA, 978 bp, Zea mays
  misc_feature: Ceres CLONE 1581277
  misc_feature: Encodes the peptide sequence at SEQ ID NO. 92538
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (320)..(320): n is a, c, t, g, unknown, or other
  misc_feature (459)..(459): n is a, c, t, g, unknown, or other
  misc_feature (503)..(503): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactccccgcggtggcggccgctctagaactagtggatcccccgggctgcaggaattcgtctcacccctagaaaaataaggcaggccgcctttgagtgtttggtggctatctcgtctacttattatgataagctggcaacagacatngcaggatatatttaatataactgcaaaagctgtgaggggagatgaggagtcagttgcactccaggctattgaattctggagttcatatgcgatgaggaaattgatattctggatgagtacagcagtgaatttacagctngatcccgatgtccttgctactactttatcaagcaggctcttccntgcctttggtgcctatgtttgtttgaaaacttctcttccaggcaggagggagaaccaagacttggaatgaaagggggctgggaaatctttgcaaagggcctggggggaaatttgttttggggccctggtgggcaaaaggacccgttggggggaaaaaaacttgggttccccccttgggaaaaggcccttttttgtggggagggagaaaaacataaaccccaatttctttgaaattgggaaaaaacaaaaaaaaagggggtgggcaaaaaaaatagcccccttttggggccctcttacctttgggaaggggggcccccctccacccgctgagagaaaaaacagcgcggcccccccccccttgtgtaaaaaaaggtgtcccccaacatgggggggctctttatagagggggggtgtttcgccccccccccgcgcgtgaaaggagagtgtgttttctcccaggggaaaaaatcctttt

SEQ ID NO: 92538 - protein, 11 aa, Zea mays
  misc_feature: Ceres CLONE 1581277
PNWDSPRWRPL

SEQ ID NO: 92539 - DNA, 830 bp, Zea mays
  misc_feature: Ceres CLONE 1581279
  misc_feature: Translation starting site: 154
  misc_feature: SWISSPROT Homolog: EC 4.1.1.19 Arginine decarboxylase
  misc_feature (620)..(620): n is a, c, t, g, unknown, or other
  misc_feature (627)..(627): n is a, c, t, g, unknown, or other
  misc_feature (774)..(774): n is a, c, t, g, unknown, or other
  misc_feature (783)..(783): n is a, c, t, g, unknown, or other
ggagctccccgcggtggcggccgctctagaactagtggatcccccgggctgcaggaattcgtctcacccctagaaaaaagaccacacaccacagcactaaaatctgttcatctctggctccccaaattcagctggagagcactttttcccatcatggataagaactacggtgaactctacaacatcctcggatggggtgaggagtacttcgcggtgaacacggaggggcacctcagcgtgaagcctttcggccgctggacggagcccgggcaggagatcgacgtgcactcggtcatcgtggaagctctagcgacccaacccaacgacagcaccagcaaatctcagttccccatgatccttcgcttccccgacgtgctcaagaaccgtatcgagacgctccataacgcattcaacagcgccatggagtccaccgggtacacgtccaggtaccaaggcgtgttcccgatcaaggtgaaccagaacaagcacgtcgtgcaggacatggttaggttcggccagcaatggaactatgggctcgaggctggctccaagccagaactgctcatcgccatgagctgcctccccgtcaccgaagcgagcccaagccgtacttgatctgncacggcntacaggacgcggactacatcgcgctcgcgctctcggcgcgggccatgggcctgaaccccatcatcgtgctcgagatggaagaagagctttgcatcgtcctcgaccagtacaagaagctgcagcagaagctgccagacgacgatgcgntgccgcagnagttcgagccggtcatcgggatccgcgccagcttctcacaagctact

SEQ ID NO: 92540 - DNA, 854 bp, Zea mays
  misc_feature: Ceres CLONE 1581280
  misc_feature: Encodes the peptide sequence at SEQ ID NO. 92541
  misc_feature (854)..(854): n is a, c, t, g, unknown, or other
ggagctccccgcggtggcggccgctctagaactagtggatcccccgggctgcaggaattcgtctcacccctagaaaaacgacctgaaggaactgctgggcggctagggcgcgaacctggcggagatggcgagcatcgggctgtcggtgccgccggggttcacggtgtcgacggatgcgtgacatcagtaccaggacgccgggtgcgccctccccgcggggctctgggccgagatcgtcaacggtctgcagtgggtggaggagtacatgggcgccaccctgggcgatccgcagcgcccgctcctgctctccgtccgctccggcgccgccgtgtccatgcccggcatgatggacacggtgctcatcctggggctcaacgactaactggccgccgggctggcggccaagaggggggagcgcttcgcctacgactgcttccgccgcttcctcgacatgttcggcaacatcgtcatggacatcccccgctcactgttcgaagagaagcttgagcacatgaaggaatccaaggggctgaagaacgacacctacctcacggcctctgacctcaaagagctcgtgggtcaggacaaggaggtctacctctcagcctacggagagccattcgcctcagacccaaggaaccagctggagctagcaatgctgggctgtgttcaactcggtgggagagcccccagggccaagaagtacaggagcatcaacccagattccctggcctccaggggcaccgcccctgaaacgttgcagtggcatggttggttccgggcaacattgggggaaacaactttcctgggcaacacaggggttgtttcctttcacttagggtaacccccctacn

SEQ ID NO: 92541 - protein, 130 aa, Zea mays
  misc_feature: Ceres CLONE 1581280
  misc_feature: SWISSPROT Homolog: EC 2.7.9.1 Pyruvate, phosphate dikinase
MFGNIVMDIPRSLFEEKLEHMKESKGLKNDTYLTASDLKELVGQDKEVYLSAYGEPFASDPRNQLELAMLGCVQLGGRAPRAKKYRSINPDSLASRGTAPETLQWHGWFRATLGETTFLGNTGVVSFHLG

SEQ ID NO: 92542 - DNA, 855 bp, Zea mays
  misc_feature: Ceres CLONE 1581283
  misc_feature (855)..(855): n is a, c, t, g, unknown, or other
gctctagaactagtggatcccccgggctgcaggaattcgtctcacccctagaaaaagaggaaaggcttgcggtggatacctaggcacccagagacgaggaagggcgtagcaagcgacgaaatgcttcggggagttgaaaataagcatagatccggagattcccaaataggtcaaccttttgaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaactcccagtgggtagtgaaatactcaaaagccaacaaacagagctccaactcagaaagcatccgtcccttggcagcagcaacaagctactagctatgtgtgtttagagcgagcgagggggaaaaaaagaaaacatctaagatatactccatcatcttcggtttgattaacccgccccagtaaagcccagggggacctattggaaagagccgggccaatttctctaaagactcccttcggggtgcactccgctggccggcttcttcccttggggtgcgccccttaaaaactggatgcttggaaccaaaaagn

SEQ ID NO: 92543 - DNA, 869 bp, Zea mays
  misc_feature: Ceres CLONE 1581284
  misc_feature: Encodes the peptide sequence at SEQ ID NO. 92544
  misc_feature (668)..(668): n is a, c, t, g, unknown, or other
aagctggagctccccgcggtggcggccgctctagaactagtggatcccccgggctgcaggaattcgtctcacccctagaaaaaaccgagctcaaacacgcatgaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcgggaggtccacggcagcaacaactgggagggtctgctggaccccatcgacggcgtgctcctccaggagctcatccgctacggcgagttcgcccaggccacctacgacagcttcgactacgaccgcttctccccctactgcggcagctgcaagtacccgggcgaagaccttncttccacgacgtcggcctcggcgggatcgggctacgaaggtcacccgctacctctacggcacttgcaaagaccttcagtttccccaactccggcatcaagacgggcgccaaacgccaagatgtggaagcgaagtcccggcacgtttcatcggggtacgggggccctggtccaaccgaccaaggaaaacggccgccggctta

SEQ ID NO: 92544 - protein, 204 aa, Zea mays
  misc_feature: Ceres CLONE 1581284
  misc_feature (138)..(138): Xaa is any aa, unknown, or other
MAATVSSCLSLVPTVHHRAGGFPSSVALTNTLQRRRRSRRYLVVASATRAEQEAAPVTIEDVDLSSHQAAADDGELAARWREVHGSNNWEGLLDPIDGVLLQELIRYGEFAQATYDSFDYDRFSPYCGSCKYPGEDLXSTTSASAGSGYEGHPLPLRHLQRPSVSPTPASRRAPNAKMWKRSPGTFHRGTGALVQPTKENGRRL

SEQ ID NO: 92545 - DNA, 883 bp, Zea mays
  misc_feature: Ceres CLONE 1581285
  misc_feature: Encodes the peptide sequence at SEQ ID NO. 92546
  misc_feature (506)..(506): n is a, c, t, g, unknown, or other
  misc_feature (524)..(524): n is a, c, t, g, unknown, or other
ctggagctccccgcggtggcggccgctctagaactagtggatcccccgggctgcaggaattcgtctcacccctagaaaaaatttgcaggcacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgctgttcacggccacccacacatggcaagcgatccgggagcagagcgtgcgcgtgacggagccgaggctgtcgccggcggagcgcgtgcaggaggccgtcgcctgcgtcccagctgctgcccangcccagcttgaagccgcngcggggttttaggcgctggacggtgcggggactccacagggcgtacagatcagggacagctaccccctacaatggtggcgccggcgaatccctggcagcccttggaggaaatggtcaggggccggaaacttgaacatggggctttctttattaagcttggaacccctgggggaaattgttgggggaagggccaaaggaactcccccccccaaaaaacccaacaaagggggcccccccttgtcccccccatgggaaagggaggtgttggggccccccttccaaggaaaaaaaattctaaatggcccgtggcccaaaaccccaaaacagggggggggggcaacagggggggggtggggggg

SEQ ID NO: 92546 - protein, 131 aa, Zea mays
  misc_feature: Ceres CLONE 1581285
  misc_feature (122)..(122): Xaa is any aa, unknown, or other
MGFFIPPPKVYKPAAEVDLGPDSDEHYISPNVKAPRVAGFLVKMLAWVLETPVLGWIVLGVLKRDNLVYKLVSDAEIPEPPLFTATHTWQAIREQSVRVTEPRLSPAERVQEAVACVPAAAXAQLEAAAGF

SEQ ID NO: 92547 - DNA, 841 bp, Zea mays
  misc_feature: Ceres CLONE 1581296
  misc_feature: Encodes the peptide sequence at SEQ ID NO. 92548
  misc_feature (649)..(649): n is a, c, t, g, unknown, or other
  misc_feature (731)..(731): n is a, c, t, g, unknown, or other
  misc_feature (769)..(769): n is a, c, t, g, unknown, or other
  misc_feature (792)..(792): n is a, c, t, g, unknown, or other
  misc_feature (805)..(805): n is a, c, t, g, unknown, or other
ctccccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagttgtggcccttcaaggtcatttctgggcctggtgagaagccaatgattgttgtccagcacaagggtgaggagaagcagtttgcagctgaagagatctcctctatggttcttatcaagatgcgtgagattgctgaagcttaccttggtagcacgatcaagaatgctgtggtcacagtccctgcctacttcaatgactcacagaggcaggccacaaaggnatgctggggtgattgctggcccttaatgtgctgcgtatcatcaacgagccaacagctgcagctatcggctatggtcttgacnagaaggctaccagtgtcggtgaagaagatgtcctcatncttgatcttgggaggtggtaccnttgatgtctcccntcctcacattgaggaaagaaatcttgaggtcagggt

SEQ ID NO: 92548 - protein, 227 aa, Zea mays
  misc_feature: Ceres CLONE 1581296
  misc_feature (9)..(225): Pfam Name: HSP70 Pfam Description: Hsp70 protein
  misc_feature (164)..(164): Xaa is any aa, unknown, or other
  misc_feature (204)..(204): Xaa is any aa, unknown, or other
  misc_feature (212)..(212): Xaa is any aa, unknown, or other
  misc_feature (216)..(216): Xaa is any aa, unknown, or other
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPFKVISGPGEKPMIVVQHKGEEKQFAAEEISSMVLIKMREIAEAYLGSTIKNAVVTVPAYFNDSQRQATKXCWGDCWPLMCCVSSTSQQLQLSAMVLTRRLPVSVKKMSSXLILGGGTXDVSXPHIEERNLEVR

SEQ ID NO: 92549 - DNA, 850 bp, Zea mays
  misc_feature: Ceres CLONE 1581298
  misc_feature: Encodes the peptide sequence at SEQ ID NO. 92550
tggagctccccgcggtggcggccgctctagaactagtggatcccccgggctgcaggaattcgtctcacccctagaaaaaccataccgcaagaaggacgcggactcacacgaatgagttaggcaaatagagctcttgcacgttattcaatttttccatgatcccactctaggtctgtaaacccttgggtccatacatatcgcatccgaaaacaatcaatatcaaccgacaatccgacgatatctttttcccgccttatgatgcggatcatttggagaaaccctaactcagtgatcacactaagccctctcgggggcttgcttaacaataataaagacgaatcttgtggaaatccatggaatgaggtttgcactcctattacatggggattcctctacatatcccattccacaaatcgaaaacatccgcacttttccgaaattggctgcccttactgatacctgatctggcatgtacataatgaacacgtcatgctcgattctacgagaatttttatgaacgcgtttcatttgcttctcttccgtggaagtctcattttcccataacgtatcctaagtctagacctaatactagtacggatgatcgacttaccctctgatcatcaacatagaccggtgattctattgcggatcggcaacaagctttcctactacgcataacggaacgatagctcccatcggatagaagcaactcctattggcttgtctgcgaatctccaaagcaaacactgacacgcaaatctatcactttccaaagttgattctgtccaaactttatcgactacctcccaggccccagaatccctgtgcaatgtaggcatacggcctataa

SEQ ID NO: 92550 - protein, 37 aa, Zea mays
  misc_feature: Ceres CLONE 1581298
GAPRGGGRSRTSGSPGLQEFVSPLEKPYRKKDADSHE

SEQ ID NO: 92551 - DNA, 1189 bp, Zea mays
  misc_feature: Ceres CLONE 1581300
  misc_feature: SWISSPROT Homolog: EC 5.4.2.2 Phosphoglucomutase
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (1017)..(1017): n is a, c, t, g, unknown, or other
  misc_feature (1189)..(1189): n is a, c, t, g, unknown, or other
nttttttttcnnntttttccccctgtcagtgggggctgtccgttttttttttttctttttttannntatattaaaaaaaactgaactcaccgcggtggcggccgctctagaactagtggatcccccgggctgcatgaattcgtctcacccctagaaaaaaaccgccactccgcccctgccctctcactcatcatccctcctagaccaccgcttcctccgcgtcacccctcttctcgccacctcactaggcaacccccgtcagaccctccgcggcgcaaccatggcgctcttcactgtgacgaacaaggccactacgcccttcgacagcctgaagcccggcacctccggcctccgccagaaggttcctgtattcctacacccccattttctgcaagaacttcgtccaattaacattcaacgccctcttctgcgtatcaagtaacacgcgcccacaattagttgtctcatgttgatcgcccgctccctctcaaaacatgctggatcagatcaataacacaaaatgcgcttttccgccccacatcgatattaagaacgtgctttgaggaattggcaacataaactgttcttaatagaccctcctccctttcttcaatccagcttagacaatttcgttccaaaacaccttttgggttccaaaaatggggaaacacagaaaggcgcttaactggcgtgcccctatccaaaccttggacaccatccaccattccatatatctcccaatgtgggcgaatccacttaaggggaaggcgaattctctcgggggcaacttcttacaatttactaaatcattggatggaaaaaaattgggcacgaagggctctccattctaactcctggtgaaactccccggtgtaagcccgccaacaaaaaaaaaggttgtgttctcatctacaattctccccaccccacaacccttaatcctcttccaagaaaaagacccccttaagttgccatataagaaatgggagagccgtgttccttagtatagttcaacgncacctactttgtccctatgtttttaataggaaaatccataccttctggatagacatatacgcgtgggcaaaaccgcggaaacaaagctgtatcctcttaggaatagttggagtaacgacagtataatatacactggcccccgcttttggcgcgcattcttcccctagcgggn

SEQ ID NO: 92552 - DNA, 831 bp, Zea mays
  misc_feature: Ceres CLONE 1581302
  misc_feature: Encodes the peptide sequence at SEQ ID NO. 92553
ccccgcggtggcggccgctctagaactagtggatcccccgggctgcaggaattcgtctcacccctagaaaaaattattatccacaacactcatcgatctacacacatacatagtttcttctactacacgacgacaaacatggggaagcctgcgaagatcggagagtggggtggatacgccggcgatcgtcgggatctgagggctactccggaccggctgatcgaggtgaaggtcacggcggacaacagcagctgcatccgctccatctccttcatctacatcggagccgatggcaaaccgtacgaggaggggccatggggtttcggccatgctggcacggagtacaagattgatctgtgcaggttcgacgagagcttgacggagatctccgggaccacgggcccagcctacaacattgacaatctggtcaagtctctcaaattcgtcaccaacaaacgcgcttacggaccgtacggcagggacgagggcaccccgttccgtgtcaaggtgatgaacaacggccacgtcgctggcttctttggccgctctggagattgcctggacgcgatcgggctctacgtgaaccccaactaataactaaaacgatggatcggatcatctgcatgcatgcatatgcagtatgcatgctgcttgcctgcctgtaacgaatatgaatgcataaaataacgcccctgctgctcccatgcatcagcagtgtgtacccactatgtatatatatatatactgaacgcgacgcaaacaacagagctgccagcctgcccactgagagtgaggaacccctagcggcgcactgtgcaagcgacggcggcc

SEQ ID NO: 92553 - protein, 151 aa, Zea mays
  misc_feature: Ceres CLONE 1581302
  misc_feature (15)..(150): Pfam Name: Jacalin Pfam Description: Jacalin-like lectin domain
MGKPAKIGEWGGYAGDRRDLRATPDRLIEVKVTADNSSCIRSISFIYIGADGKPYEEGPWGFGHAGTEYKIDLCRFDESLTEISGTTGPAYNIDNLVKSLKFVTNKRAYGPYGRDEGTPFRVKVMNNGHVAGFFGRSGDCLDAIGLYVNPN

SEQ ID NO: 92554 - DNA, 830 bp, Zea mays
  misc_feature: Ceres CLONE 1581303
  misc_feature: Translation starting site: 199
  misc_feature: SWISSPROT Homolog: EC 2.7.11.1 Non-specific serine/threonine protein kinase
  misc_feature (711)..(711): n is a, c, t, g, unknown, or other
agctccccgcggtggcggccgctctagaactagtggatcccccgggctgcaggaattcgtctcacccctagaaaaagtccgcccgcgcgccatcctccccgcgccatgcccatgcgcacgcgcacgcgctccaccccttgagcacgcacgcacgtcgccgccgccacacgcatccgtctccgcctcccgtacgtgtccatggccgccgccacggcggccgggcggctgctcctggccgcggcggcgctcatcctcgcggcggcgtccagcggcgtccccctggcggcggctcagtccaagtcggaggccgatgtcctgagcgagttccgggcgacgctgcgggggccggacccggacggcggcccgccggcggagctgaaccagtgggcgacggggggcgcgccctgcgacggcaacgcgaccagctggcctcgagtgaggaggtgcgtcgatggccgagtggtggtcctgcagctggagggcctccggctgcagggcgccgcgccggacctggccctgctcgcgccgctccggagcctgcgctcgctcagcctgagcaacaacagcctcgcgggcgcgttcccggacgtgtcgccgctccccgcgctcaggttcctcttcctctggcagaacaggctcgccgggggagaatcccgacggcgcgttcgcggccctcagggggctccagaaggtcgacctctccgggaacgnaagtctcggcccgatacccagctccatcgcggtctccgccaggctgctgtcggtcaacctcgccaacaacaacttctcggggcccgtcccggaagggctcccggaggttagggcgcaat

SEQ ID NO: 92555 - DNA, 2318 bp, Zea mays
  misc_feature: Ceres CLONE 1581307
  misc_feature: Encodes the peptide sequence at SEQ ID NO. 92556
aagcttcaatcatcgccttccagcctcttcggctcttcttgtcatcttcgatccatccgcagttcttcctgcattccccatttgcgcgttcttccatctcccagattgatctccttcccgacttgggctttcccggtgggaaagcagctgtacctaggccgcgagccacccgcccctcctgctcttcggcaaacgcggagaaagtgggcaggcaataaagtatccgcggcgccggcacgacctcctgctccgctccgtttggttcgccttcttccagcagcgaggagtggcgcagacctagaggccaagaaccagatcggcgggtccatgaagcccgacgtgaggaaagatgccggctgtggcgtgaccgcattcggcgtctcctgcttcgacatcaagtctttcgtcgcctccctcgcgctgctcacgctcgtcatggcgctctggcagctccacccctaccagccgctcctctccgcctcccgtccgtcttccatctgccccctgctcccccggccgaccatctcagcttcctcccgcgccgcttccaccgccgccgcatttccctccgccaactccagtaccaacgctgccagcaccaaggcggcctcttcggctgctcccgccgttacgacgacgaagccggctgcgtccgtgctgccagctgcccggccgcgggaccccaacaagcgggagttccgttcctacggcagcgcggcggctctgttcgttcagatgggcgcgtaccggggcggcccgcgtacgttcgccgtcattgggttggcctccaagccagcacacgtctatgacaccccctacttcaagtgcgagtgggtgccgaaccaggagccatcgtcgccggcgccgcctcgggccgtccgtaccaaggcctacaagatgcttccggactggggctacggccgtatctacaccgtcgtcgtcgttaactgcacattccccaccaaccccaacgccgacaaccgcggcgggaagctcttcatccaagcatactactccaccgcctcccgccggtacgagcgcttcgtggcgctcgaggaggtgccgggttcctacgacgagtcccggttccggccgcccttcccctacgagtacctctactgcggttcttcgctctacgggaatctgagcgcggctcgcatgcgggagtggctagcttaccacgcgcatttcttcggccccaagtcgcacttcgtgctccacgacgccggtggtgtcagcacggaggtcagggcggtgctggatccgtggatccgggctggacgggtcaccgtccaggacatccgggcgcaggcggagtacgatggctactactacaaccagttcttggtggtgaacgattgcctccaccgctatcggcacgccgcaaattggaccttcttcttcgatgtcgatgagtacatctacctcccagacggccggacgctgcaggaggtgctggggcagctggagccctacacgcagttcaccattgagcagaaccccatgtccagcaaactctgcgtggaagatccaacaatggaatactcaaggaaatggggtttcgagaagctcgtcttccgtaattcgatcaccagagtcaggcgagaccgcaaatatgcgatccgagctcggaacgcgtactccacaggtgtacacatgtcccagaatgtcatcggtaggacaacccacaagacggagagcttgatcctatactaccactatcacaactcgatcaacgtcatgggggagccctgcagggaattcgtgccgagacccaacaatggaagcaaggtgatgtttgaggggataccgtatgtctacgatgacaacatggagcgcgtggcaggggagatcaaacgcttcgaggaggagacacttgggaccgtccgtacataggatcggcgcaaaagcatcgcatcgctggtgcgtatacagctctgtaccttgagctcgtgcccatccgttcgttccccgtgactctcgtcttgtgcactttgagctgccattccaacaagcagaatggaagaatctgtctcggggtcgaattagtgtaaagtttcagtttagctttgaatctgtcatctgtgtggagggcaatgcctttatgctgtgttttccgttcttgtctctatgatgttgtatgtatctcattgtagatttgtctagactgactgttgggctttattagatttttctgaatgtcgtatagggcgcagtgtgaagcgtctgaatatttgacttgttaaccaccctctggagtctgtatttgttcctgcacaaactggagcgtcagttcccatgttaaaaaaaaaaaaaaa

SEQ ID NO: 92556 - protein, 522 aa, Zea mays
  misc_feature: Ceres CLONE 1581307
  misc_feature (260)..(507): Pfam Name: DUF23 Pfam Description: Domain of unknown function
MKPDVRKDAGCGVTAFGVSCFDIKSFVASLALLTLVMALWQLHPYQPLLSASRPSSICPLLPRPTISASSRAASTAAAFPSANSSTNAASTKAASSAAPAVTTTKPAASVLPAARPRDPNKREFRSYGSAAALFVQMGAYRGGPRTFAVIGLASKPAHVYDTPYFKCEWVPNQEPSSPAPPRAVRTKAYKMLPDWGYGRIYTVVVVNCTFPTNPNADNRGGKLFIQAYYSTASRRYERFVALEEVPGSYDESRFRPPFPYEYLYCGSSLYGNLSAARMREWLAYHAHFFGPKSHFVLHDAGGVSTEVRAVLDPWIRAGRVTVQDIRAQAEYDGYYYNQFLVVNDCLHRYRHAANWTFFFDVDEYIYLPDGRTLQEVLGQLEPYTQFTIEQNPMSSKLCVEDPTMEYSRKWGFEKLVFRNSITRVRRDRKYAIRARNAYSTGVHMSQNVIGRTTHKTESLILYYHYHNSINVMGEPCREFVPRPNNGSKVMFEGIPYVYDDNMERVAGEIKRFEEETLGTVRT

SEQ ID NO: 92557 - DNA, 839 bp, Zea mays
  misc_feature: Ceres CLONE 1581308
  misc_feature: Encodes the peptide sequence at SEQ ID NO. 92558
ggagctccccgcggtggcggccgctctagaactagtggatcccccgggctgcaggaattcgtctcacccctagaaaaaatttgtctcgcgcttggctctcacgctcgcggcatcggagctctccagaaccgaaccccaactgcccaagggcgagcgatccgaacccctcggcggcttcgtcaacgacgccgataacacttagaggaatggctgaaaaggatgtccagccccttgtgtgtgacaatggcactggaatggtcaaggcgggtttcgctggtgactacgcaccgagagctgtctttcctagcattgtaaggaggacacgccacaatggtgtgatggtgggcatgggccaaaaggatgcatatgtgagcgataaagctcactccaaaagagagtattctgacactgaagtacccaattgagcacggcattgtcggcaactggggatgacatggagaatatctggcaccacaccttctacaatgaagcttcgagtggcacctgaggagcaccctatactgctgaccgaggctcctctgaaccccaaggcaaacatggagaagatgacccacattatgttcgagacattcaactgcccagcaatgtatgtggccatccaggacgttctttccctgtacgccagtggtcaaacaacgggtattgtgctcgactctgggtgatggtgtgatgcacaccgatcctatctacgagggtacacgcttcctcatgctattcttcaatgggactttgcttgtgaccttaccgacagcatgatgaagatgctaactgagacggggtgatcccttcactacgactgccgagcaagaaatgtcatg

SEQ ID NO: 92558 - protein, 77 aa, Zea mays
  misc_feature: Ceres CLONE 1581308
  misc_feature: SWISSPROT Homolog: EC 2.7.10.2 Non-specific protein-tyrosine kinase
MTWRISGTTPSTMKLRVAPEEHPILLTEAPLNPKANMEKMTHIMFETFNCPAMYVAIQDVLSLYASGQTTGIVLDSG

SEQ ID NO: 92559 - DNA, 826 bp, Zea mays
  misc_feature: Ceres CLONE 1581309
  misc_feature: Encodes the peptide sequence at SEQ ID NO. 92560
ggagctccccgcggtggcggccgctctagaactagtggatcccccgggctgcaggaattcgtctcacccctagaaaaaccccggaaccagaacaagtccagtctgtccagaaatacattagaaaaaagagccaaagaggagaacaccggccggcgaggtggacgaagcggcccgccgaggaaatggcgtcgatgcagagctggcgcaaggcctacggcgccatcaaggacaccaccaccgttagcctcgccaatctcaactccgacttcaaggatctggatgtggcgatcgtgaaggcgactaaccacgtggagtgcccgcctaaggagcgacacctgcgcagggttgttgcggcgacgtccatcaccaggcctcgggcagatgtcgcctactgcatccacgcgcttgcccgccgtcttgccaagacccgcaactggatcgttgctctaaaagcacttgtagtgatccatagacttcttcgcgagggtgatcctacatttcgagaagagcttctcaactttacacagaggggacggatcctgcaactttcaaactttaaggatgactccagtccaattgcttgggattgttctgcctgggtgcgcacatatggtttgtatttggaggaaaggttggaatgcttcagagttctgaaatatgatgtcgaagctgagcgcttgtccaacaaggtcaaggtcctgaaagggtcacagtagaacgagagagttgattcacaggatctgttagagcagctgcagcattgcagcagtactgtaccgacttgttggatgtccgcctgaagagctgcaaatataactacttggtg

SEQ ID NO: 92560 - protein, 177 aa, Zea mays
  misc_feature: Ceres CLONE 1581309
  misc_feature (29)..(178): Pfam Name: ANTH Pfam Description: ANTH domain
MASMQSWRKAYGAIKDTTTVSLANLNSDFKDLDVAIVKATNHVECPPKERHLRRVVAATSITRPRADVAYCIHALARRLAKTRNWIVALKALVVIHRLLREGDPTFREELLNFTQRGRILQLSNFKDDSSPIAWDCSAWVRTYGLYLEERLECFRVLKYDVEAERLSNKVKVLKGSQ

SEQ ID NO: 92561 - DNA, 916 bp, Zea mays
  misc_feature: Ceres CLONE 1581312
  misc_feature: Encodes the peptide sequence at SEQ ID NO. 92562
ctccccgcggtggcggccgctctagaactagtggatcccccgggctgcaggaattcgtctcacccctagaaaaagtttcttttcttccccactcctctcgtcgcgtccaataaaaaggggggaagagcattttcccttttttttgctcccctcccccctcgcttctcccgaatttgatgcttaaaccctcgccgggaggaggactccacgcgcgagcccgcccgcgccacctaccgccgcgcccggatccccgccatggccgccgcgccgcaccgggcccaggtccccgctgatagcacggctccgttgcagacggggcctgtacttgagaataaccccttcaagagtgcaaacgccagggacagattcctttctggtaccgaaaatgtgactacaggcaatgcacgtggggctagcctcttgaaaatcgccaaagggcccacccaaaaaggctatcttttttcggaaaaactggaaaagcacctttttccttcccgacaaatggggtttgtccccaagccccaacccttttttttctgggaggaaacaaaaacccctttggggaaggggggggagaaaccccccttttttgaaaaaagggggggggccccttctttttttccgggaaattaaaaaaaaaacccccccccccctgttttttgggggggatttaaccccccccccccagaggggggggggggattttttttctttttcccccggggggggagaaggaaaaaaaactccgggggggggattttttttctcaaatatataaaaaccccccccctccttccccgcggggaggaaaacacccccccgctcgggggggcgcgacaaacacccccccccccaaaaaaaaaatttttttgggggggggggtttccccccccccgcgcggcgtggtttaatcttt

SEQ ID NO: 92562 - protein, 125 aa, Zea mays
  misc_feature: Ceres CLONE 1581312
MAAAPHRAQVPADSTAPLQTGPVLENNPFKSANARDRFLSGTENVTTGNARGASLLKIAKGPTQKGYLFSEKLEKHLFPSRQMGFVPKPQPFFFWEETKTPLGKGGEKPPFFEKRGGAPSFFPGN

SEQ ID NO: 92563 - DNA, 805 bp, Zea mays
  misc_feature: Ceres CLONE 1581316
  misc_feature: Encodes the peptide sequence at SEQ ID NO. 92564
ctccccgcggtggcggccgctctagaactagtggatcccccgggctgcaggaattcgtctcacccctagaaaaaaccttgtgaggagacaacaccacctcatgggtcctgctttagcaaggaagaaaagaatggacgcgaccctgcatcttctatccttttgcgcggaacgaacacacggcccggatttcaatctcgaatcccaaatcccctcgataaccaaaaaagcagaacttcgttaaaaccctctcgggaaaaattaccaccctcaggggggagtcctcagaccccttgaacagcaacagggccaaaatccgggacaagaagggcattccccgggacacagaggggctcatctaatcgggaaagcatctcgagaacgggcgcagctttgcctattacaacgtaaggaaagggagaaccctccactttgttctcggcctagggggagggaggcaaattttttacaagaccctacagggaaaaacgacaacccccgagggggagacttcggaccccatgaaaaacgaaaaggccaatatccaggagaaggaggcaatgcccccggacacagctgagccacttttttgctggcaagagactatagaacgggcgcagttggccaactacaactttaagaagaagacaccctcaacttggtgttcaacctacggcgcgcgaggcatatcttgttgatactctgacgggcaagatgtcacctggaggtcgagtctggcgacccctggacaaggtcaaggacatgactaggacagggagggtttcctccggacaaaaatggcgtaatt

SEQ ID NO: 92564 - protein, 58 aa, Zea mays
  misc_feature: Ceres CLONE 1581316
MKNEKANIQEKEAMPPDTAEPLFCWQETIERAQLANYNFKKKTPSTWCSTYGARGISC

SEQ ID NO: 92565 - DNA, 851 bp, Zea mays
  misc_feature: Ceres CLONE 1581320
  misc_feature: Encodes the peptide sequence at SEQ ID NO. 92566
  misc_feature (701)..(701): n is a, c, t, g, unknown, or other
  misc_feature (851)..(851): n is a, c, t, g, unknown, or other
ctccccgcggtggcggccgctctagaactagtggatcccccgggctgcaggaattcgtctcacccctagaaaaatctgcccaacacccaattgaagccgtcccaatcccaaccctactcccttgcctccccctaatgacatcgcctggcggcgtcttctccgccgcgctcgtcgccgaggacttcccttgggtggacatggaggaggagatggggatggccccggacatgtaccgcgaggtgttcgacctcgcgcagcgcgggacacgagcccttcgcgaccgcctcttcgacgaggcaatatcctgttacactaaagctcaaaatttgagaccagatccaattatccttggcaatcgaagtttgactttctgccggttaagtcaactgttgagggagagatcagcagctgactctgaatatcagcccttgaatggccttgatcctacaactcatgcagagttagctctgaaggatgcacagaagatattatctatcaacagtaattctcctagaccatatcccctagaaaaactagaaaaaaattctcaaggcatatgcgctatttctgatggagcattaccatgaggcacgtgagacccttcttgctggtcttcaagttgatcccctcagtcatgtcttgcaaacctgtctgaatgatctggataggaatacaaatattgcagctggcgcaagccgtgncaggttagctaggattgatgattttgagtgccattatgctttcagctattgtatgaactgtcactacacatgtggccattcattttgtcgctcttgtctactcagtcaatggatcatgggtatcagtgccccatgtgtcggacagtattn

SEQ ID NO: 92566 - protein, 150 aa, Zea mays
  misc_feature: Ceres CLONE 1581320
MTSPGGVFSAALVAEDFPWVDMEEEMGMAPDMYREVFDLAQRGTRALRDRLFDEAISCYTKAQNLRPDPIILGNRSLTFCRLSQLLRERSAADSEYQPLNGLDPTTHAELALKDAQKILSINSNSPRPYPLEKLEKNSQGICAISDGALP

SEQ ID NO: 92567 - DNA, 828 bp, Zea mays
  misc_feature: Ceres CLONE 1581321
  misc_feature: Translation starting site: 271
  misc_feature: SWISSPROT Homolog: EC 1.1.1.22 UDP-glucose 6-dehydrogenase
  misc_feature (801)..(801): n is a, c, t, g, unknown, or other
ctccccgcggtggcggccgctctagaactagtggatcccccgggctgcaggaattcgtctcacccctagaaaaacacagacacacaaacacgagtcgtcgtaggcagcgagcgtctctcctctcccacgcatcgcgcctaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggacgacattgccatcaggtgcgcggacattgaggtcgtcgtcgttgacatctccaagccccgcattgaggcctgagaacagtgacaccctgccaatctacgaggctggtctcgatgatgttgtgaagcagtgcacgggcaggaaccgcttcttcaggactgatgttgagaagcacgtcggtgaggctgacattaactgtgtctcggagaacacccccaccaagacccgagcgcttggagctggcaaggctgccgacctcacctactgggagagcgctgcccgcatgattgcggatgtctccaagtctgacgagactgttgttgagcagtcgactgtctctgtggagagcgctgacgctattggagaagatcttgacccacaactgcaaaggtatcagctagcagatcgcttcccaacccagagttacttgctgtagggtactgccattcgaggagcctgttcaggactgacagagtggcttattggtaggctgggatacctctgagggcangaagcccgtccaggctttcatggatgg

SEQ ID NO: 92568 - DNA, 811 bp, Zea mays
  misc_feature: Ceres CLONE 1581322
  misc_feature (755)..(755): n is a, c, t, g, unknown, or other
ctcaccgcggtggcggccgctctagaactagtggatcccccgggctgcaggaattcgtctcacccctagaaaaaatccgcgcgtccctactcctccccctccctcctcaacgacgcgagaagacgcaatcctgggagctccgaaccctagctcctaatttgagccccggtgtcatcgattcctcaggagcccgccgcgattcggctcccgtagcagcatagggctccaccgctccccagctgcatcagcatcgacggcggcggcgcgccgccgcgactacgctcgaggaagcacctagtctcggcgggttctcgttcttggaggccttccataaggcggtttcgtggtgtccgagcccggatctacggcgatctgcaagcggaaggcgatagatgaggcgattcagtggtaacccccaatccggtgggtttccggctggcagaggcggaaaggttcgggccttcggcgggtgatcagatttctccgtgcggcgcgcggcttgtgtctaccgcaacggtgtaggactggagcgcaggagccgacgaggcggtggagatacaaaaaaattgcttgcttgtacacttgttcatgttcatttgttcctgctatctgttgtggtttaaagcatcaattttccgctcaatttaagggcgaagacactttttttgttccttcccttgttggtttctatggaataatctctatattacagaagaggagtgtggaaaagcaacaaaaagaggaatataaatacnaaaaaagatataaccagcagaaaaaagagatttttttttgagtggcaagcaaaatg

SEQ ID NO: 92569 - DNA, 818 bp, Zea mays
  misc_feature: Ceres CLONE 1581328
  misc_feature: Encodes the peptide sequence at SEQ ID NO. 92570
  misc_feature (818)..(818): n is a, c, t, g, unknown, or other
ctccccgcggtggcggccgctctagaactagtggatcccccgggctgcaggaattcgtctcacccctagaaaaaatcctgcccacccgaacaataaccaacagcttcaccctcctcatccagtgtaggccgtccgcggctgacggcgtcaattcacctccttcctcaggcctgccctgccctgcccgagcgataaccatctctcgcaacacctcttcgtactcctcgtctccaacgccggctacaactacaaagattcagcttaccgagctcgagacatgcgtgcggaaacacaaacggcggagtagcgtagcgccacgatgggattgccaagctggtacgtagacaacaacacatgagatgggagcgtccttgggctccgccgccagcaagaacccgcagcatgagcacggcggctaggctccacgaccagatccctgcaagaagacgcggctctcgacccctctctgcactatccacaggcacctcgaggctgatcccggggctcccgaatgaggtctctctgcacatactaacaaggatgccgcggatggtgtacactcaaagaaaaatagtctcacgaagctggaaagcagccgtgaaccgagcagagctgtaccgagctaacgaacgagctacccctgaccgagaagaggatgctcatacagacgaaggctgcggcacgtagccagaagcttgatccggaaagctctcaatacaagttagcaatcaatggcagaagattcccactcatacctagaaaacaactgcaagacctggtggaagtataccaagagtcgaatttctccaaagcatgan

SEQ ID NO: 92570 - protein, 94 aa, Zea mays
  misc_feature: Ceres CLONE 1581328
  misc_feature (30)..(77): Pfam Name: F-box Pfam Description: F-box domain
MSTAARLHDQIPARRRGSRPLSALSTGTSRLIPGLPNEVSLHILTRMPRMVYTQRKIVSRSWKAAVNRAELYRANERATPDREEDAHTDEGCGT

SEQ ID NO: 92571 - DNA, 1204 bp, Zea mays
  misc_feature: Ceres CLONE 1581332
  misc_feature (67)..(67): n is a, c, t, g, unknown, or other
  misc_feature (1138)..(1138): n is a, c, t, g, unknown, or other
aaaagaaggtaaaattaatatcgacgttcgattctcgtcgtgccgtctttgtggggggggacccttncctttaaagctggagctccccgcggtggcggccgctctagaactagtggatcccccgggctgcaggaattcgtctcacccctagaaaaaaccggaaccagaacatgtccagtctgtccagaaatacattacaataaagagccaaagaggagaacaccggccggcaaggtggacaaagcggcccgccgaggaaatggtatcgatacaaagctggcacaaaggctacggcactatcaacgacaccaccacgcggcagcctcgccaatctcatctcctagttcaaggatctggatgtggcgactctaaaggcgattaaccacgtggagtgcgcacctaaagagcgacacctgcacagggttgttgcggcgacttgcatcaccaggctgcgggtaaatgttctcccactgaatgaaccccccttgacggccgttcttggccagaccccgacactgggatcgcaggctccaaaaaaacatcttgtacgaggatgcaaaagacctcctttcacaaaggagagaatccgacatagctatctgtaagaagattatctcccactttcttgccctataaggggggaatgggattccttgccaagttcatcaaaaccttttggaaggaatgaacttcccacggtgcccaatttgacactagcgataatttattctccggagccccggggaacgcgaacgcacaattgttgggtaattgaacatttaatccgggggtcaaaaaagcgcctaggggaaaaaacaacccttcctgtaaaaacacccaacaaacaacagtgaagatcctatagaaagacgccaaaagttccgctttgcggtcggggtaaaataatgtccccaacatggactatcacgcacaataccggatacaccatagggtgaaaaacccactcgggaaggccactgtgatatattctatcaacggtcaagtttatagaatcttagaaacgaggcaggggagacattctaatgtgggcaataccatagcatgcactacgaaaaccaaacatatatgatattctaaaaatagcgggagacaacgacactccggagaaaaatcgcancaggaggacctactatcttacattatggagcggcgctatagaagtagcgtcctcgtatattattat

SEQ ID NO: 92572 - DNA, 863 bp, Zea mays
  misc_feature: Ceres CLONE 1581333
  misc_feature: Encodes the peptide sequence at SEQ ID NO. 92573
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (539)..(539): n is a, c, t, g, unknown, or other
  misc_feature (609)..(609): n is a, c, t, g, unknown, or other
ggagctccccgcggtggcggccgctctagaactagtggatcccccgggctgcaggaattcgtctcacccctagaaaaaaacttctccaattccaatcaccagccgatcagatttatgcagtcttactgccgcgagcgccagtcatgccgcgcggcagcagcttggaccagagcttgagcgacgacgagggctcggcaggtgttggggcggtttgggttcggcgtcgctggcaatgtccgggatgtccgactccgctgggggtgtgcgcgcgggcgcggagctgatggtgcagcagttccacctcaaggtgctccacgccgtcctcgccgtgcgcacgccgcgcccgcacgccttcgcggcgccagcggcggcgtcgttcaggcggagggacaggtggttccatctcccgctccacgacccgccgccgccgcccgaggcggctgaccgcctggacgagctggtccccggggagccgctggtggtggacgtcctcctgagccccgccggtagtgtgggagcccaggagnnngtgggaaaangggggaaaactggtggcgtgcaaacccctggccgggacgcccgcgggcgggccaagaaggtttgccgtgnaaccggggcgtacaagcactggcttcacgcttgctcaggtcccgtctacgccgttgctccgcgtccctcccgggcgtacgcaatctttcggccctcctctggcgccaatcccctcctaccaactaccgagatgggggcacccggcgtcaaacactttcgccgaagccctttcctcgcggcccccagggaaggccgcccagtgcgtttcccaaacgcttttggttcccccgtcgaaaacccaggctcgggcccgc

SEQ ID NO: 92573 - protein, 210 aa, Zea mays
  misc_feature: Ceres CLONE 1581333
  misc_feature (99)..(99): Xaa is any aa, unknown, or other
  misc_feature (103)..(103): Xaa is any aa, unknown, or other
  misc_feature (126)..(126): Xaa is any aa, unknown, or other
MSGMSDSAGGVRAGAELMVQQFHLKVLHAVLAVRTPRPHAFAAPAAASFRRRDRWFHLPLHDPPPPPEAADRLDELVPGEPLVVDVLLSPAGSVGAQEXVGKXGKTGGVQTPGRDARGRAKKVCRXTGAYKHWLHACSGPVYAVAPRPSRAYAIFRPSSGANPLLPTTEMGAPGVKHFRRSPFLAAPREGRPVRFPNAFGSPVENPGSGP

SEQ ID NO: 92574 - DNA, 1059 bp, Zea mays
  misc_feature: Ceres CLONE 1581334
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (226)..(226): n is a, c, t, g, unknown, or other
  misc_feature (700)..(700): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgggactcaccncggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccatcatataaacaacacgcgcacacatgcgctatttagctcagctgaatgtagcgtctcactatctacggctagctcggacggacgactttgcatgggatctcaattgcaatacgccctaaccgacctcctggcaaagaagggccccccaccgaggctgctgccccaaaaaccccttttccaatttggaaaagaaaaccgggtccccaaaatttgggggaataggtttggggggtgggggcccccaaaaaaaaaacaaccggaaccgcggggggggtggggggccccaaaaacccccaaaaaaattttttgggaacaattttgggacangcgccgccccaaaaaaaaaaaccccccccctatttgggggcccccccccaccccttttttgggggggggaaaaaaaccccccccccagggtgttcccccggcggggggggggtttttttcccagggggggggggggggggggaaaccttttttattttgtttgtttggcccccccccgggaaaaaaaaatttttaaaaaaagggggggggggtgttctttttttttcccccccgggtggttaaaaaaaagaggggggtgtcctcttccccccaaaaaaaaaaaaaaaaatattttttttttttttaccaacacccccccacccacaatggggtgggggggaaaaaaaaatatcgtgggg

SEQ ID NO: 92575 - DNA, 1136 bp, Zea mays
  misc_feature: Ceres CLONE 1581339
  misc_feature: Encodes the peptide sequence at SEQ ID NO. 92576
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (58)..(58): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (768)..(768): n is a, c, t, g, unknown, or other
ggggggtggtgnnntnaagataaatacaaatcaggcccccccccccgttaggggtttnaaaaaaaannnnnnnaaaactggaactccccgcggtggcggccgctctagaatagtggatcccccgggctgcaggaattcgtctcacccctagaaaaaaaactgactgattgtctgattgtgattgcggcagcaccgccgaccacgagcccgccgaaaggctcctccgcctgccgttccagggtgcactgccgccattgctcatctccccgtggtgcggaggtccacccgggcgccaattggtctcctctttcgttggcagactgagtggcatccaatcctgaatcaatgaggggctggggtttgctcgtgttatcgctacatgttctttcatgcctggttagtggcgttgcttctggtcgaacaagctcttatgtgcgcacagagttcccatctacagatatacctctagaaagtgaatggccccctattccaaagggatacaatgctccacagcaggttcatatcactcaaggtgattatgattggaaaggcagtttatacgtatcttggggttacctccagaaagaacctggtgcccaaggtgaaagtaatttttatgggccaagggacgacagcttattatgcacccaccaaaaggcagtaaaggtaacctaaccaaccaaaaacctattcgcggtttttgttcccgattttaaccaaaaattcgtggggaattaaccattacaccaccccttgttgtgcccctcnttgtttccggaaattggggccctcttttggagagttatttaaacgaactcctaaaaataattttatatctaacccaaagaaattgtggggaaaagcgccgggaaataattttcaaggcctcccgagaaaaaatatcctggggttttttcaaaaacagacccctcccgaggctaaattgtggaaacccccagatatgcctactcttttcacccccatttttgcggccatctcaaatacggtgtgaatcctgggcggggcaaaaaaccatctaaaaatccctcctctcagaaagcgtggttcaacccttttttgggaagaaaaacctgggggggggtcccaaacttgtgtcctcttatttgtggggggga

SEQ ID NO: 92576 - protein, 109 aa, Zea mays
  misc_feature: Ceres CLONE 1581339
  misc_feature: SWISSPROT Homolog: EC 3.1.3.2 Acid phosphatase
MRGWGLLVLSLHVLSCLVSGVASGRTSSYVRTEFPSTDIPLESEWPPIPKGYNAPQQVHITQGDYDWKGSLYVSWGYLQKEPGAQGESNFYGPRDDSLLCTHQKAVKVT

SEQ ID NO: 92577 - DNA, 1066 bp, Zea mays
  misc_feature: Ceres CLONE 1581341
  misc_feature: Encodes the peptide sequence at SEQ ID NO. 92578
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (192)..(192): n is a, c, t, g, unknown, or other
  misc_feature (454)..(454): n is a, c, t, g, unknown, or other
  misc_feature (463)..(463): n is a, c, t, g, unknown, or other
  misc_feature (473)..(473): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagcggggctccccncggtggcggccgctctagaactagtggatcccccgggctgcaggaattcgtctcacccctagaaaaactccttcctggacaaaatcatcagctcccgaaatccaaattgaaacagttgcaggcgattctgagctcgggttttgttccggggacggattcctgtgccggcggacgggatgtcaggccctctcgaccgatttgctaggccatgctttgaagggtttgtacataacgatgaaaggaagagagcagatctgatgcnagacactcngagggagatnagaagactaagattggggttcttttcagaaaaaagcaattaatgcttggaaacaaaattcagggctttcccttggggaaggggaaaccaaaaaaaaaaccccaaaagggggggaattcccctccaagggaactttaggggggaccttttaaaaaaaccctctcccaaaaaatattttgggaaaaaaaattttttccccaaaaaaatggggtttttattttgggtgaggaaggatttttttctggccccccccccccccagggggggggggataaattttcccccccccctttggtggttttaaaaggggtcctccccaacaaaaaacccccccggagaaaaatttgttgaaaggtggggaaaaaaaaaacccccccaaaaatttttttggtgggggcccccccaaaaaggggcccaatttggggggtgggggagaagagaaaaaatatttggggggggggcggcacacaaaaaaataaggggggggattttttttttttccccccccccccccccccttttttttttaaaaaaaagaggggccccccacaaaatttttatttctccccccccccccatttttttttttttttt

SEQ ID NO: 92578 - protein, 48 aa, Zea mays
  misc_feature: Ceres CLONE 1581341
  misc_feature (29)..(29): Xaa is any aa, unknown, or other
  misc_feature (32)..(32): Xaa is any aa, unknown, or other
  misc_feature (35)..(35): Xaa is any aa, unknown, or other
MSGPLDRFARPCFEGFVHNDERKRADLMXDTXREXRRLRLGFFSEKSN

SEQ ID NO: 92579 - DNA, 830 bp, Zea mays
  misc_feature: Ceres CLONE 1581343
  misc_feature: Encodes the peptide sequence at SEQ ID NO. 92580
ggagctccccgcggtggcggccgctctagaactagtggatcccccgggctgcaggaattcgtctcacccctagaaaaattccctctttatcctcgcggtctcccgccgtcgtcttcactgattcactccgacgcctcccctggcgctgccgctactggtaggcggtccctgtcgcgcgcgactaccagtcttcatgacggggacactctgctgattcgtagcgcaccacccgccggttcgccctcgggctctctcgcgcccctccaacggattactggtgcccaacgcttgtgcttgctgtgtagcctggcgcgtctgctcgcggccgatacctccgcggccggcggcgatgggccaggacctcgtcgagatccgtccgagcgagctccagttcacctttgaggtgaagaaacacagttcatgtgtcgtccacctaatcgacgagtccaacgactatgttgctttcaaggttaacacgacctctcctaaaagatactgtgttcgaccaaaatactgtggttatccttccaaggaaaacatgtgaattcacatggatgtggctcgacaacgatgacgcgaggtgagcccccctccttcgtggctggattgcttccgagtcttggcgtttgacgggtctggacttacgatcacgtctggaagtcgcgttggtgaagaatcgagctgcctcacgtgaggtgtatagaggtctgactatgacggaacactgcggtcatcctcacgtgacgttactatgtcagagctccagactgctacgtcagacatgctacttaagatcagtttgttgcacacacacaaatggttccttaggg

SEQ ID NO: 92580 - protein, 64 aa, Zea mays
  misc_feature: Ceres CLONE 1581343
MGQDLVEIRPSELQFTFEVKKHSSCVVHLIDESNDYVAFKVNTTSPKRYCVRPKYCGYPSKENM

SEQ ID NO: 92581 - DNA, 818 bp, Zea mays
  misc_feature: Ceres CLONE 1581344
  misc_feature: Translation starting site: 283
  misc_feature: SWISSPROT Homolog: EC 2.2.1.7 1-deoxy-D-xylulose-5-phosphate synthase
  misc_feature (728)..(728): n is a, c, t, g, unknown, or other
agctccccgcggtggcggccgctctagaactagtggatcccccgggctgcaggaattcgtctcacccctagaaaaaacgccccgccttgccttcatcctcctcctctcctccatctctcctcgccccagcgcgcgcgcggcatcgccgtcgagctacttactcgagcttcagttccagctactggagcacgcagttcatattaatacacagcttagctgtaccaagcggcatcttgcacgccagctaaactagaggaactcgctgcgcgcatgtctccaataatggcgctccaggcatcgtcgtcgtcgccttccgcgttccgtgcggtcccggccaccgccaacgcttcctgccggcgtcagttccaggtgcgcgctcaggtagccggcggcagcagcagtagcagcatcggagccgatggtgggaagatgatggtttccaaggagccggcggcggcggccacgtcgtcgggaccgtggaagatcgacttctccggcgagaagccgccgacgccgctgctggacaccgtgaactacccgctccacatgaagaacctgtcgatcttggagctggagcagctggcggcggagctccgcgcggaggtcgtgcacaccgtgtccaagaccggcgggcacctgagctccagcctgggcgttgtggagctgtcggtggcgctgcaccacgtgttcgacaccccggaggacagatcatctgggacgtgggccancaggcgtacccgcacaagatcctgacggggcggcggtcgcggatgcacaccatcccgcagacctcggggctggcggggtttcccaagcgc

SEQ ID NO: 92582 - DNA, 1006 bp, Zea mays
  misc_feature: Ceres CLONE 1581348
  misc_feature: Encodes the peptide sequence at SEQ ID NO. 92583
ccccgcggtggcggccgctctagaactagtggatcccccgggctgcaggaattcgtctcacccctagaaaaaggtctatctcgccgcgtcggcgtgctggtcgcccgacgaagctaggaggcagtcaaggcggacgaagcgctgcaccaaatttgacgggggatcgagcacaggaggcgtagtggaaaatgtttaagtttctcaaggaggtggtcgcgggatccggatcggggctcaaggacttcccctacaccattggtgagacatacgcatccgcctggggttcatggacacaccaccgcggtacctccaaggatgatgggtcacctgtgtcaattttttctctgtcacggagcaaccctcaggacagacacatggttgctggccgtaatgccgttaagagagttccaacgggtgcggcatccaaatatcttatcctttattaccaggtacagaaagtcgaaatctgccggatgggacccttgccgatcaaacaacgcggattttatattggagaacaggaagccctggtctatggccactttaactggagaaagcttaaaagggaaatctgaaaattcttgggttgggggtaccccctagggagttttgagagttcctttttcccattggggggggacctttccattgagggataatgccgctatagtcttttgaaatggccttatttcacacaaaattatagggattccggcacaaatctctggttacaaaagggaaaaataggtaacgcgccctaaaccccccgggtgtttattgtgtttaactacacaagcccttgtgtaaactggcaaggctgttctccggctccttatagattgtttatttttcccaaacattgtttaagtcctaaacaaataaaaggctcctctggtttaaccccaaaggctgggaattttggaagggggaacagcgaagggtctggacatatcacaggtgttaaggccggttttattttaggtgtggatattgggctctgcaaatt

SEQ ID NO: 92583 - protein, 128 aa, Zea mays
  misc_feature: Ceres CLONE 1581348
MFKFLKEVVAGSGSGLKDFPYTIGETYASAWGSWTHHRGTSKDDGSPVSIFSLSRSNPQDRHMVAGRNAVKRVPTGAASKYLILYYQVQKVEICRMGPLPIKQRGFYIGEQEALVYGHFNWRKLKREI

SEQ ID NO: 92584 - DNA, 826 bp, Zea mays
  misc_feature: Ceres CLONE 1581350
  misc_feature: Encodes the peptide sequence at SEQ ID NO. 92585
  misc_feature (784)..(784): n is a, c, t, g, unknown, or other
ctggagctccccgcggtggcggccgctctagaactagtggatcccccgggctgcaggaattcgtctcacccctagaaaaaagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagaaccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaaccccaaggcgcccgtgtttccgcgcctggcgcagggcacgtcccacgacgagatgacggtgacgtggaccagcggctacgccatcgatgaggcgtacccgttcgtggagtggggcgccctggtcgccggcggcggcgcccgggaaaccgnggggcgcggccgccgggaacgctcacctttcaacgggggcag

SEQ ID NO: 92585 - protein, 229 aa, Zea mays
  misc_feature: Ceres CLONE 1581350
  misc_feature (216)..(216): Xaa is any aa, unknown, or other
MAVALLAALVASAAMLAGTASASPAEGIQPLSKIAVHRATVEMQPSAYVRATPSLLGEQGEDTEWVTVKFGWKEPSEDDWIGVFSPSEFNSSATCPNPWPAEEPYLCTAPIKYQFANYSANYIYWGKGSIRLQLINQRSDFSFALFTGGLSNPRLIAVSEPISFKNPKAPVFPRLAQGTSHDEMTVTWTSGYAIDEAYPFVEWGALVAGGGARETXGRGRRERSPFNGG

SEQ ID NO: 92586 - DNA, 806 bp, Zea mays
  misc_feature: Ceres CLONE 1581352
  misc_feature: Encodes the peptide sequence at SEQ ID NO. 92587
  misc_feature (806)..(806): n is a, c, t, g, unknown, or other
ctggagctccccgcggtggcggccgctctagaactagtggatcccccgggctgcaggaattcgtctcacccctagaaaaaaccaaaaacccttccgccccgagccgaccggaaccctacccatcccgcagcgccgccggccgcccgccccgccccgccccttcaccccctacctcttcttgcgccgtcatcccgatcccctacgctcgctgaggcattatgggtaaatcaagcaagaagtccagtgttaaggctgcacctgctgctgtctcagttccagaggtgaaatctgcaaagaaggggaagagaaatgcagaagatgagattgagaaggccgtgagtgcaaagaagcaaaagactgtacctgaaaaagctgtgccggttaagaagcagccccctccaaagaaagttgagagcagcagctctgaggaggattcttcagattccgaagtggaggttaaggtccagccgaagaaggttattcaaccgaagaaaggtacacaacctgctaaacaggagtccagtgatgacagcagctctgagagctcctcagacgatgaaccttccaaaaaaccagttgccggttcaaaaaagcctcctgccagtagtagcagcagtgatgatagcagtgacagtgatgatagtagctctgatgaggaaccagcaaagaagcccacggtcctttcaaagaagcccactgtcctttcaaaaaaacctgtcacagcagtcagtaatggttcaaaacaggttaaacctgatagcagcagctctgacagtagctcagatgaggatgaaaaacctgcggcn

SEQ ID NO: 92587 - protein, 196 aa, Zea mays
  misc_feature: Ceres CLONE 1581352
MGKSSKKSSVKAAPAAVSVPEVKSAKKGKRNAEDEIEKAVSAKKQKTVPEKAVPVKKQPPPKKVESSSSEEDSSDSEVEVKVQPKKVIQPKKGTQPAKQESSDDSSSESSSDDEPSKKPVAGSKKPPASSSSSDDSSDSDDSSSDEEPAKKPTVLSKKPTVLSKKPVTAVSNGSKQVKPDSSSSDSSSDEDEKPAA

SEQ ID NO: 92588 - DNA, 828 bp, Zea mays
  misc_feature: Ceres CLONE 1581356
  misc_feature: Encodes the peptide sequence at SEQ ID NO. 92589
  misc_feature (765)..(765): n is a, c, t, g, unknown, or other
  misc_feature (819)..(819): n is a, c, t, g, unknown, or other
  misc_feature (820)..(820): n is a, c, t, g, unknown, or other
ggagctccccgcggtggcggccgctctagaactagtggatcccccgggctgcaggaattcgtctcacccctagaaaaaggggtggtggctctttgcaccgcttttttcgaacgctactttagcttttactcttcttttctcttggcttccgctcctcgcccacgcctcctcctccagtcctccctttcgtcgtcgcttccctccccttcccgttcgaatcctctgaccaccgcagagcctcccccctgaggaaaccctagcgcagccgccgaccgccgccgacccgtagcatggcgtccccggcccggcccgtcgccgcgtccgtctccggcgccttcggcctctcgcccgaccccaagcgctgctccttcgaccaggcgctccggcacaaggatttccaggagaacaggctgttgatgtcatttgttaatttccatgagcaagagaagatctctaaagaaatcgtaacacacgctatagaaagctgcatgaagaaacaagcagataacctgttgaattcactggacgttatcagcggtaggttgtcacagttggagttatactgctatagactggaaaggtccattggagaattacgaagtgacgtgatggattatcataacgaagcaaatctgaacttccggtgcgttgaaaagcaagtgaaagagggtcagaaatctgtgcaggctgttcaggaaaagcaggagcttgctgaaactcagaaagaaatgaccaaacttcagatagtacatgaggattctgcancaaagaagtgaaggtactgctccatcagttttcatgaataggggaaaatgaggnntgccctgg

SEQ ID NO: 92589 - protein, 161 aa, Zea mays
  misc_feature: Ceres CLONE 1581356
  misc_feature (159)..(159): Xaa is any aa, unknown, or other
MASPARPVAASVSGAFGLSPDPKRCSFDQALRHKDFQENRLLMSFVNFHEQEKISKEIVTHAIESCMKKQADNLLNSLDVISGRLSQLELYCYRLERSIGELRSDVMDYHNEANLNFRCVEKQVKEGQKSVQAVQEKQELAETQKEMTKLQIVHEDSAXKK

SEQ ID NO: 92590 - DNA, 841 bp, Zea mays
  misc_feature: Ceres CLONE 1581357
  misc_feature (834)..(834): n is a, c, t, g, unknown, or other
ctggagctcaccgcggtggcggccgctctagaactagtggatcccccgggctgcaggaattcgtctcacccctagaaaaagcgctctctccagtcctccaccgacgcccaccctcccacgatccccacatcgctctctccctcgcccaccagcccttcccgtcctcgatgcgctctgcaacttccaccctcgccgcgacgagctcggccggccgagctccgcgccaacctccagcttgatctcctcgccatgagccttgccaacctctcgcgccgagctacgcgtttccccgcagatctcctcaccatgatctccttgccatgatctttccctcgctctgccatctgcccccaaattcccctccccgctcgctcgcgtcgcgatagcaagcaacgcgcaggtgctgaaactcgtgtactgttgatggatgatgactgttcccatggatagtgctagcgcagccccatcctctgcgcgggaccttgccatggatagtgctagcactagcatgaagcactttcagttttataataattgaagaaaacctggcgcctgggctcatatttatgcaatagggaaatcacatggttgcttatatttcctgttttctgtgatgagactgttgatgtgaagatatatcaattcaagcacacatagctttaaccttcataatttcttcaccagttataacagttttcatttttgagataccacatgtcttttaaacagcataacttccttttacccaattattggtttacacaactaatttttacatttgctttctattactaaacttaattttcacactcagccttgtgttaactaccttgnaggtatt

SEQ ID NO: 92591 - DNA, 875 bp, Zea mays
  misc_feature: Ceres CLONE 1581358
  misc_feature: Encodes the peptide sequence at SEQ ID NO. 92592
ctggagctcaccgcggtggcggccgctctagaactagtggatcccccgggctgcgtgaattcttctcaccgctagataaagcgacctggacttcggctggggcaagccggtgtacggcgggcccgccaagggcggcgtgggcgccatccccggggtggccagcttcctcatcccgttcaagaacgccaagggcaaggacggcatcgtcgtgcccatgtgcctgcccggccccgccatggagacgttcgtcaaggagatggacaagctgctgagcgcgcccgcagacgcagaggcagagcagcagaaggatgcgttccccgtcatcaggtccgcgctctgaagtgagctctctgctgaggcagccgcgcgcacggcgccgatcgaaccatcgttttcgcttcgtgctacagcaagcatataggtaatcatcagcgggtcctgagcagctgagcttgtgtaacgtactgggtgtgggtgtgggtgaaccataagtactttgacgtgcctgaagctacgttgatgcatacgctatgtaaggcgagacatttggccgggctattggcgttgttggtgacgtttgaatgttaaaattttgggttccgttttcatccatttaattcataatacacattcatccgccttttcccttaccgaaaaacaaaaaattatgtttgcaaacgttcgaagggaacctaaatatccgcccaatatagggggaggccggaattcagaccggcgtctcagcgtggggcccgccgtttttgccacacccaccggggcacttggaaaaaatctctttgagcacttttccacgacatttaaatccagcgggtggcaggaaatctggccccccacttttagcgcaaggggtgggg

SEQ ID NO: 92592 - protein, 41 aa, Zea mays
  misc_feature: Ceres CLONE 1581358
MCLPGPAMETFVKEMDKLLSAPADAEAEQQKDAFPVIRSAL

SEQ ID NO: 92593 - DNA, 885 bp, Zea mays
  misc_feature: Ceres CLONE 1581361
  misc_feature: Encodes the peptide sequence at SEQ ID NO. 92594
  misc_feature (885)..(885): n is a, c, t, g, unknown, or other
tccccgcggtggcggccgctctagaactagtggatcccccgggctgcaggaattcgtctcacccctagaaaaacgcatacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgtgttctccgggtcggtgaacctcaagcacgtcaagctggggtaccagtacctggtgaaccacttcctgacgctgctgctggtgccggtgatggccgccacggcgctggagctggcgcgcctcggccccggccaactgctctcgctgtggcgctcgctggagctggacctggtccacatcctctgctccgcgttcctggtcgtcttcgtcggcaccgtgtacgtgatgtcccgccccccaggccggtgtacctggggggactacccctgctaaaaacccccccgccagctgccccggtgccccttcgccaccttcatgggacaaaacgcccccttattcagcgaacgaccaacaaggagcggggcgccttccagaacaaggaacccttggaacgcctcggggggctcggcaaagaacacgtggccttcccggccgggcaaaacaattactttccggcctaaaccccccgaatggaaggccctccggggcgccgaaagggcccaacttggtcaatctttttccggcaattcaaagaacctactcccccccgacagggggtttcaaaccccaagggaaatttgaacttccctactatgggtaaattggcggacctcttttccccn

SEQ ID NO: 92594 - protein, 95 aa, Zea mays
  misc_feature: Ceres CLONE 1581361
  misc_feature: SWISSPROT Homolog: EC 2.3.1.119 Icosanoyl-CoA synthase
MPSGSVFSGSVNLKHVKLGYQYLVNHFLTLLLVPVMAATALELARLGPGQLLSLWRSLELDLVHILCSAFLVVFVGTVYVMSRPPGRCTWGDYPC

SEQ ID NO: 92595 - DNA, 760 bp, Zea mays
  misc_feature: Ceres CLONE 1581365
  misc_feature: Encodes the peptide sequence at SEQ ID NO. 92596
  misc_feature (360)..(360): n is a, c, t, g, unknown, or other
  misc_feature (362)..(362): n is a, c, t, g, unknown, or other
  misc_feature (372)..(372): n is a, c, t, g, unknown, or other
  misc_feature (375)..(375): n is a, c, t, g, unknown, or other
  misc_feature (378)..(378): n is a, c, t, g, unknown, or other
tggagctccccgcggtggcggccgctctagaactagtggatcccccgggctgcaggaattcgtctcacccctagaaaaagcttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccgggtcaccccgctccgcctggccgccgcgctcccgctcccgcactggctcccgccccttcgcgccgncntccggcgcgncgncgnagttccagcggccggggacgacgcgtcgccccagttcctgggcgtggagacgaaaccatccagaagatcgggccctgggggctcatgttcttcttgcatctcttcaactaaccattctgggggataccagacgtgctcgtcgtcccgccaaagggagcagcgccgagatcatcccgttcctcaagactgggtcaaactggcccttggagtcgggttcatgctcctctaacccaggttcgcgatgtcctctccaaggaggggctcttcttacgcggtatcttttccgtttattgccttttttggggcctttgcctaaatggtcttaaacattgggcgagaccctttccccccactgtgctttcgccaaatgcccctccccctc

SEQ ID NO: 92596 - protein, 153 aa, Zea mays
  misc_feature: Ceres CLONE 1581365
  misc_feature (72)..(72): Xaa is any aa, unknown, or other
  misc_feature (73)..(73): Xaa is any aa, unknown, or other
  misc_feature (76)..(76): Xaa is any aa, unknown, or other
  misc_feature (77)..(77): Xaa is any aa, unknown, or other
  misc_feature (78)..(78): Xaa is any aa, unknown, or other
MESGLVASHRLRVPPPSASAGHHHLIRHRHAHAPVAAAPLRLSLPRHLPRVTPLRLAAALPLPHWLPPLRAXXRRXXXVPAAGDDASPQFLGVETKPSRRSGPGGSCSSCISSTNHSGGYQTCSSSRQREQRRDHPVPQDWVKLALGVGFMLL

SEQ ID NO: 92597 - DNA, 850 bp, Zea mays
  misc_feature: Ceres CLONE 1581366
  misc_feature: Encodes the peptide sequence at SEQ ID NO. 92598
acccgcggtggcggccgctctagaactagtggatcccccgggctgcaggaattcgtctcacccctagaaaaaagctctactcaaagagcgctctaccagtacaactacaaccacactaaaacccaaacaaaaaaaaggaagcaggtgctgccgatatatcgattgatcgatcatggcggcggccgtggccaatatcggcatggagtggctccaagaccctctgagctgggtgttcctgggcacggtgtgcttggtggtcctgcagcagctgcgacgtcggcggggcaaagcgccgcttccgcctgggccgaagccgctgccgatcgtaggcaacatggggatgatggaccagctgacgcaccgcgggctggcggcgctggcggagacgtacggcgggctgctgcacctccggctggggcggctgcacgcgttcgcggtgtcgacgcccgagtacgcgcgcgaggtgctgcaggcgcaggacggcgcgttctcgaaccggcctgcgaccgcggccatcgcgtacctgacgtacgaccgcgcggacatggcgttcgcgcactacgggcccttctggcggcagatgcgcaagctgtgcgtgatgaagctgttcagccggcggcgcgccgagacgtgggcggccgtgcgccacgagtgcgcggcgctggtcagggcccgtaccttgggcgggggccggggcaaggggccaggccgttaacctgggcgagctcatcttcagcctgaacaaaaaactggaaggttccccccgggaatcggcaaccgtcaacggggaagggccacgaaggaattcatccccccttcttgcaggaatttctccaaagctgtttcgggt

SEQ ID NO: 92598 - protein, 180 aa, Zea mays
  misc_feature: Ceres CLONE 1581366
  misc_feature: SWISSPROT Homolog: EC 1.14.13.88 Flavonoid 3',5'-hydroxylase
MAAAVANIGMEWLQDPLSWVFLGTVCLVVLQQLRRRRGKAPLPPGPKPLPIVGNMGMMDQLTHRGLAALAETYGGLLHLRLGRLHAFAVSTPEYAREVLQAQDGAFSNRPATAAIAYLTYDRADMAFAHYGPFWRQMRKLCVMKLFSRRRAETWAAVRHECAALVRARTLGGGRGKGPGR

SEQ ID NO: 92599 - DNA, 838 bp, Zea mays
  misc_feature: Ceres CLONE 1581369
  misc_feature: Encodes the peptide sequence at SEQ ID NO. 92600
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (649)..(649): n is a, c, t, g, unknown, or other
  misc_feature (658)..(658): n is a, c, t, g, unknown, or other
  misc_feature (663)..(663): n is a, c, t, g, unknown, or other
  misc_feature (801)..(801): n is a, c, t, g, unknown, or other
ggagctccccgcggtggcggccgctctagaactagtggatcccccgggctgcaggaattcgtctcacccctagaaaaagttcagctatctccaaccaatttgaaaccatcttgttcaaatcgccccctcctctctctctctctctctcgtcaagcacaagcttctgcgcattcgtgttgtgttgcggccctgtctgctgattggctgtggatccagaggcgaagctatggctctgacgctgcgttcctcgacgtcgttcctgtcgcatgtggactccgcctccaagctcctccacaagcccaccgacgaggcggcgccctgctgcgtctccgtgccgcctgcgcccagccgcaggccgcgcgcgctccgggcggctgcggccgcggccacggcgccctcgccggcgacgcaccgcgcgccggcggaggcggcagagctgctgcacggaggcggcgcgggccagcagcacgggctgccgcgcggcggggtgccggtgtacgtgatgctgccgctggacacggtgggggcaggcgggcagctgtcgcggcagcgcgcggtgggcggctagtctgatggcgcttccggggccccgggttggagggctttatggtgacttgttttgggggaaaatatttttaaannntttggncccttgttntttgnaatggggggggtttatgtgaaagtttggggggggggtggggaaataaaaagggggtaagggttttttgggattgttatttttatatgaaaagggtggggggttggaagagggggaataaagtccgagaaaaaaaacangaatgtggcaaaaaatgttacccgcgggataaaaaaa

SEQ ID NO: 92600 - protein, 113 aa, Zea mays
  misc_feature: Ceres CLONE 1581369
MALTLRSSTSFLSHVDSASKLLHKPTDEAAPCCVSVPPAPSRRPRALRAAAAAATAPSPATHRAPAEAAELLHGGGAGQQHGLPRGGVPVYVMLPLDTVGAGGQLSRQRAVGG

SEQ ID NO: 92601 - DNA, 1293 bp, Zea mays
  misc_feature: Ceres CLONE 1581372
  misc_feature: Encodes the peptide sequence at SEQ ID NO. 92602
  misc_feature (1)..(1): n is a, c, t, g, unknown, or other
  misc_feature (11)..(11): n is a, c, t, g, unknown, or other
  misc_feature (18)..(18): n is a, c, t, g, unknown, or other
  misc_feature (61)..(61): n is a, c, t, g, unknown, or other
  misc_feature (62)..(62): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1293)..(1293): n is a, c, t, g, unknown, or other
ntttaattttntttttcnacgtccttccacacccctcaactcacgtggactaaattccaannaccggtcnnnnccaagctggagctccccgcggtggcggccgctctagaactagtggatcccccgggctgcaggaattcgtctcacccctagaaaaaccggtacacggcccccagaactaagagaaacgacgcagtgtcagccagccattggatcaccaccattcgcgctgttcggagtgcgcacccaatcccatctccgtgcggctttgtgagtatacaacgaaaggtgaagcagaccaggaggggttcgtcatcccgtggaggacgcgccgctctgttcctccgtcccctccacattccggctctcgctgtaacatggcgggtggtgcgggggcgctcagatccggatggtgcggcgcctgcacatcgcccaccgccataaaccgatcacctaccaaccggaagcaatgctagtttcataatgaggcaccccccttgggtggcctcaagcccaaatactttcctgcttatcaacttcctccaaaatcaaaataaggaggagcgtctgaagtgtttttctttggggaatcaatggaaacaatccggtagtgcataacctgcttgggcttttcgccaaaagaaaacttttggggtaaagggggaatattccccaaaaaaccacaaggggcccttttataacaactgggtccctcattccgtgtccccggtaaccacaggtacaaattttctctgcctggccccccaggggggacacccactaaaaaagaattattataatctttcccacggaatggtgtatatatcacgcgagaaaatttattgtgtgggtgctctttcaaaacccccccacaccttagcacctttataatacagggcgtttttttttgaaatcacgacccccacatatgtgtttaactttccacgaaattataaataatgtggtggcgtgcaaccaacatcgaggtgtttatccccaactagtgatagagacgaaaacacagggggggtttcttcacctatacatttatttgctccccctgcttcaagaggaagtgcccaactccacctgcgaggggcccgcccggcccatcgtagtggagagtgcgcgccccaccattttgcgagagaattatgtaagcagcgcttctgttggagtggatatataatgtgcaactaagaaaaccccccaccctgtgtgagaacaaagacggcgtaacaatagatgcggtttcctctcgaggcacaagcccctctttagtgttccaatgtn

SEQ ID NO: 92602 - protein, 32 aa, Zea mays
  misc_feature: Ceres CLONE 1581372
MAGGAGALRSGWCGACTSPTAINRSPTNRKQC

SEQ ID NO: 92603 - DNA, 674 bp, Zea mays
  misc_feature: Ceres CLONE 1581374
  misc_feature: Encodes the peptide sequence at SEQ ID NO. 92604
  misc_feature (181)..(181): n is a, c, t, g, unknown, or other
  misc_feature (182)..(182): n is a, c, t, g, unknown, or other
  misc_feature (207)..(207): n is a, c, t, g, unknown, or other
  misc_feature (208)..(208): n is a, c, t, g, unknown, or other
  misc_feature (227)..(227): n is a, c, t, g, unknown, or other
  misc_feature (228)..(228): n is a, c, t, g, unknown, or other
  misc_feature (248)..(248): n is a, c, t, g, unknown, or other
  misc_feature (249)..(249): n is a, c, t, g, unknown, or other
  misc_feature (259)..(259): n is a, c, t, g, unknown, or other
  misc_feature (260)..(260): n is a, c, t, g, unknown, or other
  misc_feature (342)..(342): n is a, c, t, g, unknown, or other
ggagctccccgcggtggcggccgctctagaactagtggatcccccgggctgcaggaattcgtctcacccctagaaaaaatcgcttcagctcggcgtcttcacaaacgccggcgcaaactctcgcccgagcccgacagatcttcaattccccattccgcccaccgatcgaccttcacgccanngtctcggtctcttccgaaggcgtcnngcgcgcggttggtttgagnnaggagaggaggaagatgagnnggagtgcatnnctcccgtccacatcggggcagggccgggcaatcccaaggtcgggcaaacgccggtggctgggggaaactttttacctggccnttcggaggcaacgggcaattcccaagccccgggaatgggcccaaaagggggcccctggggaagaaaaaaaaagaacccggccggggggaaacatttcccccccaaaggggaattgggcccctttttcaagggcaaaacccttttttttttttcctaaagccccccgaaaaaaatggggggggggggcccctgggggggggaaaaaaagacccaccctggtttttttccccccccccggcgggggtggggacaaaaaaaaactcttttttttccccggtttgtgtggggaaaaaaattctctcttgggaggagaaaaaaacaccccccccccc

SEQ ID NO: 92604 - protein, 40 aa, Zea mays
  misc_feature: Ceres CLONE 1581374
MGPKGGPWGRKKKNPAGGKHFPPKGELGPFFKGKTLFFFS

SEQ ID NO: 92605 - DNA, 749 bp, Zea mays
  misc_feature: Ceres CLONE 1581375
  misc_feature: Encodes the peptide sequence at SEQ ID NO. 92606
  misc_feature (498)..(498): n is a, c, t, g, unknown, or other
  misc_feature (517)..(517): n is a, c, t, g, unknown, or other
tggagctccaccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaggtgtgggggggaggccacctacgacctcgccaccgtgctcngcttttctcgcgtcttcgnctttcacatcttcgtctacatcatgtccaggccccgggcccggtgtacctcatccgacttcgcatggctacaaagcccggccgaccaaacttcaagtggtccaagggcgggaatttcttcggacctgggggggccaaattccggcaaatttcaaacaaggaaaaccccggggggtttcccagtcgccggttttgtggggcccaaaatccgggaattcggggggaaaaaaatt

SEQ ID NO: 92606 - protein, 186 aa, Zea mays
  misc_feature: Ceres CLONE 1581375
  misc_feature: SWISSPROT Homolog: EC 2.3.1.119 Icosanoyl-CoA synthase
  misc_feature (103)..(103): Xaa is any aa, unknown, or other
  misc_feature (109)..(109): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRRCGGEATYDLATVLXFSRVFXFHIFVYIMSRPRARCTSSDFAWLQSPADQTSSGPRAGISSDLGGPNSGKFQTRKTPGGFPVAGFVGPKIREFGGKKI

SEQ ID NO: 92607 - DNA, 872 bp, Zea mays
  misc_feature: Ceres CLONE 1581376
  misc_feature: Encodes the peptide sequence at SEQ ID NO. 92608
ccccgcggtggcggccgctctagaactagtggatcccccgggctgcaggaattcgtctcacccctagaaaagaatcatacggccagaaatattagatagacagaaaggaagaggagaatagcggcgaggacgaagtggcccgcccaggaaatggcgtcgatgcagagctggcgcaaggcctacggcgccatcaaggacaccacaaccgttagcctcgccaacctcaactcggacttcaaggatctggatgtggcgatcgtgaaggcgactaatcacgtggagtgcccacccaaggagcgacacctgcgaaaggttgttgcggcgacatccatcaccaggcctagggcggatgtcgcctactgcatccacgcgcttgcccgccgtcttgccaagacccgcaactggattgttgctctgaaagcacttgtagtaatccatatacttcttcgtgagggtgatcctacatttcgagaagagcttcttaactttacacaaaggggggcgtatactgcaactttcaaactttaaggatgactcccgtccaattgcttgggattgttctgcctgggtgcgcacatatgggttggttttgggaagaaaggttgggagcgctttcagagtttctaaaacatggatggttgaaacctaaaccgtttggtcccaaacaaagggcccaaggtgccttgaaaaaggggtcacaggttggaaacccacaggagcgctgggaattcccccacggactccttgtttagaagaaaactctgcccgggcattttgggcacctcccacttcaattatttcccccgcccctctctttggtggaatgtttctagtcccctcggacaaggggagcctatcacaaaaaaaataaa

SEQ ID NO: 92608 - protein, 125 aa, Zea mays
  misc_feature: Ceres CLONE 1581376
  misc_feature (29)..(125): Pfam Name: ENTH Pfam Description: ENTH domain
MASMQSWRKAYGAIKDTTTVSLANLNSDFKDLDVAIVKATNHVECPPKERHLRKVVAATSITRPRADVAYCIHALARRLAKTRNWIVALKALVVIHILLREGDPTFREELLNFTQRGAYTATFKL

SEQ ID NO: 92609 - DNA, 1186 bp, Zea mays
  misc_feature: Ceres CLONE 1581379
  misc_feature: Encodes the peptide sequence at SEQ ID NO. 92610
  misc_feature (71)..(71): n is a, c, t, g, unknown, or other
gaagggggaagaaattattaagagctataaaagacgccagaaaagggggtggtttgatacagggaggaagnggggggattcacattacccggagggggccgctctacactagtggatcccccgggctgcaggaattcgtctcacccctagaaaaaatgccaaataatccccacctcccgctcatcctccgcctccgccgccagccatggtctctgtcacctcggcctgcacctcactcctcttcccgcaggccacctcatcgaggagccgcgtccggctctcgacctccctgggcttctccgcgcacccggctcggctgcggagcctggcggcaggaggaaggcagctgcgccggacccagctggtggtgcgcgcggctaggggaaagcttgagccgcaccaaatccccaaagaaacgtcggggggttaggtaatgtcgaccccggggaagagacccgtcaggggccggggtcaataatggggatcggccaacagttgggggggcaagcacccccaaaaaaaaaaccaattaggatcgaaatgcctcccccccgaaggaggaggggccccccccgttttaaaaaaaacaaagtccccccctccggagttaaaactaagaaaaacaaaaaaaacccctggcgggataacaaattataggggtagaaaaaggggcccccggggggacaggcggaaaaacattttggtgtttaggtaaaccgttttaatatttcccccggggcgaactatacgcccaaaatataagaggaaaagaggggtgtgaacataaaaaaaaatcgggtgtggtgctccatctgggggggggagtaaaaaacaaggaggacccccacaatagtgcccctcaggatagatcttgcagaaacggtgtgcgcccatttttttttttttttatggagacaaaaaataatagtggtttggggggtgcttcccgcaaaaaaaataacatttgtgtcccgtgtaggtccctcacaaaagaatggaagggagtccttggtgtcgctgctactcccccccagaggggggcctcggtctatggaaaatttctttcgcaaaggaatgggagaagtttttctgctaagtataagtggtgacagagagaaaccgaaatagggggcgtagaaggcgggagaaaaaaatggcctccattaagcacctctctgaccgcaaa

SEQ ID NO: 92610 - protein, 74 aa, Zea mays
  misc_feature: Ceres CLONE 1581379
MVSVTSACTSLLFPQATSSRSRVRLSTSLGFSAHPARLRSLAAGGRQLRRTQLVVRAARGKLEPHQIPKETSGG

SEQ ID NO: 92611 - DNA, 725 bp, Zea mays
  misc_feature: Ceres CLONE 1581380
  misc_feature: Encodes the peptide sequence at SEQ ID NO. 92612
  misc_feature (464)..(464): n is a, c, t, g, unknown, or other
ctccccgcggtggcggccgctctagaactagtggatcccccgggctgcaggaattcgtctcacccctagaaaaaaaaacaacacacgaacaccgcaccgcaacgtagccggctaggggaagagctctttccttcagctgtgccgtgcacaacgcacggcacgctggtttggtttgcatcgcccccgccaagaaagacgctgccgtgagcgggctgagcgggcgggaagcagcagcaggcgggcgacatgccgagcggcagcgcgttctccgggtcggtgaacctcaagcacgtcaagctggggtaccagtacctggtgaaccacttcctgacgctgctgctggtgccggtgatggccgccacggcgctggagctggcgcgcctcggccccggcgagctgctctcgctgtggcgctcgctggagctggaccctggtcacatcctctgctcggcgtttcctggtcngtctcgtcggcaccgtgtacgtgatgtcgcgggccagggcggtgttaccttggggggactacccctgctaaaaacccccccggccagcttggccgggtgcccctttgcccaccttttatgggaaccaacagcggcccctaatttaggggaacgaacaaaaaaaaagggggggggggcttttccaaaaaccagggaaattcccgggaaagggctccccggggggggcctccgggcaaaaaagaaaaaaccctggggcccctc

SEQ ID NO: 92612 - protein, 159 aa, Zea mays
  misc_feature: Ceres CLONE 1581380
  misc_feature: SWISSPROT Homolog: EC 2.3.1.119 Icosanoyl-CoA synthase
  misc_feature (73)..(73): Xaa is any aa, unknown, or other
MPSGSAFSGSVNLKHVKLGYQYLVNHFLTLLLVPVMAATALELARLGPGELLSLWRSLELDPGHILCSAFPGXSRRHRVRDVAGQGGVTLGGLPLLKTPPASLAGCPFAHLLWEPTAAPNLGERTKKKGGGAFPKTREIPGKGLPGGGLRAKKKKPWGP

SEQ ID NO: 92613 - DNA, 806 bp, Zea mays
  misc_feature: Ceres CLONE 1581381
  misc_feature: Encodes the peptide sequence at SEQ ID NO. 92614
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (422)..(422): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnntttnnnnnnnaaaagctggggctccccgcggtggcggccgctctagaactagtggatcccccgggctgcaggaattcgtctcacccctagaaaaaacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgaagctcgtccccatgaagccgccaggaacggcgaaccaccgnccgccccggagcaccttcgcccaggaaaccccttttccgggaaaaggtgcccgggtgccttcgaagggaatggggggacctttccacggctccttttgaaaaatcaacggtggccaaaatccccgaaggggcaatggtttttcttccccgggaaaaaccaccaaaaccccccggaaaaaccttgtcttggggggcccgggccggcaaaaagggggcttggggaaaacccaaaaaaaggggggcaaaaaaggggggggggaaaaccttttttggggccccttgggaaaaaaattttttaaaaaaggcgccccccaccacccaaaatttttagaaaacccccccccccccgggggggggaaaaaattccccgcccccattttgggg

SEQ ID NO: 92614 - protein, 144 aa, Zea mays
  misc_feature: Ceres CLONE 1581381
  misc_feature: SWISSPROT Homolog: EC 2.5.1.18 Glutathione transferase
  misc_feature (46)..(46): Xaa is any aa, unknown, or other
MATPAVKVYGWAISPFVSRALLALEEAGVDYEARPHEAARNGEPPXAPEHLRPGNPFSGKRCPGAFEGNGGTFPRLLLKNQRWPKSPKGQWFFFPGKNHQNPPEKPCLGGPGPAKRGLGENPKKGGQKRGGGKPFLGPLGKKIF

SEQ ID NO: 92615 - DNA, 829 bp, Zea mays
  misc_feature: Ceres CLONE 1581391
  misc_feature: Encodes the peptide sequence at SEQ ID NO. 92616
  misc_feature (80)..(80): n is a, c, t, g, unknown, or other
ctggagctccccgcggtggcggccgctctagaactagtggatcccccgggctgcaggaattcgtctcacccctagaaaanaaaaaaaaaaaaaaaaaaaaaaaaaaaaaaaaaaacccctgcccacccgaacaataaccaacagcttcaccctcctcctccagtgcaggccgtcggcggctggcggcgtcatttctcctccttcctctggcctgccctgccctgcccgcgcgataaccatctctcgcaactcctcttcgtactcctcgtctccaacgccggcaacaactacagagcttcagcttcccaagcgcgagacatgcgtgcggaaacacagacggcggagtagcgtagcgccacgatgggattgccaagctggtaggtagccaagaagacatgagatgggggcgtccttgggctccgccgccagcaagaaccggcagcaggagcacggcggcgaggctccgcgaccagatccctgcaagaagacgcggctctcgacccctctctgcactatccacggccactcgaggctgatcccggggctcccggatgaggtctctctgcagatcctcgcgaggatgccgcggatggggtacctcaagcccagatggtctgcggagctgaaaggcggcggtgaccggcgcggagctgtacgggctgaagaaaggactcggctgggcgaaaaaatggctgtacatactgacaaaaggcggcggcaggtgggcaaaaactggtctgcacacttctcgatccggtttagcaccaatggcaaagctggccctccatgccgggaatcaattgcaagaatggcggcctgtacgggcttg

SEQ ID NO: 92616 - protein, 143 aa, Zea mays
  misc_feature: Ceres CLONE 1581391
MGASLGSAASKNRQQEHGGEAPRPDPCKKTRLSTPLCTIHGHSRLIPGLPDEVSLQILARMPRMGYLKPRWSAELKGGGDRRGAVRAEERTRLGEKMAVHTDKRRRQVGKNWSAHFSIRFSTNGKAGPPCRESIARMAACTGL

SEQ ID NO: 92617 - DNA, 1179 bp, Zea mays
  misc_feature: Ceres CLONE 1581394
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (71)..(71): n is a, c, t, g, unknown, or other
  misc_feature (79)..(79): n is a, c, t, g, unknown, or other
  misc_feature (80)..(80): n is a, c, t, g, unknown, or other
  misc_feature (82)..(82): n is a, c, t, g, unknown, or other
tgtgtgttgggttnnnntttagcggaagaaacacaacactgacgcagaattagtatttatatcttcatttngggggggnntngtgatattatcgcggtggcggccgctctagaactagtggatcccccgggctgcaggaattcgtctcacccctagaaaactctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaaagataccgttcagagaaaaagttatctacactgttatttttccctcttcattttcctggtctgcagccagctcccactctatggcattcattcaacaactggagctgatcctttttctactgggatgcgtgtttatccccccccatcaaaacggggccactgtgatgggaattggggatttactccccaattggtgaccatccgggaagggaaatgcaaaccttcctttgtttggggatcgaaaaaatcattggaaatttgaaaaaaccactggggaaaaaaagagaaatcccgggcccccgtgccgaaaaggggggggccaccaaaaagaatgggccctggggggaaaccccccgaaattggccctattttgggggggaaaaaacctctttgtgcgcaattatatttttccccggcttcctccggaggaaataatgataattgagggccaacatgggtgtaaaaaccctccacatcttctgtggagaaaacagggggaaaatagagcttatttcccccccatatatataaataacctctaacaaatctttatttttcttttgtggggggggggcacaccttttgttgttccaactcggccgccccggagaaaaaaacacacccctccccaccacaagaaaagagttattgtgggtgttgtaggaaatatctggggggattttctctcctcgtgtgttctgttgtggccacacaacaatattttctgcgggaagaaaaatattcatcatcggtaagaaagggctggtttatcccccccacacccacaaacataaaaaggagagtggtggggggggctatatattatataagg

SEQ ID NO: 92618 - DNA, 879 bp, Zea mays
  misc_feature: Ceres CLONE 1581395
  misc_feature: Encodes the peptide sequence at SEQ ID NO. 92619
  misc_feature (846)..(846): n is a, c, t, g, unknown, or other
ctccccgcggtggcggccgctctagaactggtggatcccccgggctgcaggaattcgtctcacccctagaaaaactctcttctcctcgcctcgccttggtgttcacgccgtcgctagcgcctgccgcggcgaagcttctgccctccccggcgccgggctcgggtcgtcgtcggccaggaagatggctggcggcttcagggtactgcatctggtcaggccttttcttgctttcttgccagaggtgcagagcgcggataggaagataccgttcagagaaaaagttatctacactgttatttccctcttcattttcctggtctgcagccagctcccactctatggcattcattcgacaactggagctgatcctttctactggatgcgtgttatcctcgcatcaaccagtggcacttggtgatggagttgggtattactccaagtgtgacatctggggatggtaatgccaacttcgtgtgggatccaagatcattgaagctaacaccaccgtgaaaaaaggatcgtgctctgcctgaaatgggggcaaaaaaagttgctttgggtatcctgatttgctattgggggaaaccctgggggcatttgtcctgtccgggaatgtttggggagtgttaagcccaacttggaaacagggaaatgctttccctcattataccttcaagatttttctttgggggggcatctttgtgctccagtgctgggaggaacttccccccgaaaaggttatgggcttggggatccggggattttccccggttctttggctaccaaatattacgccagaattttcatcccgggaagggaattttaccccccccacccttccatacnggggtgccttggggcctcaatattttaaaaggg

SEQ ID NO: 92619 - protein, 78 aa, Zea mays
  misc_feature: Ceres CLONE 1581395
MAGGFRVLHLVRPFLAFLPEVQSADRKIPFREKVIYTVISLFIFLVCSQLPLYGIHSTTGADPFYWMRVILASTSGTW

SEQ ID NO: 92620 - DNA, 830 bp, Zea mays
  misc_feature: Ceres CLONE 1581400
  misc_feature: Translation starting site: 159
  misc_feature: SWISSPROT Homolog: EC 6.3.5.4 Asparagine synthase (glutamine-hydrolyzing)
  misc_feature (366)..(366): n is a, c, t, g, unknown, or other
  misc_feature (479)..(479): n is a, c, t, g, unknown, or other
  misc_feature (532)..(532): n is a, c, t, g, unknown, or other
tggagctcaccgcggtggcggccgctctagaactagtggatcccccgggctgcaggaattcgtctcacccctagaaaaatcccagcacgtctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccngtcgtggtggtgggccaatggagagatctacaaccacaagaacgtccggaagcagttcaccggcacacacaacttcagcacgggcagtgactgcgaggtcatcatgcccctgntacgagaagtacggcgagaacttcgtggacatgctgggacgggggtgttcgcngttcgtgctctacgacacccgcgacaaggacctacgttggcggcgcgcgacgccctcggcgtcaacccgctctacatcggctgggggcagtgacggttccgtctggatcgcgtccgagatgaaggcgctgaacgaagactgcgtgcgcttcgagatcttcccgcgggccacctctactcagcgccgggcggcgggtcccggcgtggtacacccgcactggtccagaagcagtgccccggaacccgtacagccgctcgtcctcaaaaagcctcgagaagcgggcatcaagagctcatga

SEQ ID NO: 92621 - DNA, 878 bp, Zea mays
  misc_feature: Ceres CLONE 1581406
  misc_feature: Encodes the peptide sequence at SEQ ID NO. 92622
  misc_feature (878)..(878): n is a, c, t, g, unknown, or other
gcggccgctctagaactagtggatcccccgggctgcaggaattcgtctcacccctagaaaaagcccaagctgagctgagcttttccataccccgccctaaaaccatcacgactcatgcctgtccttccccggaatctgacagctccgcttcaccaagcaaaccaaacagctagcgtcattgcgtcaacgacgttgtctcgtcttgcaagatttttccccttctaaaaatacatttggacctgaactgttgttaagctaaagtggcgggcggaactgtttttaaaatgtacaacgtaactacaggggatggtgctgctggtgctgtccgtctcggtgccggcgctgaagccgccgccgtgcggcgccggcggcgtgtgcccgcatgcgtcggcgctgcagctcggggcgtacttcggcgggctctacatcgtggccctgggcaacggcggcaccaagcccaacatctccaccatcgggggcggaccagttcgacgagttcgacccgcgggagcggacgcaaaagcggtccttcttcaacgggggggatgttcccatttttccgggggatacctttttcctacaccggtcctcgtttaccgggaggaaaaccgggagcggggtccggggggtaagggattccccccgggggggccccaggggttccaatttccgggtttccccgggggggacaggggtggttccccccagggggggcccagggggaaccccttttacaaaaaaggggagggggcctgggcccccccgcctcttaaaaggtgagagagcccggggcccggcggaaaaacaaagggagtcccccaagaggggggctccgggagaaaccccccacaaaaacggtggttggagggagagccccn

SEQ ID NO: 92622 - protein, 157 aa, Zea mays
  misc_feature: Ceres CLONE 1581406
MVLLVLSVSVPALKPPPCGAGGVCPHASALQLGAYFGGLYIVALGNGGTKPNISTIGGGPVRRVRPAGADAKAVLLQRGGCSHFSGGYLFPTPVLVYREENRERGPGGKGFPPGGPQGFQFPGFPGGDRGGSPQGGPRGNPFYKKGEGAWAPPPLKR

SEQ ID NO: 92623 - DNA, 840 bp, Zea mays
  misc_feature: Ceres CLONE 1581410
  misc_feature: Encodes the peptide sequence at SEQ ID NO. 92624
  misc_feature (655)..(655): n is a, c, t, g, unknown, or other
  misc_feature (663)..(663): n is a, c, t, g, unknown, or other
  misc_feature (664)..(664): n is a, c, t, g, unknown, or other
  misc_feature (722)..(722): n is a, c, t, g, unknown, or other
  misc_feature (790)..(790): n is a, c, t, g, unknown, or other
ctccccgcggtggcggccgctctagaactagtggatcccccgggctgcaggaattcgtctcacccctagaaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattcccccgtgccctctctccgtcccctcaaccttctccctcctttcttgcttccctccacaaatcgcaaataacagcactagcggcagcgggtagaggaatcttttcgaggtaagttagggccgggccgggtccctgcgggaaaaaagaaagaaaanggacctgnntctgatgtcgtcgtcgtcgctgtctccgacgggcggggaggacgtcccgggtcggacnggcgactcggcggcggacacgcacaggcgcgagaagcgccggctgtcccaacgcgagtcggcgcggcngtctcggctccgggagcagcagcacctggacgagctggtgcaagaagtgg

SEQ ID NO: 92624 - protein, 57 aa, Zea mays
  misc_feature: Ceres CLONE 1581410
  misc_feature (41)..(41): Xaa is any aa, unknown, or other
MSSSSLSPTGGEDVPGRTGDSAADTHRREKRRLSQRESARXSRLREQQHLDELVQEV

SEQ ID NO: 92625 - DNA, 1227 bp, Zea mays
  misc_feature: Ceres CLONE 1581411
  misc_feature (1)..(1): n is a, c, t, g, unknown, or other
  misc_feature (2)..(2): n is a, c, t, g, unknown, or other
  misc_feature (14)..(14): n is a, c, t, g, unknown, or other
  misc_feature (15)..(15): n is a, c, t, g, unknown, or other
  misc_feature (21)..(21): n is a, c, t, g, unknown, or other
  misc_feature (22)..(22): n is a, c, t, g, unknown, or other
  misc_feature (73)..(73): n is a, c, t, g, unknown, or other
  misc_feature (75)..(75): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (1042)..(1042): n is a, c, t, g, unknown, or other
  misc_feature (1082)..(1082): n is a, c, t, g, unknown, or other
  misc_feature (1084)..(1084): n is a, c, t, g, unknown, or other
nntttttttttggnngggggnnggtgcttttttagcaccacacaacccacccttaattaattgaaagagcggngnggcgcaannnnaaaaaaaataaaactcaccgcggtggcggccgctctagaactagtggatcccccgggctgcaggaattcgtctcacccctagaaaaaccctccctccattccatcgtcttcgcttccactccccacgttccccgcctgcttcctccaggccccggccagatccgcgcgcccgcggggaagagggcctcctctcctccctcctcccttggctcgcgctctggtcgaggaggcggacgccggtgccggcgggcgggcggggaggtaggtagcagcttgcggttgcgggagggaagctgcgcgcgctaggctgccatggcggtggaagagactctgcccggcccgagtgcggggaggaacgtgctggtcacgggcggggcgggctacatcgggagccacgccgtgctagaactccttctccgcgggcttccgcgcccgtcgtcatcgaaaaacctcaaaaattccctcccaaactgggccgttccgcccgggttccccccagcttgggggggggaacaacttcccccgcaaaccccctccttttcccaaaaaaaatttggaatccccccgggaaaaacaaggggaaccccctgggggaaaaagggggttttttttgcgccctctccccaccaaaaaatatttttgaaaaacggtgtttgctttttttccacttttttcccccgtgggggaatatattgtaataaaaaacccccctcggggggggggggggggaaaaaaaaaagaccgcgtgcctcccccatgaggaaaaagccccccccgtttctcccctttttttttatttgtaatgagataacaaacaaaaaaaaacaccgtgtttttttttggggggcgcgccccccccaaaaaaaaaaaacccccttctccccaaaaaaaagaatattatatgttgtggttttgggttggtgccacccccccccccccccaacaaataaaaaaangggggggggtggtcccccaaccaacagaagaaaaaaagtnanaattggttgtgtgttgtatattcccccccacataaaaaatattctccccgcccggcccgcagaagaaaaaaattttttccccgcctgtgttgcgccaaaaaaaaaagtctttatgtgggagaaaaaaaaaaaaaagccgcgtg

SEQ ID NO: 92626 - DNA, 1108 bp, Zea mays
  misc_feature: Ceres CLONE 1581412
  misc_feature (57)..(57): n is a, c, t, g, unknown, or other
  misc_feature (59)..(59): n is a, c, t, g, unknown, or other
  misc_feature (61)..(61): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (79)..(79): n is a, c, t, g, unknown, or other
  misc_feature (1108)..(1108): n is a, c, t, g, unknown, or other
gtgttggggtgtcttttttctctagaaaagaaggggacgggggggaggtgaggaggntntnatgccggcggcnnnnaantaagagctcccgcggtggcggccgctctagaatagtggatcccccgggctgctggaattcgtctcacccctagaaaaactctccgagagccctcgcgaattgaagctgctgggcacggctatctagctgtatcgctcgtcgagtcaactccccgcgcgcgtcgtctcgttcgagttctctcgcatctcgatcgggtgcgctacacgtagacgtagcgtccgctgatacataaaccgcacggcggaagctgctcggtgctctccctactagttccaaaagaagcaaggaagatagcatcatcgatcgtgtcatgagacccgcggaaagcccggcccggttggttttgctgctcctgctcgcccccgtggccgcgggggacgccgggcgtggagccccctggccccgcattggcctttcaacggggccccgctttctggctcgaacccttccccccgccctggcggggcccccccccggaagcctgcttggggaaccaaggggcgaaaaaataccggccctgggggggaaaggggagaaccccttggttaccgggccccaattccaaagtgggcccaaatagaatttggggactcccgcgcgctgttttttcctcccccctctcgaaaagtttaaaaaagcgggggttccacccaaggtggcccgtgggggtttctcccccccgggaagattcttgtgggcccccaagaggcccccccgtggagaaaattaggtgcccccggggttccccccaatataagaaatattttcatttttccgcccccaaaaaaagatatttttcagtggagcttcttggcgggaaaaattttccccgcgagaaaaaaggagggccgccccctcagatttttccacagcctgtatgattaaacccccgcgcgggggggggatcccttccccattgcggcgcccgtgtttttaccccggggggggattatcccgcagattccccaaaaccttttgttgccgaaataggtaaaaaagcccctttttgtttttcgccaagaaaccccn

SEQ ID NO: 92627 - DNA, 842 bp, Zea mays
  misc_feature: Ceres CLONE 1581418
  misc_feature: Encodes the peptide sequence at SEQ ID NO. 92628
  misc_feature (321)..(321): n is a, c, t, g, unknown, or other
  misc_feature (564)..(564): n is a, c, t, g, unknown, or other
  misc_feature (590)..(590): n is a, c, t, g, unknown, or other
  misc_feature (626)..(626): n is a, c, t, g, unknown, or other
  misc_feature (685)..(685): n is a, c, t, g, unknown, or other
ctccccgcggtggcggccgctctagaactagtggatcccccgggctgcaggaattcgtctcacccctagaaaaaacggctccagatccgccgtacgcataagccccagctgccctacctgcgcactcgcctccgcctccatctccttcgccaccagacctcaagcgcgccacacgccgccgcacgggagccgcgcgccgcacccgccgccgcttctcctcaaaaccagaggtctccccccgtcccccgatccagcgtctccatggccgcgccgcagcctgtcgcccccgcctccgaggcgccgccgtctgcgcaaatgggnggcatacgcgttcgtgcagcagtactacctcgtgctgcaccaagtcgccgggatctggtgtaccgcttctaccaggaggccagccgcctcgctcgccccgcatccgccgccggagccgcccgcatggactcggtcaccaccatgggaggcgatcagcgagatgataatgggagatgggacgtgtccaaagcggatgatcaggacggtggatctcgcaggagtctttagggcgggcggcgtcgnctgtggctcgtcacaggtcacctcanccggccgttgatggagtgggcgccgcgagttctcgncaatccttcttcctcgcgcccgcaggagatggggctacttcgtgctcaacgacatcttnccgcttcgtcgggggacatccctggcctctaccgccgttgatgcgcagccagaagcgggtgctgtagtcccgcctggggctgctccactttgcacggcacagctactcctgctgtggagcctgccactctgatgatcatgggtgcgtgcacagcagg

SEQ ID NO: 92628 - protein, 34 aa, Zea mays
  misc_feature: Ceres CLONE 1581418
MDSVTTMGGDQRDDNGRWDVSKADDQDGGSRRSL

SEQ ID NO: 92629 - DNA, 1104 bp, Zea mays
  misc_feature: Ceres CLONE 1581419
  misc_feature: Encodes the peptide sequence at SEQ ID NO. 92630
  misc_feature (1)..(1): n is a, c, t, g, unknown, or other
  misc_feature (13)..(13): n is a, c, t, g, unknown, or other
  misc_feature (17)..(17): n is a, c, t, g, unknown, or other
  misc_feature (25)..(25): n is a, c, t, g, unknown, or other
  misc_feature (70)..(70): n is a, c, t, g, unknown, or other
  misc_feature (1104)..(1104): n is a, c, t, g, unknown, or other
ntattttttttgngggngctttccncccaccacccctatgtccagccaacacaaggtataataatttatngagagtttttttttttgtggagctccccgcggtggcggccgctctagaactagtggatcccccgggctgcaggaattcgtctcacccctagaaaaatcgtgtcatacaccctcgcccaaccgacggctaccggttgtaatattggaatcgtttgatggccgtctcctccgcttcgcatccggttcctttaagacccgatgcctccgatatactggacggggatctccgtctcatgcccgctgtggcaatctcttgggattcctgaagcaatacacaggcatgcagagacgcgtgagatacagtcaaaagcgtgtgtcattgatccttctctgcttccagctctagatgatttattgcaggacatctattaatcattgcaaccaccagtcagtgggactatgagtaccgattcctccacgagaacggttttcatcaaatattgctgggataaaatttttcggtaaaaaacaaaggagccttcccagttgggggaaaaccttttgggaattttttcccaaaaaggaattctagttttaatcccccccaaagcggaaacctgggaaaacccccccctggtggaaaagcttccccacaaaagggaaaggtcctaaaaatggaagccggggggagccctccccccccgggggaaaccccaggaaattttgccttggcccccaatttttaaagagaaaaaagccccttgggaaaaacaaagatgttgtcgccccaactttgtttaaacccaacccccagcccacgaatccacgtggtgttttcccccctgctgctatacggggtgatgtgttattacaaccgcgtttttttttgtaacttgcgccacaaaaattttacccctgctttacgccgaaaaggttttttgggggataaaaaaaggccaacaccgccggttcataaaaagccggggttataagttctcccctccacaaaaagaatacattatgggcgggttttttcacacaaatccggggggcaattttttacaactgttgtctttcaacggcagttgtgataan

SEQ ID NO: 92630 - protein, 57 aa, Zea mays
  misc_feature: Ceres CLONE 1581419
MPPIYWTGISVSCPLWQSLGIPEAIHRHAETREIQSKACVIDPSLLPALDDLLQDIY

SEQ ID NO: 92631 - DNA, 1190 bp, Zea mays
  misc_feature: Ceres CLONE 1581420
  misc_feature: Encodes the peptide sequence at SEQ ID NO. 92632
  misc_feature (11)..(11): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (63)..(63): n is a, c, t, g, unknown, or other
  misc_feature (73)..(73): n is a, c, t, g, unknown, or other
  misc_feature (77)..(77): n is a, c, t, g, unknown, or other
  misc_feature (712)..(712): n is a, c, t, g, unknown, or other
  misc_feature (1063)..(1063): n is a, c, t, g, unknown, or other
  misc_feature (1190)..(1190): n is a, c, t, g, unknown, or other
gtgtttttgtngttnnntttacttttgtaagtgggtccgaggcagattgcgctgctctatttngaaagatatnaatnaaaaactgggactccccgcggtggcggccgctctagaactagtggatcccccgggctgcatgaattcgtctcacccctagaaaaaactccggccctcacacaaattgcccctcttcttgtcctcctctttacacgctgccgaccacggctgccgccaaccacccgccccaccgctgccgagtgctagccatttggagctgccgcgccatggcgtccgtggccgccaccaccacgctggcaccggcactcgcgccccggcgccgggcgcggccagggagcgggctgctgccgccgcgccgggcctcggccgtccgctgctcgctcgacagtaacgtctccgacatgggcgtcaacgcttcccaaagggttattcccacccgagccaaagcactaccaggggcccgaaagctcaagggtgggccatccattagggggcagggcctttgcggggcatggtcccaaccgcctgtttgagcctctttgggacccaggggcccatggagggttgtatttttgtaacaaggctcccccttcccgttttatatccggtgaggtaaaaggtttgggacctcccctttttgtttgaaaacagggcccaaaggaaaaaaccccaattatctccgaagaaatggggngggccctggagcaaatgagtgagttatcccatcatcccgggggtgggtgcttatacaccaccacaaaaattccttcccttttctcccccctcctctcttaaattggtaataaaaaaaataagggtttttggggcccgccctctcaaaaaaataaaaaaaaatccttgggcttttggggggggaaaataggtaaaacacatttaacccccgccataacccttttgtttggtataaaaataaaaaagaggggcgggcacaaccaattttgggcgggcgaacactttgtaatattattaccggggtttcccccgaggtgggtgagaaaatctccccatgttaagcatgtggccntatctccacaacatacatctcctataacaaactcttattctcgcgccgccctaaagggtttcattggattaaaatagcttaaagaatagagcgggagttgccccccttgggccacctatagtacccn

SEQ ID NO: 92632 - protein, 88 aa, Zea mays
  misc_feature: Ceres CLONE 1581420
MASVAATTTLAPALAPRRRARPGSGLLPPRRASAVRCSLDSNVSDMGVNASQRVIPTRAKALPGARKLKGGPSIRGQGLCGAWSQPPV

SEQ ID NO: 92633 - DNA, 862 bp, Zea mays
  misc_feature: Ceres CLONE 1581421
  misc_feature: Encodes the peptide sequence at SEQ ID NO. 92634
  misc_feature (242)..(242): n is a, c, t, g, unknown, or other
  misc_feature (244)..(244): n is a, c, t, g, unknown, or other
  misc_feature (246)..(246): n is a, c, t, g, unknown, or other
ggagctccccgcggtggcggccgctctagaatagtggatcccccgggctgcaggaattcgtctcacccctagaaaaatacctttgccttgtcgcgcttgcagcttgctcgtctccggcgcccgcgcgagctcttcttcctttccgacgccagcgcggtatcctcgtcgtcgccagtgcgcgagcgtctcctcctcctccttgcggcctcccgcgcctccgccccccccccccacgcactagnananagacacatgcgggagaagagtagtggatgcggagcgtctcctgtaagcggtctcccaaacgccacgcttgtactcactttgtttctaataaaaaattgctgtggtggaggccatagattccaagtggtggtttagagaagtcccaaacataccctttgtttggggagaagaatcgagagggagatagctaaactagggttaagggaattaggggccgagaggagcgcaatgagcatcgtgcccaaggagacgatcgaggtcatcgctcagagcgtcggcatccccagcctcggtgccgatggtgccgtcgcgctcgcccctgacgtcgaataccgcctccgcgagatcatgcaggaatccatttaacggattgcggcattgcaagggggactggttctaaccgcgaatgatttttaacagggcccgtgggcctcagggaaatgtgaacccccctaatagggaatttgccctctggggaatcccatttacctttttaagaagaagctgggtgggaaaatagagggattctccttcttattctttgaaggaaccgggggaaggggagaaactttccaaaagaaaacattatgtgtgccgtgggcctcttcctgggccc

SEQ ID NO: 92634 - protein, 45 aa, Zea mays
  misc_feature: Ceres CLONE 1581421
  misc_feature (2)..(46): Pfam Name: TAF Pfam Description: TATA box binding protein associated factor (TAF)
MSIVPKETIEVIAQSVGIPSLGADGAVALAPDVEYRLREIMQESI

SEQ ID NO: 92635 - DNA, 894 bp, Zea mays
  misc_feature: Ceres CLONE 1581422
  misc_feature (376)..(376): n is a, c, t, g, unknown, or other
  misc_feature (387)..(387): n is a, c, t, g, unknown, or other
  misc_feature (398)..(398): n is a, c, t, g, unknown, or other
ctccccgcggtggcggccgctctagaactagtggatcccccgggctgcaggaattcgtctcacccctagaaaaaaagcaggacgtcttttcggcggacttcaccgcatacaccgctgcccgcgcgcagccgcgcaggtgcatctgcgccgccgccggcccgccgcacccgcacgtctccttatacccatccggccatctacacacggcagtccacgctcgtggcaccgcactcactccgaatcctgaagcaacaaacaccagaagcgcaccaactccccaaccaccggagaccgcaccccagcaaaggatggcatctgactccacggccgccgtgacggtggacggcagcgcgcttgcgggcgcgcgctggccgcngcgggcacgcngcacatgttcngggtgggtgggcatccccgtcacctccctcgcgtcccgtgccgccgcgggccggggtccgcttccctcgcttttccgcaacgagcagtccgcgggggtagcccgccgccgccttacgggttccctcacgggctcccccgggggcccaaataaccgttttcgggcccaggaagcgtccagggggttccggggccttttcccaccggcaccgcaaaacgcttgggccgctccccaggaatcccggaaaacccggaaaaggggttaaacccgggaggggggaaattccaagagaacctccacaaaaacccccccccaaaaccccttccacaaagacccggcgaaagggaaaaacaaattgggaaaaaaaccccgccctcttttttaaaagccccccccccccccccgggtgtgggcgcccccggggggggtctcctttaatttttccggagaagacccccccaaaacaccccctcataaaaagaagggggggggttttc

SEQ ID NO: 92636 - DNA, 844 bp, Zea mays
  misc_feature: Ceres CLONE 1581423
  misc_feature: Encodes the peptide sequence at SEQ ID NO. 92637
  misc_feature (513)..(513): n is a, c, t, g, unknown, or other
  misc_feature (744)..(744): n is a, c, t, g, unknown, or other
  misc_feature (746)..(746): n is a, c, t, g, unknown, or other
  misc_feature (804)..(804): n is a, c, t, g, unknown, or other
ctggagctccccgcggtggcggccgctctagaactagtggatcccccgggctgcaggaattcgtctcacccctagaaaaagtcccgtcctcgcatcccacgccacaccctcccaatccccttcccctcgcgtctccacacctttcacacgcgacgccggagagacagagcgcgcgcgcgcgcccgaaagatgtcgacgtgcgcggcggacctggcgccgctgctgggcccggcggcggcgaacgccacggactacctgtgcgggcagttcgcggacacggcctccgcggtggacgccacgtacctgctcttctcggcctacctcgtgttcgccatgcagctcggcttcgccatgctgtgcgccggctccgtccgcgccaagaacaccatgaacatcatgctcaccaacgtgctcgacgccgccgcgggggcgctcttctactacctcttcggcttcgccttcgccttcggcacgccctccaacggcttcatcggcaagcagttcttcgggctncaggcactgccccagaccggcttcgactacgacttcttcctctaccagtgggccttcgccatcgccgccgcgggcatcacgtcgggctccatcgccgagcgggaccagttcgtcgcctacctcatctactccgcgttcctgacgggggtcgtctaaccccgtggtgtcgcactggtttctggtcgcccgacgctgggccggcgccagccgcacgtccggcccgctgctctncngggtcggcgtcatcgacttcgccaggctccggcgtcgtccacatgggtcgcggcatcncggggctgtggggcgcgctcatcgaggcccccgcatcggg

SEQ ID NO: 92637 - protein, 159 aa, Zea mays
  misc_feature: Ceres CLONE 1581423
MSTCAADLAPLLGPAAANATDYLCGQFADTASAVDATYLLFSAYLVFAMQLGFAMLCAGSVRAKNTMNIMLTNVLDAAAGALFYYLFGFAFAFGTPSNGFIGKQFFGLQALPQTGFDYDFFLYQWAFAIAAAGITSGSIAERDQFVAYLIYSAFLTGVV

SEQ ID NO: 92638 - DNA, 832 bp, Zea mays
  misc_feature: Ceres CLONE 1581424
  misc_feature: Encodes the peptide sequence at SEQ ID NO. 92639
  misc_feature (832)..(832): n is a, c, t, g, unknown, or other
ctccccgcggtggcggccgctctagaactagtggatcccccgggctgcaggaattcgtctcacccctagaaaaaaaatgggccacgccgcaccactgagcacccttcctccctgctcttgcctctgtcctatactactactactacccatctttagccgccgcgtgcatgcaagaagaggaatagccgccgatcgatcagcgctcgaccgacccgtcatccttgacgaacgaccagctaggaaacaggaggcaccttctttgcacgtgtcagtgccagccaggcgaacccaagggctagctgtcaggacggctcagctccagctttgcggccctccagctctccccagttcaagttcaatattggcgagcatgcgagtttgccctcttccgtcatcgtcctcgcgatccccgcgtccctgtttcggcgtacgcctcccgtagacaacagttgcgccctgctctccggcaagctatggccaagctgagctgcttccccgctctgctcccccggcaagaggaagaagaagacacgcaagatcaccgatgccatcaaagccagcggcaacgagtgccccaaagtgtagccgggtcgagtcgaactcatcgacccgacgcttggtgcaggcgtcgtccaggacgtcgtccccgccgagctctcggtcccccgtggaggaccgcgacaataagggagcggctgatcaactggtgtcggtggaggagagcgatctggcagatttcgaactcagcttcccagcgggcaagaaagccgtccgggccgaacggtggcgtgtgactgggacacctcggcgaacgctgcgggtggcggacacn

SEQ ID NO: 92639 - protein, 96 aa, Zea mays
  misc_feature: Ceres CLONE 1581424
MPSKPAATSAPKCSRVESNSSTRRLVQASSRTSSPPSSRSPVEDRDNKGAADQLVSVEESDLADFELSFPAGKKAVRAERWRVTGTPRRTLRVADT

SEQ ID NO: 92640 - DNA, 900 bp, Zea mays
  misc_feature: Ceres CLONE 1581429
  misc_feature: Encodes the peptide sequence at SEQ ID NO. 92641
cggccgctctagaactagtggatcccccgggctgcaggaattcgtctcacccctagaaaaaaccgtcttccggccgtccaccgtttccagcacacagggtaaaggcaagcaaacgagcggcgggacggctagcccgcaatacaaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccatgggagaagctccttaaattgggctgacgctgcgaagctcaaggagaagattgagaagatgtttaaaggtgaaaagattaattagcacagaggacaggtcagtggcttcatgtagctcctgaggggctccaagagatgcagtcataaacagtgatgggggtggaatggtggcccctgaggtttgggaagggttaaagataaaatccaggcagttttcaaagactttttaaaagggggatatgggggttgggaagcaacgggaaaaacgggtggaaaaatggttggggccggtttgaaataaggggggtagcttttcttgggcccttcttttttggggcataacgggcacctcccagaaccggattcctgaaagccgcctgaaattgtgcaaaaaggggccggggacacggggagaattccctgtggaaaatggtggaatccacaggtttaacgtgttgccccaaaagcactttaaaaagatgttg

SEQ ID NO: 92641 - protein, 66 aa, Zea mays
  misc_feature: Ceres CLONE 1581429
  misc_feature: SWISSPROT Homolog: EC 5.3.1.9 Glucose-6-phosphate isomerase
MASAALICGTEQWKALQAHVGAIQKTHLRDLMADADRCKAMTAEYEGIFLDYSRQQATGETMGEAP

SEQ ID NO: 92642 - DNA, 1181 bp, Zea mays
  misc_feature: Ceres CLONE 1581431
  misc_feature (777)..(777): n is a, c, t, g, unknown, or other
  misc_feature (1181)..(1181): n is a, c, t, g, unknown, or other
ttttttttttgtttttttgcccgcggacacactaatcatgttctagtgtggggggaggttttaatcgagagagggggggcggaggcgggggggcgaggtgggtttttagactagtggatcccccgggcttcttgatgcgtctcacccctagaaaaagtgctcctcacaccggcctcggcgcctcgcaccacaaccacctcctaccccttctcttcttcttctccccccttgcgaatcggagaccaagtgcaattgcccacccaagccccggaaccggggggccaagagcagtacaaggggttggtttctgcgacggcggaggacgcgaagcgggattcggattgggccgccatgcccctcgaacaaactcaccaacaaaactggttatggtgaatgcgtgggttcccgcgggggggggggccttcgccctccgaagaaagccaacctcacggaccgtcggattccaaaggtggggaagccccccccccccttcaccaaaattcctcctccctaattactttccaagccattagaatcaattgggcgcaatcgcggttttttgttcccagaaagggtttataagtgggaggggtttgacggggtccccctatagccaaaaagggggaagaattggggatctttaatctcctaataatggggtaaggtttataaactagaaagagccccggaggaagagggcgagtgcgcacaacgtgaagtggtgtttgtgtgtggaccagaaagaacaacaccttattgacaatggagtcacaaacnctgaaaggtgcggagcaaatacccggggctcgggagaagggttttatcgccgggaggggctctcgacgtgaggagaaatacggggtgtgtgcagagagataaggctggggatttgaagaaagcgaatagttgagctctggaagaggcgggaatagtggtcgctttcttttccgcctcacggcgacgataaatttgactaccctgattaatgtggcggaaagacaccgaacagaagaggtttatacattgtattaatggtcacaacatcggagatctattgtcaggttctgtgtggaggtgggaaagattgagcgcagaagggtatggatagtataagattggtagtgctttctcgagaaataaggaggagtggttgttcaacggaccgccctcagcgaagcgan

SEQ ID NO: 92643 - DNA, 1142 bp, Zea mays
  misc_feature: Ceres CLONE 1581436
  misc_feature: Encodes the peptide sequence at SEQ ID NO. 92644
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (769)..(769): n is a, c, t, g, unknown, or other
  misc_feature (850)..(850): n is a, c, t, g, unknown, or other
ttttttttttttnnnnncnntgggcggtggcctataaaattacgcacgggacgggtgggcgagttattagatnnnnaaaatctggaactccccgcggtggcggccgctctagaactagtggatcccccgggctgcaggaattcgtctcacccctagaaaaactcgttgtcttggcggctgctgcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggaccgacgagaactaaccctgctgggttcatggatgtcattttccctcccttaagacaatgggagaacctccgggcttgctttatatacaacccagggggccgctttccgtccttcccccccaatccagggggaggtagggaaggccaaagtttccaagccttcttgccaaagggtgaaagggtcccgtttctctggttttggggccccaaaaaagagggaataattcccccccttgaacccttggatataacaaccccttaaagcgaataggtgtnggccgggccaatccccatatgctcgcggcctttatccccccgccgaaaaatcccggggctttccattttcatgggggggcnccaaattaggaaaaacaccacaattctcaaaaggaattcgcgaatcctctggggggaggaaccccaaggccgagtattcccctgggggaacccttcgccctccaagatgttttgaaatagcttcgtgtgcacataagcggggggtccattggttgtgcaacaccggcgggggggagagaaaaacacccgggggcgccgttctcggaaaaatgaatccaaaaaaacacggggagagaatctcccgggggggggggttttcgaaaatcaccccccagggccgaaggaaccccct

SEQ ID NO: 92644 - protein, 81 aa, Zea mays
  misc_feature: Ceres CLONE 1581436
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVRTDEN

SEQ ID NO: 92645 - DNA, 798 bp, Zea mays
  misc_feature: Ceres CLONE 1581444
  misc_feature: Encodes the peptide sequence at SEQ ID NO. 92646
  misc_feature (461)..(461): n is a, c, t, g, unknown, or other
  misc_feature (462)..(462): n is a, c, t, g, unknown, or other
  misc_feature (668)..(668): n is a, c, t, g, unknown, or other
  misc_feature (675)..(675): n is a, c, t, g, unknown, or other
  misc_feature (730)..(730): n is a, c, t, g, unknown, or other
ggagctccccgcggtggcggccgctctagaatagtggatcccccgggctgcaggaattcgtctcacccctagaaaaagatccacccatcgcttctcccgctcgtcctcctcctctcctcctggacagcagagcacagcacaacacaccgagaaagaacaagcagccgccaccggagctcagaaccaccatcagcagcagcagcacacccggtcaaccttccacacacgcgcgcacacaacacatggcgtcgcagcagaggcaacagcaggcggggagcggcggcggcggcgtcctccgccgtgggcttcgaggactacctgccggtgatggcggagcggctggggcgaagacgggctgatgcgggagctggcgagcgggttccggctgctgatggacccggcgcgcgggctcatcaccttcgacagcctccgccgcaacgcgccgctgctgggcctgggcnngcatgtcggacgccgaccctccgcgggatgctcgccgagggcgacttcgacggcgacggcgcgctcagcgagacggagttctgcgtcctcatggtggcgctcagccccgagctcatggacgagcccaggcggtggctcgacgacgccgtcgaccaggcggcccgcttcctcttcaccagctgatgatgacgacgacgatgattgantactaantaataggctactagatgatcgttgagagggttcttctcttcttcttccccctctnctggcgctgtcaatagctggatgatcaggactgtgctgatggtcgatgatccatccagtgtaccgtct

SEQ ID NO: 92646 - protein, 105 aa, Zea mays
  misc_feature: Ceres CLONE 1581444
  misc_feature (51)..(79): Pfam Name: efhand Pfam Description: EF hand
  misc_feature (45)..(45): Xaa is any aa, unknown, or other
MAERLGRRRADAGAGERVPAADGPGARAHHLRQPPPQRAAAGPGXACRTPTLRGMLAEGDFDGDGALSETEFCVLMVALSPELMDEPRRWLDDAVDQAARFLFTS

SEQ ID NO: 92647 - DNA, 1111 bp, Zea mays
  misc_feature: Ceres CLONE 1581445
  misc_feature: Encodes the peptide sequence at SEQ ID NO. 92648
  misc_feature (16)..(16): n is a, c, t, g, unknown, or other
  misc_feature (17)..(17): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (93)..(93): n is a, c, t, g, unknown, or other
  misc_feature (1111)..(1111): n is a, c, t, g, unknown, or other
ttttttatttttgggnngattacttcacgggattcttggggggtgatcttcttcggggnnnnngggcannnnnnnnaaaactggagctcaccncggtggcggccgctctagaactagtggatcccccgggctgcaggaattcgtctcacccctagaaaaagtccacccatcgcttctcccgctcgtcctcctcctctcctcctggacagcagagcacagcacatcacaccgagaaagaacaagcagccgccaccggagctcagaaccaccatcagcagcagcagcacacccggtcaaccttccacacacgcgcgcacacacacatggcgtcgcagcagagggaacaacaggcgggagcggcggcggctgcttcctccgccgtggggcttcgaggactacctggcccggtgatggcggaacggctgggcgaggacgggctgatgccggaagctgggcgaacgggtttcctgctgctgaatgacccggccccccgggttcttcacctttcgaaagaccctggcccgcaaccacaccccctggctgggccctggggcgggcatgttccgaaaccccaaacccccccccgggaaggttccccccaaagggcggaacttttgaacagggggaacgggggccgcttccataccaaaaaacggaggagttcttgccggccccaccccttgggggtgggggacccttccaagccccccggaaaatctctcatgtggaaacgaaaagccccccacgggcgggggggtggggatttctaaaaacaaaaaacgccccctttctaaaacacagagagggggggtcccccgcctttctcccctcttttttgcccaagattttgtttgtgatggtaaccgaaccccccccattgttttttggaaaaaaaccccataaaattttttagggggggaaacccaaaatggaaatcccttttgaaaaaagtgtttagccgcaatgggtatgatagtcttaccccccaccccttcttttgccccccgtggttcaaagtagagccgggcaggggttaccaggaaaatgtttttcttaatcggggcgcaaagggaatccccccccccgggggggtcctccgcgccgcccgttn

SEQ ID NO: 92648 - protein, 148 aa, Zea mays
  misc_feature: Ceres CLONE 1581445
MASQQREQQAGAAAAASSAVGLRGLPGPVMAERLGEDGLMPEAGRTGFLLLNDPAPRVLHLSKDPGPQPHPLAGPWGGHVPKPQTPPREGSPQRAELLNRGNGGRFHTKKRRSSCRPHPLGVGDPSKPPGKSLMWKRKAPHGRGGGDF

SEQ ID NO: 92649 - DNA, 797 bp, Zea mays
  misc_feature: Ceres CLONE 1581448
  misc_feature: Encodes the peptide sequence at SEQ ID NO. 92650
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (678)..(678): n is a, c, t, g, unknown, or other
  misc_feature (679)..(679): n is a, c, t, g, unknown, or other
  misc_feature (717)..(717): n is a, c, t, g, unknown, or other
ctccccgcggtggcggccgctctagaactagtggatcccccgggctgcaggaattcgtctcacccctagaaaaaattcctcatcaccaagccgaaccacagagctcccccacacccacagcggggtgaagcgaatcgcatcaaattcgaccgaagaatcgcgccgctcggcccggccaccatgagcttctcgtccatgagcaagcagcaggtgctggacgccggtgacggggaggggggaggaggtcatggagctcatcccgggcctgccggaggaggtggccgagaagtgcctcctccacctgcccttcctctaccaccgcctcttccgcaccgtctcctccacctgggaacgcttcctcacggacgccctgggcaagccactgctgttccctcgccttttgacccatgtcgcggcgcctccagtgccaggcgctcgacgtttctcgaggaagtgctcctgctcccgcagtgcccggcagcgcagcggcgggtcgttccctgtggggggggtcccccccgcggccagatctactgaatggggggcctcaggaggggggaacaagcccgtacaaacgtggcggggtacccgcccgcgaacgggtgggaagaagcgccgctattcgacgccccgtttaaattgcggccgggagtgggaaagnnnnnttgggggggattnntgttaatataatgttgtggggatagaaaaaaattggtnaaattttgaattagggttcagcgggaaaaaaaaggcttcggggtccaaatgggatggggctgggatctccggcacaacct

SEQ ID NO: 92650 - protein, 145 aa, Zea mays
  misc_feature: Ceres CLONE 1581448
  misc_feature (138)..(138): Xaa is any aa, unknown, or other
  misc_feature (139)..(139): Xaa is any aa, unknown, or other
  misc_feature (140)..(140): Xaa is any aa, unknown, or other
  misc_feature (144)..(144): Xaa is any aa, unknown, or other
MELIPGLPEEVAEKCLLHLPFLYHRLFRTVSSTWERFLTDALGKPLLFPRLLTHVAAPPVPGARRFSRKCSCSRSARQRSGGSFPVGGVPPAARSTEWGASGGGNKPVQTWRGTRPRTGGKKRRYSTPRLNCGREWEXXXGGDXC

SEQ ID NO: 92651 - DNA, 815 bp, Zea mays
  misc_feature: Ceres CLONE 1581456
  misc_feature: Encodes the peptide sequence at SEQ ID NO. 92652
  misc_feature (815)..(815): n is a, c, t, g, unknown, or other
ctccccgcggtggcggccgctctagaactagtggatcccccgggctgcaggaattcgtctcacccctagaaaaaaccagtcagtccacacagcctacggcctgctctggctctgcctgtagagggctagagctacaagctacaactctgaaagtctgaacagtgcgccgcccaaccagagatggcgccgcataccaccgcagccgccggcggcggcggcggcgaggaggcgctggaggaggccagcactctccggcaccgccacagcgctgccaaggacggcggcgaggagggccaggccaacaacggggtcgccgccgccgccgacgacgacggggaggggaacgcgctgtcggtggagcgcgcgttcgcggaccaggcggttccgtcgtggcgggagcagctgacggtgcgcgccttcgtggtcagcttcttcctgcccatcatgttcagcgtcatcgtgatgaagctcaacctcaccacggggatcatcccctcgctcaacgtctccgcggggctcctcggcttcttcttcgtacgcctctggaccgccgccatcgagagggttggcctcctcaggcagcccttcacgcgccaggaggacaccgtcatccagacctgcgtcgtcgcagcctacgacatcgccttcagcggggggtttgggacatacttgtttgggcatgagcgaaaacatcgccaagcaagccacagaagctgacaatccctcagaaagtcaaaaaccctcacatccgaagggagggataggggttcccctcccttggcagtttcattgggcctatttggcccttgggcccn

SEQ ID NO: 92652 - protein, 178 aa, Zea mays
  misc_feature: Ceres CLONE 1581456
MAPHTTAAAGGGGGEEALEEASTLRHRHSAAKDGGEEGQANNGVAAAADDDGEGNALSVERAFADQAVPSWREQLTVRAFVVSFFLPIMFSVIVMKLNLTTGIIPSLNVSAGLLGFFFVRLWTAAIERVGLLRQPFTRQEDTVIQTCVVAAYDIAFSGGFGTYLFGHERKHRQASHRS

SEQ ID NO: 92653 - DNA, 790 bp, Zea mays
  misc_feature: Ceres CLONE 1581457
  misc_feature: Encodes the peptide sequence at SEQ ID NO. 92654
ctggagctccccgcggtggcggccgctctagaactagtggatcccccgggctgcaggaattcgtctcacccctagaaaaaatctccatctccatctacctacgctctcgcgagtcgcgacgacatcctccgcggagcttgcgcgggtacggcacggagatggccgcggccgggccgacgacgtccccggccacggcgggcgccgtggaggagctcacgcggctgtaccgggagctgccgccgcgcccggccgtggaggaggtggaggccgcggcggcggtgctggcgtcggcggccgcggaggaggaggcgcgcctcgccgagatcgacagggaggaggcgctggcgcgcgggggcgcgccgcccgagctcctcgacgtgctgtgggaggcccggcgcagctccgtgcgcctccgcgcgctgcagcagcgcaaggaggccgcgcacgtcctcgagctcgagaggcggttcaggctcttcgacgacctcatccagcgggcgtcgcgtcttctgtcccccggcggtggtgccggggccaggagcggcacgggtggtgccgcggtggaccacgacgaggtcgtcgaggtcgacgccacccggaacacggagctggacgccgcgccagccgagattggtcgcgggagcaagggcggcttgggactggaacccaagtccgtctcgtcgctgcgtcgtgctgcttcggcaggtactgacacagaaaagctgggcctttatcaagtgggcagccttatagagtcatcggcaaagaaaaggactacagagctcaatct

SEQ ID NO: 92654 - protein, 210 aa, Zea mays
  misc_feature: Ceres CLONE 1581457
MAAAGPTTSPATAGAVEELTRLYRELPPRPAVEEVEAAAAVLASAAAEEEARLAEIDREEALARGGAPPELLDVLWEARRSSVRLRALQQRKEAAHVLELERRFRLFDDLIQRASRLLSPGGGAGARSGTGGAAVDHDEVVEVDATRNTELDAAPAEIGRGSKGGLGLEPKSVSSLRRAASAGTDTEKLGLYQVGSLIESSAKKRTTELN

SEQ ID NO: 92655 - DNA, 854 bp, Zea mays
  misc_feature: Ceres CLONE 1581458
  misc_feature: Translation starting site: 171
  misc_feature: SWISSPROT Homolog: EC 3.5.1.14 Aminoacylase
  misc_feature (412)..(412): n is a, c, t, g, unknown, or other
  misc_feature (846)..(846): n is a, c, t, g, unknown, or other
ctggagctccccgcggtggcggccgctctagaactagtggatcccccgggctgcaggaattcgtctcacccctagaaaaaatttttgccgccgctgccgctccagcaccagcctgctccggcgcagcacctcagcccaggcgcccatcgcttcgccagtctcatacggccatggaccgcggcggccacgcggcgctgctgctgctgctgctggcgctggcggtgatccccgtgacgggcgccgccggcgcggcgttcctggaggaggacgcgatcctgggcgccgtggagcgcgcgatgaatgcgcggcggcgcgaggaagggcgccgcgaccgcgaacgcgagcgggaggcaccagcaccggcgccagcgctacggcgtgggggcgccgtggagggaggagatcgcggggnctggcggggcggcccgagctggcggcgtggctgcgctcggtgcggcgccggatccacgagcgccccgagctggcgtacgaggaggtggagaccagccgcctggtccgcgacgagctgggcgcgctgggcgtcgggttccgccaccccgtcgcgcgcaccggggtcgtcgccacgctcgggaccggccgcccgcccgtcgtcgcgctccgggccgacatggacgcgctgcccatccaagatgccgggggagtgggagcacaagagcggggtccccgggaagatgcacgcgtgcgggcacgacgcgcatgtgggcatgctgctcggcgccgccagcattcttcaaggtcgcgagcacaactcaaggggacggtgaagcctctggttcagccggcggaaggagtcgggctgcggcccgaagcggatgatcaaggaanggcccctg

SEQ ID NO: 92656 - DNA, 1107 bp, Zea mays
  misc_feature: Ceres CLONE 1581463
  misc_feature (1)..(1): n is a, c, t, g, unknown, or other
  misc_feature (11)..(11): n is a, c, t, g, unknown, or other
  misc_feature (37)..(37): n is a, c, t, g, unknown, or other
  misc_feature (61)..(61): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
nttttttcttnccccttctcccttccctgcccgcccnagtaaaaagcggggggaaaaaggngggggggttnnnaccccgggggggtgacggggtggcgccgctctaaactagtggatcccccgggctgcaggattcgtctcacccctagaaaaactggtttgtttactgacaccttctgtttcctctcaccttccactcctggatctccagctccaggcaaggcccgaactggggaattccgatcccaagagcccccaccaagcgctcccgccgatcccaaggactcctgcctccgatgcgggaactcatcccatccggcttctaaaagacgcgggccccctgaaggtcaaatttcccgggggcgccggcggcatggaattttcgggccaacaacatctggcaaaaccgtggggggagaaagccggtcgatttggggttggccccccccccacccccaaaaaaaagggggggggcgaaaacccgtcaacaaaaggggtaccggggcccccaccggggggggagaccgtaatccccgtggcgaggccacaccacccccaaggggggatcccccgggagaaacccccccgggggcgagaaaaagcgggccgctttagcgcaacaacagcccgccgaagaagaacaaatgtgtgggggggaaggaccccccaaaaattcggtgggttaacctaggacctcggcgcggccccgcaagagaccccagcgggctctacaagactgaaacccatacgggagtgcgacgccaagagaaaaaggagggaaagaaagatagaacaaacgacgcatgaaatccttgagaagagaggacataatggtgatggatcacaggtacaaagaagtatgtcgcgcacaggatgcaaaggagatcataaaaatgaagtggtacggtccctccttcaacgcaatagacaggaccaccagcaacaatgagagcagtgccgctggacgtactcacacctacgactggcatgcattcaggcacaacgacgttcctgcgcagtcgcgaatgcaactacgtaccgcggtgataagtgagtatccgcggatgagtacagctaggagagggctgttggtcggctcgtcaaaaa

SEQ ID NO: 92657 - DNA, 811 bp, Zea mays
  misc_feature: Ceres CLONE 1581466
  misc_feature: Encodes the peptide sequence at SEQ ID NO. 92658
  misc_feature (703)..(703): n is a, c, t, g, unknown, or other
ctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcacctcgaggtggagtcttcagacaccatcgacaacgtcaagggcaagatccaggancaggagggcattccccagtacagcagcggctcatctttgctggaagcagcttgaggacgggcgcacgctggccgactacacatccagtaagagagcaccctccactgg

SEQ ID NO: 92658 - protein, 219 aa, Zea mays
  misc_feature: Ceres CLONE 1581466
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (184)..(184): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITSRWSLQTPSTTSRARSRXRRAFPSTAAAHLCWKQLEDGRTLADYTSSKRAPST

SEQ ID NO: 92659 - DNA, 1053 bp, Zea mays
  misc_feature: Ceres CLONE 1581477
  misc_feature (11)..(11): n is a, c, t, g, unknown, or other
  misc_feature (14)..(14): n is a, c, t, g, unknown, or other
  misc_feature (56)..(56): n is a, c, t, g, unknown, or other
  misc_feature (57)..(57): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
ggttgtgggtnctnccccccctctccatcgcatcgcggcaaagggcacgcgaaaannttgnnnnnnntttatggttnnntaaagctggagctcacctcggtggcggccgctctagaactagtggatcccccgggctgctggaattcgtctcacccctagaaaaaaaatggtacagttatggcatatggccagactggtactgggaaaacttttacactgggaagacttggtgaagaagacactgctgctaggggaatcatggttcgtgcaatggaggatattctagcagacataacacctgggactgattctgtctcagtatcatatcttcagttgtacatggagatgatacaagatctccttgatcctgtaaatgataatatagccattgtagaagacccaaggactggggatgtttcattgcctggagccacagtagttgaagttagagatcaaaaaagctttgtggatcttctaagggtgggtgaggctcatccgggttgctgcaaattacaaaagtttaaacacagagtcaatctcgaaaggcatggccaatccccctgggtgaaatggccagggagggtcctcgttaaaaagggtagaaccgggaaattggggatggtgccaccctttttccgggggggaaaaaaagggggctcctccatccaaccccttgggggtagagggtctcttttggaaaaacccccccctttttgtgtgtttgtgggaaaaaagttaaagccctcttgttaaatttggtcccaaatttttgggccggggggatcccaaaaaggcgccccttaaaaccaaaatttccaaggaaaaattgaaagggggtccaactcccccttttggaaaagaaagggccaaaagcccccaccccaaaattttgggcccctcttataaaggggcccctcgggggaaaaaaaatggccccccaatgggccccttgggtggaaaaaaaaaagaacccctccctttgtttgccctgtgttctccggaatttcttcttaaaccttccaaaaaaaatggggcgtcaaaaaaatatcctct

SEQ ID NO: 92660 - DNA, 1260 bp, Zea mays
  misc_feature: Ceres CLONE 1581478
  misc_feature (77)..(77): n is a, c, t, g, unknown, or other
tttttttttttttctttttcccttctggcgttggaaataagattgttaatgagtgttttattttcttttggtttttnttgggagtcccgagggtggcggccgctctagaatagtggatcccccgggctgcttgaattcgtctcacccctagaaaaaattgtttctggtggggctgataactcattgatggtctgggatttgacggctggaaaactcatgcatgatttttgtcttcatgaaggtccagtcaactgcttagatgttcacccctatgagtttttattggctacaggttcagttgataagactgttaaattttgggaccttgaaacttttgagttgatcggttcttctggacccgagaacaaccgagaatactttgagctggctagtgcaatccgttctatgaagttcaacagtgatggtaaaacaattttttgtggattgcatgaaagcttaaaggctctttcctgggaacccaccatatgtcatgatgtgattgatgtaggctggtcctacatccacagatctaactgtttgaccgaaagggaaactttcttgggctgcctcatatataacccaaaatttgatgtccaggagttgtggggtttgtcggaaatttgaatgaaaggaaattgacaccccttgatggttctgattaagtccagtgggcctggggaatccaacccacctcgaaaaattgggaaaaaggttagttaaaattaataggggcgccaaatttttcctaatattccgactgatctgtggaatcttgtgcgcccctttgggttcccaacattccccacagtgcgagatgttgttttctggaggggcgacgagaaggaggctcttaaatctcgtcataacgttttttttctccactcagaaaaataggtcacctcccataggactctcaataaagttgtgaaacaaatagtctgggaggaaatctcaggagtgcaatatatctctcactcggcacacacgaagagaaaaagtgggcctcctctaaatgagctcctctcgccggtttcccacaaacaaagaagagtaaagtgctccccgtgggtcaactccaaaaccatatctccttgcccaatctcacattgtcgcagcgagggtgaatgtggccttctaaaagaccgcaccccctggagaaaaagatgggggggaaacacttcacgcgggttcctcacagaaaatctttagtttttcctacaaccccttcatgtcatttttctcccccagaaagttagaaac

SEQ ID NO: 92661 - DNA, 1331 bp, Zea mays
  misc_feature: Ceres CLONE 1581481
  misc_feature: Encodes the peptide sequence at SEQ ID NO. 92662
  misc_feature (1)..(1): n is a, c, t, g, unknown, or other
  misc_feature (47)..(47): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (82)..(82): n is a, c, t, g, unknown, or other
  misc_feature (754)..(754): n is a, c, t, g, unknown, or other
  misc_feature (757)..(757): n is a, c, t, g, unknown, or other
  misc_feature (800)..(800): n is a, c, t, g, unknown, or other
  misc_feature (819)..(819): n is a, c, t, g, unknown, or other
  misc_feature (850)..(850): n is a, c, t, g, unknown, or other
  misc_feature (856)..(856): n is a, c, t, g, unknown, or other
  misc_feature (1074)..(1074): n is a, c, t, g, unknown, or other
  misc_feature (1080)..(1080): n is a, c, t, g, unknown, or other
nttttttttttttttttgttctcttttctcccccgccaactaatccntaaaattnnttnnnnnggggggnnnnnnnnaaaantggagctccccgcggtggcggccgctctagaatagtggatcccccgggctgcaggaattcgtctcacccctagaaaaaaagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccccgtgctctacctgggcccgctgtccggcgcgcccccaagctacctgatggtccacctcccgggcgaccgacgggggggggaccgggggggtggtcggcggacccgggagacgggtcgcgcagaaacccgggaacttggaggttcagccaactcccccacgagggggcaatgactaggggaaactttggggtttgcagcactcccgagggagcggcctccacccagggcaaacagggaagccaaagggtgcgggccaaaagggccgccgtgaggggagtcccacggaggcccaggcgataacgaacgaaatacgtctgcatggttagaagggggtgggccggacataggagacactgcacacccccgtcgntgngctgtggccactggcacagcacatgtgtatggatcactcgaangaggcatagaggtaaaatnaaagggggggagagcacggagcctgcaatancctttncttatatatcctgatgccagaggaaaagacatctgtaagtgaacgaagcgacgacgggcagtggtgtgtgaggcgtctgacggagcgacggaacgcggggcgtgtgtattgcgtgcgaagccgagaggttgagtaatgggaggcgcgaggacgagaacggtgaagaagagggggggcgcgagccggcagagcgcgcgtcggcgagtaactagagaggnagagtnaaagtgtgcacgaacgcacgagggttcttctaagtccgcacaccatattgcgggctaagggccgacaaggttcagagataagttgttaacgttgccgcggcgtggagcgacgggagggatgtggtgtggggaagggaggggggcacttcatagactcggacggcaaacacaaactcgatagacgggacgaccacccttgcgatgagataccatgagcgtagtgttgtgcgtggtggagtgcatgtaggcgg

SEQ ID NO: 92662 - protein, 110 aa, Zea mays
  misc_feature: Ceres CLONE 1581481
MASSTMALSSTAFAGKAVNVPSSLFGEARVTMRKTAAKAKPAASSGSPWYGPDPVLYLGPLSGAPPSYLMVHLPGDRRGGDRGGGRRTRETGRAETRELGGSANSPTRGQ

SEQ ID NO: 92663 - DNA, 835 bp, Zea mays
  misc_feature: Ceres CLONE 1581482
  misc_feature: Translation starting site: 230
  misc_feature: SWISSPROT Homolog: EC 2.3.3.1 Citrate (Si)-synthase
  misc_feature (376)..(376): n is a, c, t, g, unknown, or other
  misc_feature (377)..(377): n is a, c, t, g, unknown, or other
ctggagctccccgcggtggcggccgctctagaactagtggatcccccgggctgcaggaattcgtctcacccctagaaaaaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccnngaacacaggatcgctttaagaagctcaagtcagagcatggaaagacccagcttggaaacaatactgtggatatggtcccttggtggaatgaggaggatgactgggatgctttggggaacatccctacttgatccaggagaggggattcgttttaggggccctctcaattcccgatgcccaaaaaggctgcccaacgcaggtaaggggcggggaaccttttgccggaggggcccccttgggcttcctttgaacggggaaaggccccaaccaaaaagcaggttgaggccctttcaaaaggaattggttggcgcgccaaatggttccaccccattggtttaaaaaaaaaaaggccctcccccagggaagccccctccatagaaaatttttacccagagaaaaaggggccccttggcggggagagggattttcaaaagggtttataaaatgggtggcccaac

SEQ ID NO: 92664 - DNA, 734 bp, Zea mays
  misc_feature: Ceres CLONE 1581483
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (389)..(389): n is a, c, t, g, unknown, or other
  misc_feature (415)..(415): n is a, c, t, g, unknown, or other
  misc_feature (416)..(416): n is a, c, t, g, unknown, or other
  misc_feature (448)..(448): n is a, c, t, g, unknown, or other
  misc_feature (451)..(451): n is a, c, t, g, unknown, or other
  misc_feature (452)..(452): n is a, c, t, g, unknown, or other
  misc_feature (456)..(456): n is a, c, t, g, unknown, or other
  misc_feature (489)..(489): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (532)..(532): n is a, c, t, g, unknown, or other
  misc_feature (533)..(533): n is a, c, t, g, unknown, or other
  misc_feature (593)..(593): n is a, c, t, g, unknown, or other
  misc_feature (601)..(601): n is a, c, t, g, unknown, or other
  misc_feature (602)..(602): n is a, c, t, g, unknown, or other
  misc_feature (609)..(609): n is a, c, t, g, unknown, or other
  misc_feature (648)..(648): n is a, c, t, g, unknown, or other
  misc_feature (649)..(649): n is a, c, t, g, unknown, or other
  misc_feature (669)..(669): n is a, c, t, g, unknown, or other
  misc_feature (670)..(670): n is a, c, t, g, unknown, or other
  misc_feature (673)..(673): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (702)..(702): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
ctccccgcggtggcggccgctctagaactagtggatcccccgggctgcaggaattcgtctcacccctagaaaaaacctcacctcactcaaaccgagcgccagttgccagcacgaagagtaggagtaggaatcgaagagtgagtgaaactgaaagacgaggaggagccatggcgaccccggatgaccgcggcagctggttgctgtacctgtccctagcccgccaaattgcgcccgggcgaagcagcccttacccgcccctccggggggtttttcttgggggctttttgtcccccggggggccctctccccggggaaaaaaacacccccctcccccccccggggggggggggtccccccccccccggaagaggagccccccccccnnnccnaagggaagaaaaaaagggtgtttttnngaaaaaaaacccaccccccccccccccccccnccnntttnttttccccccccgcgcggcccgccggggggggnggggggggggggggggggcccgcccccacccccaaannngggnntgggggggggtttggggggggggggggggggcccccccccccccccgctggggggggggntgggggtnnggggagnagggaaaaaccggggggggggggagggggcgcccccccnnggggtgcggtgggggtgatnnaanattaatattttatactnnnnnannnnagntggttttgnnngtggttttttgttttttgttt

SEQ ID NO: 92665 - DNA, 1194 bp, Zea mays
  misc_feature: Ceres CLONE 1581485
  misc_feature (12)..(12): n is a, c, t, g, unknown, or other
  misc_feature (13)..(13): n is a, c, t, g, unknown, or other
  misc_feature (20)..(20): n is a, c, t, g, unknown, or other
  misc_feature (56)..(56): n is a, c, t, g, unknown, or other
  misc_feature (61)..(61): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (1093)..(1093): n is a, c, t, g, unknown, or other
tttttttttttnnggggggncgaccagtattcttaattacttcaaaacaggataanataanatataattntnntttatttggactccccgcggtggcggccgctttccactagtggatcccccgggctgcatgattcgtctcacccctagaaaaagtggtctcccaattccatctcgttctgaagtgattccacaccacacgtgggctagccatgatggcctgcgacatacgccatctcctggcatgcagcgcctctcacgccatgcgggaagatgaacctctcccgctgccatcacccatggctgcagtcccccaaaccttcctgctgcagaaaggcgtcactgctgctgctccgccggcgctcccggaacacggtgctcgtagccggtgttgccctcagctgttacacagcctctcataagcaatcaccgagaatgctagggcacggagaaaaggtttctaccacgcagacgatacaacccgaacaccccatcagacacatttcttccccgatgggatcctgggatcggatgatcgcccttcgtcctccaagggtagggaaccttgaagaaaaaagacccaccgggcttgggctccattaaactggagcccaggggaaacagacctatgccccccaagaacccttttgccccgggtcttttgggtaagtcgggtcaaaaaataaggcccccctctctccgtatacacctcgccatcctaggggtttccaatggaatgggcgcttgggccttccccaaagaagtccctctgccacaaacacacacgcgcgcggtgggtttttttccccgcctttgaataaagttgtgtgtttttatccacctttgtttttcccacagagcctggagaaaacactaccgactttgttgcccgcccccccccctccaaaaaatttggcgaataatagcgtcaaatagagcaccgcgctcatatataaatacccccacttgggaaagaaaggccccttttttccaataaaaaataaaaatctagggcctcttttgtgtgagggcgccctgcactctaaatattggggggggaataacaaaatagggtggaataagcgtttgtttnagtcaacaacaaaaagcctaaccacgtgggcagtttttcttcctgcccccataaaagaggagggggttcattttcttcacgaggaattgtactcccccgga

SEQ ID NO: 92666 - DNA, 1130 bp, Zea mays
  misc_feature: Ceres CLONE 1581488
  misc_feature: Encodes the peptide sequence at SEQ ID NO. 92667
  misc_feature (53)..(53): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (676)..(676): n is a, c, t, g, unknown, or other
  misc_feature (765)..(765): n is a, c, t, g, unknown, or other
  misc_feature (885)..(885): n is a, c, t, g, unknown, or other
  misc_feature (927)..(927): n is a, c, t, g, unknown, or other
  misc_feature (1112)..(1112): n is a, c, t, g, unknown, or other
aaaatatataaaaaaaaataaaaaaaaaaaacgaaagaaagaaaaaagaaagnagaagaggcgnnncgggcgtggggtgggctggggctccccgcggtggcggccgctctagaactagtggatcccccgggctgcaggaattcgtctcacccctagaaaaaccgaaccaaacaacacacgtcaaagcggaaaacctcggaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggtgtccaaccaaacgggtggatgcccggcgtcggcgccggggtgcccgatggcgtccacgccgagcgcacccgcggcgactctgtcggcgggggaagcgtccctgggagcgccaccttgtgggggcgcccccacacaagggcggacgtcaaacgatggaggtcaaaggatcgggggggacttacaacgctcgaccctggcgggaagccctatggaaaagcgcgaccccggggcagggagccttcggtgggggggggccagaaaaaaaagggttctaccctccgcggggctaacctccgccacaaaagggagtaaaatcccacggaancgggggccaagctgtattccggggaccccctgggcaccccccgacgacaaacaaatatcctaactatgtacagagaggggggcgcgcgncgagcggaataggggcgttatcaaaaggcacgtagttcatgaaggggggcgggccgcttcatggaggttggatgagaataaccttatgactcgccctcacaatgcctgtaggcaaagttngcgcgtgggaggagaggccacatcaaagtgtcgcacaagggngtgccggggggtgggacagccagataccagttatgtgactgtcgtaagccaggcaacactaatctaggggccctcctcccgaatagtgatcaatggaaaggatggaatactccgaacagaccttctgacaaagacagctcacacactgccgcataatcagggcagggtaggagtaagaatagagnctccgggggtaaagccag

SEQ ID NO: 92667 - protein, 140 aa, Zea mays
  misc_feature: Ceres CLONE 1581488
  misc_feature: SWISSPROT Homolog: EC 4.1.1.1 Pyruvate decarboxylase
  misc_feature (120)..(120): Xaa is any aa, unknown, or other
MDTHIGSVNGAVSNQTGGCPASAPGCPMASTPSAPAATLSAGEASLGAPPCGGAPTQGRTSNDGGQRIGGDLQRSTLAGSPMEKRDPGAGSLRWGGARKKRVLPSAGLTSATKGSKIPRXRGPSCIPGTPWAPPDDKQIS

SEQ ID NO: 92668 - DNA, 806 bp, Zea mays
  misc_feature: Ceres CLONE 1581505
  misc_feature: Encodes the peptide sequence at SEQ ID NO. 92669
ctggagctccccgcggtggcggccgctctagaactagtggatcccccgggctgcaggaattcgtctcaccacgaagagcgccgccaccagcgccagcgcgacgaagcacgccctcgccgctgccatggactcgctggcactccctagtccctctagccgagcaaccgaaacggcggcgcgcgggacggcgggtaaactaaaaaaaaaaggagggcgagggcagctgacgctcaggcagcggcgccggcagctgctgcggcagcggcaggtgcgcagccacctcaagaggctcaacaaggcgccgctcgccaccatcgagagtccagacggagacatcatagactgcgtgcatatctccaaccagcccgccttggatcaccccttcctcaagaaccacaccgtccagatgcggcctgcataccacccggaaggtctgtacgacgacgagtccaaggttgcatcgcagcggaacgcgcagacgatcacccagatgtggcatcagaacggcaggtgccccgagggcacgataccgatcaggcggaccaaggaggaggacgtgctgagggccagctccgtcaggaggtatggcaagaagaagcgcaggagtgcccccaaccccatgtcggttgaccctgacatgctcaacgagagcggccaccagcacgccatagcgtacgtggaaggagacaagtactacggcgccaaggctaccatcaatgtgtgggcagcgaagatcgagcaggccaatgagttcagcttgtcccagctctggatcctggggggctctttcggccagaacctcaact

SEQ ID NO: 92669 - protein, 227 aa, Zea mays
  misc_feature: Ceres CLONE 1581505
MDSLALPSPSSRATETAARGTAGKLKKKGGRGQLTLRQRRRQLLRQRQVRSHLKRLNKAPLATIESPDGDIIDCVHISNQPALDHPFLKNHTVQMRPAYHPEGLYDDESKVASQRNAQTITQMWHQNGRCPEGTIPIRRTKEEDVLRASSVRRYGKKKRRSAPNPMSVDPDMLNESGHQHAIAYVEGDKYYGAKATINVWAAKIEQANEFSLSQLWILGGSFGQNLN

SEQ ID NO: 92670 - DNA, 817 bp, Zea mays
  misc_feature: Ceres CLONE 1581506
  misc_feature: Encodes the peptide sequence at SEQ ID NO. 92671
  misc_feature (621)..(621): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaagttccgcttcgtcccagcctctagttcttcctttcctccagagtgatggccaaatgctactcagattggccaccgattccgcctttccatccatcgcgaagaacgccgccgcaatcccacgcctccccgatcacgatcaggcggcagctcgtgtccttcgtgctccagtgctccagatcctgcgctcccctcctcgagcccaagaacctgcccgatgagttcgaggccgtgccggcgacgacgacgccgccgctgccggacgccgccccgaagctggggatttctaacaagttcatccgaggcctctgcggcgacccgcagaccgagcagctggccttcgagggctacaggagggcgctgctgcagcccgagttccggctggagaagagacggcccacgcgctgaccctgcagctgatcagggagaagcagtggggctcgctggagctgctggtcgaggacttcagggccccacgcgtgctcccggagaaacggacgtgcgcgcggctcgtcgcctgctgcatcaggggcgggccggttcggactcnccgacgcggntgctcggggtcgtcaaggcgaaaagggagcccccgctggcatggccttcagcggggccatgcaggggtacaacaggctgcacatgtacgggagaaacggggctcctgtacgggcaaggcaaagggtggccccccctgcgcttgaaccccgaacccctaccgtgcccccaatggccggcttgcgggg

SEQ ID NO: 92671 - protein, 119 aa, Zea mays
  misc_feature: Ceres CLONE 1581506
MAKCYSDWPPIPPFHPSRRTPPQSHASPITIRRQLVSFVLQCSRSCAPLLEPKNLPDEFEAVPATTTPPLPDAAPKLGISNKFIRGLCGDPQTEQLAFEGYRRALLQPEFRLEKRRPTR

SEQ ID NO: 92672 - DNA, 811 bp, Zea mays
  misc_feature: Ceres CLONE 1581508
  misc_feature: Translation starting site: 545
  misc_feature (301)..(301): n is a, c, t, g, unknown, or other
  misc_feature (676)..(676): n is a, c, t, g, unknown, or other
  misc_feature (796)..(796): n is a, c, t, g, unknown, or other
ctccccgcggtggcggccgctctagaactagtggatcccccgggctgcaggaattcgtctcacccctagaaaaactccctccttctccatctccgctttccctcctcgcctaggcctagccgcccccgcacgccacgccacgccacattcgcatctctggatccccctcccctcgccctctcccattacccgccgccgccgccgcctcgcgcccgcgacccacccggcctcccacttcgatcccgccccgattccgattcgtcactgtatcgcgcgcgcgggtgggaagacagcgatggcntcgtggcgggggcctctcgccccgccgcgggtgatctctcctctagcggggagccttcccgcgtgcccaagcggaggatcccgtcgcagctggtgcctcacctatccctctccttcgcatctccgccgtgctctctcgcgcaccccctcgaccctaggtttgctctttccctcccttcctcgccacccgattcgatctcgctccctccggcctccggctaggctgctccgtctctcctccgccatgttctcgcacggcgctgattccgcccacgacgccggggccgtcggcgtcagcagcggcggggctaccgtccccacccgcttcgtctggccctatggtgagaaagaggggtctcgtctcaagctccttcancaggtggtcggaacatttgccgatgtctcctatcgaaaggctgccccactgtattcaggctatttgcagtctgtctcctgggattcacgagtacaaattctttgtggacggggaatggcngcatgatgagcgtca

SEQ ID NO: 92673 - DNA, 1202 bp, Zea mays
  misc_feature: Ceres CLONE 1581514
  misc_feature: Encodes the peptide sequence at SEQ ID NO. 92674
  misc_feature (8)..(8): n is a, c, t, g, unknown, or other
  misc_feature (9)..(9): n is a, c, t, g, unknown, or other
  misc_feature (15)..(15): n is a, c, t, g, unknown, or other
  misc_feature (68)..(68): n is a, c, t, g, unknown, or other
  misc_feature (69)..(69): n is a, c, t, g, unknown, or other
  misc_feature (73)..(73): n is a, c, t, g, unknown, or other
  misc_feature (76)..(76): n is a, c, t, g, unknown, or other
  misc_feature (935)..(935): n is a, c, t, g, unknown, or other
  misc_feature (952)..(952): n is a, c, t, g, unknown, or other
gggggggnngccttntgcggggcgtgccaccaacaaccaccctgaaaaaagaaaaaagaaagggattnntttnttnttaaatctggagctccccgcggtggcggccgctctaaactagtggatcccccgggctgtttgaattcgtctcacccctagaaaaaaagcgggactagtccctgtcgtctgtctctccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaaggacaacctcatcaacaacccggtgtccgacgccaacatcccaggagccggccgctgttcacgggcatccccacagctggggaagacacccccggaagcaaaaacgtggcgggctgaaccaaagccccgtacccctgtccaggccggcgggaaacccgggttcccagggaaagggcccgttgggggtcttgtcccttcccccgggccgcccgggtcttgaggaaaggccccagcaggcctttggggcctcgcccactaaaacctccttccgggacggggggcacattcccagggaggccggccctgggaggaaaacccgattttctccccggaccgaaaacacttttttctcctccccggaaaaaggccccgcgtatatccacggggtttccccccccgggccccaaagagcgctgtaaaaccccccccgtgtgttccccccaagggatatggggcaccgggccccaaaagnagttttcccctcctctncagggccagcggttgtgaaaagaggaataaaaagccttccgctggggcccccctagggccggtgtggaggcccaataaaggggggccccttgtcttttacattacaagcctgtccaaaaacccccgaataaaaaacgttcttttaaagggcatggctcctaagaggaaattccgacccccctctaggggtccccacaataaaggggggctccccctttttcccctctctttgaaacaggggttccttgtg

SEQ ID NO: 92674 - protein, 136 aa, Zea mays
  misc_feature: Ceres CLONE 1581514
MGLFSSPAKVYKPAADVDLGPGSDELYISPNVKAPRVAGLLVKIFVWILEMPIVGQIVLYILKKDNLINNPVSDANIPGAGRCSRASPQLGKTPPEAKTWRAEPKPRTPVQAGGKPGFPGKGPVGGLVPSPGPPGS

SEQ ID NO: 92675 - DNA, 1161 bp, Zea mays
  misc_feature: Ceres CLONE 1581517
  misc_feature: Encodes the peptide sequence at SEQ ID NO. 92676
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
ttttttttncnnnttntctgggtcgcgcggccccggggcccggcgcgggggggaggggnnnnaatgagaatggnnnagagggggctccccgcggtggcggccgctctagaatagtggatcccccgggctgcaggaattcgtctcacccctagaaaaaaccgcacacggctccgctgcttcgcgactcctctccggctctccgcacaggactccaaccgcctcgccgttgcatcgccgcgggcgtcaacctaggctgctgccggtaccggtgcgtccccagccatggctcggccgccgcaggaggcgatcgacaccttcgtcagcatcaccggcgccgacgaggtcaccgcagtccgcgtgctcgaggaacatggtcatgatctaaatgaagctgtgaatgcttattttaatgaaggagataggaccaccaccagaatcaatcagaatcctgtgcctgccactgccagttatgatgacatgatggagctggatgaaccacttgatcccatgttcaacagacccttttgttccctagaactttgggcaacccctttttgcccttttgggatccagggttttggctgaccataagctgcctgggtggattataattttggaacggtgagaaccccccaagttttaccaccaaccccgtagggggaccggtgaagggccagaaattaacccctaatttgggaaatcgtgttaaaggggacccgggcccagacttaccgttccaaaaaacacaggggccccacggtctttctccagaggaggcacccaggggggaggtccgcccccacaatttacatttttggtggaggggaaaaagcgtgattataacccggggggaaaccccgttggagaaaagtccctcttttccctaatagggcggccaccaacagaaaaggggcccccgagtgtggggggaaacccgggttgtggttatagtctcgctgcccgcaccactgaattgggagtggagaaagaaaccgttggcgccctattataaagacccttgtttccttgcgcatgcagaggacaccccctaaacgatccccccacacgaaaagagccctttttagaaccgcccaaaacccagtttatcataggccgctaaggggcggcagtccccaacggggtttaatatgccacccggac

SEQ ID NO: 92676 - protein, 100 aa, Zea mays
  misc_feature: Ceres CLONE 1581517
MARPPQEAIDTFVSITGADEVTAVRVLEEHGHDLNEAVNAYFNEGDRTTTRINQNPVPATASYDDMMELDEPLDPMFNRPFCSLELWATPFCPFGIQGFG

SEQ ID NO: 92677 - DNA, 831 bp, Zea mays
  misc_feature: Ceres CLONE 1581524
  misc_feature: Encodes the peptide sequence at SEQ ID NO. 92678
  misc_feature (388)..(388): n is a, c, t, g, unknown, or other
  misc_feature (610)..(610): n is a, c, t, g, unknown, or other
ctccccgcggtggcggccgctctagaactagtggatcccccgggctgcaggaattcgtctcacccctagaaaagccacgaagccgagatcgagcagctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtggtgagcgggcagctggagagcatcctgggcgacgcgtccgtgccgtgggggacncggatgggcgtcggcgtccgcgggtggagatgcggctgctggtgcgcctggccgcggcccgccgtgctcgtgtacatgatcaactacctcatgtccatgtccacgcagatcttctcgggccacctcggcacgctcgagctcgccgccgcctcgctcggcaacaccggcatccaggtcttcgcctacggcctcatgctgggcatggggagcgcggtggaaacnctgtgcgggcaggcgtacggggcgcacaagtacgacatgctgggcatctacctgcagcgctccaccgtcctgctgatgggcacgggtgtgccgctgggcgcgctgtacgctttctcccgccccgtctgctcctggtgggggagtcccccgagatcgcgtcggccgccgcccgtcttcgtgtacggcctggtcccgcaaatcttcgctacgccgccacttcc

SEQ ID NO: 92678 - protein, 193 aa, Zea mays
  misc_feature: Ceres CLONE 1581524
  misc_feature (66)..(193): Pfam Name: MatE Pfam Description: MatE
MGSAGGGGESKLESPLLGASSTGHGEAVVSGQLESILGDASVPWGTRMGVGVRGWRCGCWCAWPRPAVLVYMINYLMSMSTQIFSGHLGTLELAAASLGNTGIQVFAYGLMLGMGSAVETLCGQAYGAHKYDMLGIYLQRSTVLLMGTGVPLGALYAFSRPVCSWWGSPPRSRRPPPVFVYGLVPQIFATPPL

SEQ ID NO: 92679 - DNA, 924 bp, Zea mays
  misc_feature: Ceres CLONE 1581525
  misc_feature: Encodes the peptide sequence at SEQ ID NO. 92680
  misc_feature (336)..(336): n is a, c, t, g, unknown, or other
  misc_feature (345)..(345): n is a, c, t, g, unknown, or other
  misc_feature (390)..(390): n is a, c, t, g, unknown, or other
acccgcggtggcggccgctctagaactagtggatcccccgggctgcaggaattcgtctcacccctagaaaaaaccgtccgtcgtacagtccacccacgcgggcgaaatgtgaaaggcatcgtctccatctcatgactcgtgatcactggactgccgccgcccgccgccctcagcttagatcaatgattgggagcaccaagccgctcgcggagccgctgcacccgccgtacccctccggtcgccgcctcgtccccccgtcctgcgcccctgattcctccacagctctacaccccgccgtcgagaggccaggtcagtctcagtctgaaggcggcccgncgccaacanctcccagatgaggtgggctcagtccctcgcgctgcgcgctagccngcatagtcatcgcgtggtcccgcctcgcaggcggctgctggtcgaacctgcgggcctggggttggaaaagcgggctcttcctcgtactccggggggggtcggtggaccaagaaaaatcccggcccgaggaactctgccagtgggccggtggtagaatggccaagtaccaagaacttgtggcggtaaagacgggactccccccggggggggaaaggccctcttccataggatccgaaacggggaccaggctgggaacccgggaagaacttcgggtgaacccccccggctccggaaaagttttggaagaactggctttcgtacaaaccccaggcttgcgctgttaaattacccaccgttgtttccccccggattggaataaaatgggatccgacccttcctggaggggaattaaacccagcccgggaaagggaagggggccacttgggttctttattaccccctgggcctgattccctttaaatgggctggagtcccacctaaaaaagggcccggcgaatattccggggggggggc

SEQ ID NO: 92680 - protein, 74 aa, Zea mays
  misc_feature: Ceres CLONE 1581525
  misc_feature (69)..(69): Xaa is any aa, unknown, or other
  misc_feature (72)..(72): Xaa is any aa, unknown, or other
MTRDHWTAAARRPQLRSMIGSTKPLAEPLHPPYPSGRRLVPPSCAPDSSTALHPAVERPGQSQSEGGPXPTXPR

SEQ ID NO: 92681 - DNA, 1158 bp, Zea mays
  misc_feature: Ceres CLONE 1581528
ggtgggggggttttttttcaaaggagatattataaggggggaggggacaggataaaaggtcttcttcttcgtttaaggcgggactccccgcggtggcggccgctctagaatagtggatcccccgggctgcttgaattcgtctcacccctagaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaaacagcagcagcgcaacgagcgctgctgctcgcgatcccccttctccctgctgctcctggccgctcctgctcccgctacctcgcggcgttcggggtcgggggtccgccatccggcgaccaaaaaacgaacggaaccggccggcgggggggggcccaaccgaaccccgaaaaaaagtccttgaagccttggttgtccatcagaccgccccatgtaaagcttcccccatttttaccgggggaaacctggccacccctaagagggggggaaaaattccccccttaacgtgtgttccccctcccgcccgggggctttgtggacaaccaagagggaaaaaggtggccccggaaaaacccgggtgaagaggagggatatttcccggtgccttatcggagagacgcctcctgtttgctccaaaaaaccagaggggagggggggggcatccccgaattgcctcccagaccacccaccgtattgccccctcaaaaagaaaccaaggtcttccctccccgaccctctatgagcaaaaacaccccacctcgtttttccttccactctccaggagcaccgcgaacggcttacccaccggttggtgttgccgggaaactcccataacatatttgttttagggcggtcgcccacaccccgaactgccgtgggtggtatacaggagccctctaaaaaaggaggaaaccaaacttggtaccacaaaaaggggaggcggaaaagaaccgggggaacaacaggcgggaccaccatgtgcactaaactgcacacccggaggggtgg

SEQ ID NO: 92682 - DNA, 801 bp, Zea mays
  misc_feature: Ceres CLONE 1581529
  misc_feature: Encodes the peptide sequence at SEQ ID NO. 92683
acccgcggtggcggccgctctagaactagtggatcccccgggctgcaggaattcgtctcacccctagaaaaaaagcctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctcggcgccatctcgttgcccaccgtcggcatggtcgtcccctacggcgccttcttcgtccctgccggctccgggaacgccggcggcgggacctacgcgaaggacaagctgggcaacgacatcacggtggaggcgtggctcaacacgcacggtcccaacgaccgcacgctcgcgcaggggctcaagggtgaccccacgtacctggtggtggagcaggacaagacgctggccacctacgggatcaacgccgtgtgcactcacctcggctgcgtcgtgccgtggaacggcgccgagaacaagttcatctgcccatgccacggatcccagtacaacaaccagggcaaggtggtccgtgggacggcgccctctgtcgctgggccctggttcacgcccgacgtcgaacgacagcaaaggtcctctttcgtcccggggggtgggagacccgactt

SEQ ID NO: 92683 - protein, 218 aa, Zea mays
  misc_feature: Ceres CLONE 1581529
  misc_feature (54)..(92): Pfam Name: CytB6-F_Fe-S Pfam Description: Cytochrome B6-F complex Fe-S subunit
  misc_feature (110)..(203): Pfam Name: Rieske Pfam Description: Rieske [2Fe-2S] domain
  misc_feature: SWISSPROT Homolog: EC 1.10.99.1 Plastoquinol--plastocyanin reductase
MATSAALSTAANPTQLCRSRASLGKPVKGLGLSMGRERAQRSIVCQAASSISADRVPDMEKRKLMNLLLLGAISLPTVGMVVPYGAFFVPAGSGNAGGGTYAKDKLGNDITVEAWLNTHGPNDRTLAQGLKGDPTYLVVEQDKTLATYGINAVCTHLGCVVPWNGAENKFICPCHGSQYNNQGKVVRGTAPSVAGPWFTPDVERQQRSSFVPGGGRPD

SEQ ID NO: 92684 - DNA, 830 bp, Zea mays
  misc_feature: Ceres CLONE 1581530
ctccccgcggtggcggccgctctagaactagtggatcccccgggctgcaggaattcgtctcacccctagaaaaaaccacaccgccccgaccatcaccgacaccagcgcctaagccccccccaaacggcaggagacagcagcaggccggaggtctcctccttctacgcatccactgagttccttcctgcgcaaagtaaatccccagttctttcggccgctgccaagttttcgagtgttgctagccccgccagagttttcttctcccccgcagtcgaattgggcgagaagttgatgggaccgggggcacactggaaggttgtgtgagatcgcgaaggggaccgtgaaatcctgagagggctgcggtgattcggctgctcggcctgtattgaactgtttccgtgaaacctggggactccacctcgaacctccgaaacaaacttacgtcggcctgcccttcctccatcttcctggctggattttcttcccccccaggttaaatccctccccattcctaattccaacctaataaatttgggaaaggaaaaaaaaaaaaaactggcccaaatggggggagaaaaaaaccccaagggggggggaaaaagcggaaaaaacccccccccccccctccccctttttggttttttgggggggggggggttttaaaggttttttgcccccccccaaaagccccccaaaaaaggcccccccccccccggttttttttctttgggaaaaacccccggagaaaaaaaaatgggggggggaaatattcacccgggggaaacaccctttttttgggggttcccaccccattttttgggagaaagcct

SEQ ID NO: 92685 - DNA, 1221 bp, Zea mays
  misc_feature: Ceres CLONE 1581538
  misc_feature: Encodes the peptide sequence at SEQ ID NO. 92686
  misc_feature (12)..(12): n is a, c, t, g, unknown, or other
  misc_feature (13)..(13): n is a, c, t, g, unknown, or other
  misc_feature (54)..(54): n is a, c, t, g, unknown, or other
  misc_feature (56)..(56): n is a, c, t, g, unknown, or other
  misc_feature (57)..(57): n is a, c, t, g, unknown, or other
  misc_feature (59)..(59): n is a, c, t, g, unknown, or other
tggtgggggggnncgtctcactctcctctttcttcgactcatgtgggtatatantnntnaacacaaatttttatgctggagctccccgcggtggcggccgctctagaactagtggatcccccgggctgcttgaattcgtctcacccctagaaaaaagcggcactcgcacgatcaatgtacacattgcccgtccgtgccaccacatccagcatcgtcgccagcctcgccacccccgcgccgtcctcctcctccggctccggccgccccaagctcaggctcatccggaacgcccccgtcttcgccgcccccgccaccgtcgtgtaaacgggacggcgggcagctgaggagtcaaaccacagagatcgagagagaaagaaagggagggcatccaccagcccgcggcgataaaaggggaggagagagaggccacaaaaaaagaggaagagaagaaaaagatgagcagctgccccctgcctcccgaaaaaaaaaggtaggggcccgcccaaaagaaaaagccgtcccacagataccccccaacctcgatcaattccctttaagaaaccaaaaaagccccctccccaaaccctccaaacctccctttcccctccaaaaggaggtttccctccccaagaggggcatgggagaagcccccacccccgttccgagagacgctcttgaaaaaaaaaaccgggggtgttccccaaaaaaattttaccaagaaaaacccctagagagttcccttttgtgaaaacaacacaaaaaaaccccccgggagacgcctctggttttccctaaagaagcaccaccactccccaaaaaattgcccaggggggcctctgaaaaaaaccccccccaacgcgtttactaaaggaggagggggttgttttctccccttggggtctcccccgacaaaaccctcccaccccagagttgtggtaccccccccccttctccgggtgtaaaaaccccccgggagaggccagtggtttatagcccccgcggggttataggaagccgtatttacaacactgtgcagcgaatagaaaatacatcgcaggcctcgccgggtgagtgcgccccacacctccgtcagaggaacagaaagattcccatgtcaccacccccccgggcacccacagggttctcccacaccctcctgatatactaccccccgaattgtggtcgccgccttcctataggaggtatcaaatgcactattct

SEQ ID NO: 92686 - protein, 49 aa, Zea mays
  misc_feature: Ceres CLONE 1581538
MYTLPVRATTSSIVASLATPAPSSSSGSGRPKLRLIRNAPVFAAPATVV

SEQ ID NO: 92687 - DNA, 1144 bp, Zea mays
  misc_feature: Ceres CLONE 1581545
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (84)..(84): n is a, c, t, g, unknown, or other
  misc_feature (87)..(87): n is a, c, t, g, unknown, or other
gggtgggggggtnnntcnntctttttttataaaattaataggagaggggaaaaaattaaattgtacttgttttttctccctttnaanaattccccgcggtggcggccgctcttgactagtggatccccgggctgcttgattcgtctcacccctagaaaaaactcccatcccagatcaggattagccgaccacccgccgaaggccagagagaaatatctcatcttctctccaccggatcggttcaatcgagagcgagggagaaagggaggtggtgcgtcgaggggggccgagatttttgcccgttttggagcccgataggggttagagctgcttcgggcaccgtcgccgctccgaagtcgccccccgcccaggaacgacctctcggcttcggtcttccttcctctcgatttccacatcctaacccgtagtttttaattttaaggagcagcaaatttggaggtagcaaatcctcttggaaaaatggcgcctcccccccccccctgtttcctggggccccttttggcgcttttttctggtcccctccttttcccctcaaattttctcccttaatttctttcccccctttccaaagggggaataaccccgggccgggctgggggatgggggatcccccaatggggcccccccaaaaaacacggggaagggccctttttttggctccccccaaaacacactggtataaataggggcgggtgtgggatggttttgacccccttccccattccccgtggcatttttgttgtaatattccactgccggcattgtggttactttcttcctcgcgagaggtctttttttctcccgcttatgcccccctatgtgtcccctctttggccgcaaaagtgtgcttgttgctttttttttaagggagggagaacgcgcttcttgcgtgggaaaatctccccgaaagaataccctcccctatggtggtgcgggggcgccccattttctcacacccgcgcaaaaagcccccctttggggggggaggtccccccctcttgttatattgcgggggagaacccctctacgggtggtctaaaaacccccgggtgtggtgccacaatggggaaaatatctccgctgtggactccacctgttgtataaaaagccacactcttggggg

SEQ ID NO: 92688 - DNA, 1166 bp, Zea mays
  misc_feature: Ceres CLONE 1581555
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (69)..(69): n is a, c, t, g, unknown, or other
  misc_feature (912)..(912): n is a, c, t, g, unknown, or other
gtttgtgttgtggggggggcgctcaccccacggtcccggttcgcattttcctaagaaacannngaatgnaagaggagccccggactgaccgcggtggcggccgctctagaacagtggatcccccgggctgcaggatgcgtctcacccctagaaaactccttcctggacaaatcatcagctcccgaaatccaaattgaaacagttgcaggcgattctgagctcgggttttgttccggggacggattcctgtgccggcggacgggatgtcaggccctctcgaccgatttgctaggccatgctttgaagggtttgtacactacgatgaaaggaaagagagcagatctgatgcagacaactcagaaggagataagaagactaagattgggtctttcaagaaaaaagcaattaatgctgggaaaaaattcaggcattcccttgaaaggagaagcaaaaaaaagaccgaaagggggggacccccctccaaggacattaaggggaccgttaaagaagcttcaaagatgttgaaagaacattccgaacaaagccttaaattgaatgaaggattttgcctggcccccccctcaggcagcggattaatttatccccccctggaatggtttaaagggcttcccccaaaaaaccccccgcgaaaaaatttttgaaaagttttgaaaaaaaaaagcctaaaagaagatatatgttgggggctcccataacaaattggaaatcaaaaaatttggggggggggaaaaaggggaaaattttccccgggggggtgcccccacccccaataatattttgtgggtgggagaaattttttggaaatcttaacaccccacccaagagctcgtaaggaaatagaaagaggtgagaacacaaaagaatgttgttttcacccccccaccaatttcnttttatgctccggtggggaagcttagaaatattaaaatagaggggggaatagaaccccttcgccttcatacatgttagaaatatttagggtcgggagaagaaaaaggtgtgtgggagctccaaaaaacagagcgcttcaattaacactagggtggaatacaccaccccctcataaatacgggggaatagttgaaataaacacacctcacgggcaacaaaaacaattctcaaaataaaaggggcttctcccacga

SEQ ID NO: 92689 - DNA, 815 bp, Zea mays
  misc_feature: Ceres CLONE 1581556
  misc_feature: Translation starting site: 194
  misc_feature (710)..(710): n is a, c, t, g, unknown, or other
  misc_feature (727)..(727): n is a, c, t, g, unknown, or other
  misc_feature (728)..(728): n is a, c, t, g, unknown, or other
ctccccgcggtggcggccgctctagaactagtggatcccccgggctgcaggaattcgtctcacccctagaaaaaaccgacaccgcgcgcgagatcgcaagcgtccacaccgtgaccaccggcgccgctgcggcgtccggagcaggcggcgagcgtcgtccacagggtaggctcggcttgccggggcggacgagatgagcgggcacgactccaagtacttctctaccaccaagaagggggagatccccgagctcaaggaggagctcaactcccagtataaggacaagagaaaagatgctgtcaagaaagtgattgctgctatgactgtaggaaaggatgtctcatcattgttcactgatgttgtgaactgcatgcagactgagaacttggagctaaagaaactagtatattgtatctcatcaactatgctaaaagtcaacctgatcttgccattcttgctgtgaacacatttgttaaggattcacaagacccaaacccattgattcgtgctttggctgttaggacaatgggttgtatccgcgtggacatatcacagagtatctctgtgatccacttcaaagatgcctcaaggatgacgatccgtatgtacggaagactgcagctatttgcgttgctaaactttatgatataaacgctgagctagtagaggacagaggatttctgggagccccttagggacttatatctgancatatccctatgggtgnntgcaatgctgttgctgctctggcagagatccaagatagtagtgttcagccaatctttgaatcaccagccatacactgtcaaagcttc

SEQ ID NO: 92690 - DNA, 1317 bp, Zea mays
  misc_feature: Ceres CLONE 1581562
  misc_feature: Encodes the peptide sequence at SEQ ID NO. 92691
  misc_feature (16)..(16): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (453)..(453): n is a, c, t, g, unknown, or other
  misc_feature (855)..(855): n is a, c, t, g, unknown, or other
  misc_feature (858)..(858): n is a, c, t, g, unknown, or other
  misc_feature (867)..(867): n is a, c, t, g, unknown, or other
  misc_feature (1173)..(1173): n is a, c, t, g, unknown, or other
ttttgggggtggctgnttgtcgttgtgggggggcgcggggcggcgccggggcgnnnaaaacgccccccataaagaaaggcatagctggagctccccgcggtggcggccgctctagaactagtggatcccccgggctgttggaatgcgtctcacccctagaaaaagaggacatcctcggccttccagggcagtctaccacgaaagccttctgcgcggggtgctttcctcgcagcaaatattcctgccttttgcattccggctttgcaagttccttgctttgggcatatatattgtgaggtctctatatatataggtggttcgaggtgatcggcagaacctctcaggctaagatggggagcgtgcacaaggccaccacccttgttctcatgttctgcctgctagcgctggggagagcggagtacctcaagtacaaggacccgaagcagcccgtcnctgctcgcatcaaggacctgctgggtcggatgaccccccctgaaaagatcggccagatgaccgcggatcggagagggaaaaacgccacggcccgacgcgactgggccaaataacttcaataggatagcagtgcctgaagcggccggcaggccaagcgtggccatggcctcctccaggccgttcctgccttcagaggcttttggggcccggccaatggggtcgaaccccgaagaaatggccaggaaagtggggcgggccatcgtgttttccttaccggccgcgtaccgggaggtgatatataccacccggaaatccaatctcgctagacggtgaggtaaagtcccgcataagggcggcataaggagcggcacatgaggtgtgagagtctttacatgagtacancgnaaacgcgtncatgtcattttagcgcgagatattgagctcgcgtaaacgtgtagtatgtggagttggagccgccggagtgcgcgccatatactgtgacatatagggagtgggcttgttgtgcggcggtataggaaggaagacacacagcggaacccccacacagattagcgagacccgcctttgagactgccacccggggctcggtcatgatatctgacgaaaaatgagttagtgggacactataagatatgataagaatgggggtgcgctctctctgatataaataaatctgtaatgatagacgcttccatatcngaaggaacaatgtagcaccggtatatatcaagcgctgttgtatacgctcccacacgatatataatgtaacaaggaatgattacgtgatacataagagacgcctcatactgtgagtggagcgacacatcccgaatctaatcaaca

SEQ ID NO: 92691 - protein, 71 aa, Zea mays
  misc_feature: Ceres CLONE 1581562
  misc_feature (35)..(35): Xaa is any aa, unknown, or other
MGSVHKATTLVLMFCLLALGRAEYLKYKDPKQPVXARIKDLLGRMTPPEKIGQMTADRRGKNATARRDWAK

SEQ ID NO: 92692 - DNA, 870 bp, Zea mays
  misc_feature: Ceres CLONE 1581564
  misc_feature: Encodes the peptide sequence at SEQ ID NO. 92693
gcggtggcggccgctctagaactagtggatcccccgggctgcaggaattcgtctcacccctagaaaaagagatgggactcacacgccgtcacaatgctgtgcctcgtgtcgccctcttcctcgccgactccgcttccgccgccgcggcgctctcgctcgcatgcttatcgggcggcaccgccggggatcgcgggtggcggcaatgtgcgcctgagtgtgttgtctgtccagtgcaaggctcgccggtcaggggtgcggaaggtcaagagcaaattcgccactgcagctactgtgcaagaagataaaactatggcaactgccaaaggcgatgtcgaccatctccccatatacgacctggaccccaagctggagatattcaaggaccatttcaggtaccggatgaaaagattcctagagcagaaaggatcaattgaagaaaatgagggaagtcttgaatccttttctaaaggctatttgaaatttgggattaatacaaatgaggatggaactgtatatcggggatgggcacctgctgcgcaggaggcaaaactttatgggggacttcaatggacggggatgggggcaaaccctaaggatggagaagggaaaaattttgggggttgggccgattcaaaatttgaccatgtccaaaggggaaacccggccatccccctcccaattcccaagggttaaaatttcccctttccaacctgggggggaagtaatggggttggaatcgtaattcccccgcttttggttttccctttttggcgaaccggtggggaggcgccccccaaaatttgggggacctcccccctaagggaaggggggttcacatagaggagaacccccccccgcgcctccgggaaa

SEQ ID NO: 92693 - protein, 199 aa, Zea mays
  misc_feature: Ceres CLONE 1581564
  misc_feature: SWISSPROT Homolog: EC 2.4.1.18 1,4-alpha-glucan branching enzyme
MLCLVSPSSSPTPLPPPRRSRSHAYRAAPPGIAGGGNVRLSVLSVQCKARRSGVRKVKSKFATAATVQEDKTMATAKGDVDHLPIYDLDPKLEIFKDHFRYRMKRFLEQKGSIEENEGSLESFSKGYLKFGINTNEDGTVYRGWAPAAQEAKLYGGLQWTGMGANPKDGEGKNFGGWADSKFDHVQRGNPAIPLPIPKG

SEQ ID NO: 92694 - DNA, 1230 bp, Zea mays
  misc_feature: Ceres CLONE 1581565
  misc_feature: Encodes the peptide sequence at SEQ ID NO. 92695
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (726)..(726): n is a, c, t, g, unknown, or other
  misc_feature (996)..(996): n is a, c, t, g, unknown, or other
  misc_feature (1077)..(1077): n is a, c, t, g, unknown, or other
  misc_feature (1189)..(1189): n is a, c, t, g, unknown, or other
tgggggggggnnncacagcggggaggggcgcgaggggacaggagaggggaaaaagacaacaaaaaaaaggggggaaaatagaacgcacgcggtggcggccgttctagaacagtggatcccccgggctgcttgaagcgtctcacccctagaaaaagagatgggactcacacaccgtcacaatgctgtgcctcgtgtcgccctcttcctcgccgactccgcttccgccgccgcggatctctcgctcgcatgcttatcgggcggcaccgccggggatcgctggtggcggcaatgtgcgcctgaatgtgttgtctgtcctgtggaaaggataaagagacaagggtgcaaaatgtctagagaaaattcgaccacttaaggctactgggccggaagaaaaaagctatggggaactgccgaaggcgaagggcggctatcttcccccaaataaccaccgcaaaaccccgggctgggagatagtgagaggacccccccccccgccaccggaaagaaaaaaacgccctaagagacactaacgggatcagtcttaaagaaagaaatgaaggcgaaggtccaaggaactccgctttccaaaaagggccccctttttgaggaagttggcggagttgaatcaccacacacaaaggcacgggggaaaccgaatcaaaaggcgacaagaaattgaaagacaactgtgaacgctggcacaaaaggggaaagagtacaaaaaantcgttcagaatgcaggtcgaaacctttgtcccacaatactgaccatgaaacaaaacatcggcgttgtgcgagcgagccccccatttatagatatcaggcctccttctcaccggcgcaatatacaacactattgtgagtgccatgtagttgggcagtctccgtcagttccaaatcacagagtcgagatactccagtacgcggcaggataacgagggagaaaaaaacgtggaggggtgcggatgcaccgaccccacaccagaactgtgccgngagagggcacataaaaacgagctgccccgattattttggctacacccggcgcgcgggttataacagtactcagaggtgatncaaaccacaattaagaagatcgcaaaggagggagataggataatttacagatttttgaggcatgcaaatattctacatattcgcccacgtgtcatcaaaaaacctaagacgnggactgtcaccacatcactgaagagaggtgagtatccccac

SEQ ID NO: 92695 - protein, 49 aa, Zea mays
  misc_feature: Ceres CLONE 1581565
MLCLVSPSSSPTPLPPPRISRSHAYRAAPPGIAGGGNVRLNVLSVLWKG

SEQ ID NO: 92696 - DNA, 1191 bp, Zea mays
  misc_feature: Ceres CLONE 1581566
  misc_feature: Encodes the peptide sequence at SEQ ID NO. 92697
  misc_feature (69)..(69): n is a, c, t, g, unknown, or other
  misc_feature (1191)..(1191): n is a, c, t, g, unknown, or other
gttggtgggtgttttttttgaagggcggcatccccctccggcatggcgccagaattgcggtacttaatnaattgggactccccacggtggcggccgctctagactagtggatcccccgggctgcttgaatgtcgtctcacccctagaaaaaaaacatgtgtcactcaccagcgctttcttgtcccgtactcccgtgtaccctgtcccgtcctcctagctcgcattccgatttccgagttccagccagcgagcgagccaaccaactgaaccaaccaaccaccgctccttcttccttccttccttccctccccagttcccctcggtttaccagtgcccaaaggttccgagaacagaccgagataaaaaaaaaggaatcccaacggaaaccaacatgggcgcgggcagagggcgggtaaaggggtcggggaaggccctggggcgggggggggggccaagccgcatggtggttcgtcgaaggggggacccccccccatacgtcgaacgttgcaaacaacagagctgctgaatcgtcgacgcgcccttaggcgctgggtgccccccatcacggggccccggcggggcgtgggggcagaccggggttgggggttccacagtgaaacgtgggaaggagaactccccctccggggggaattctttttgaggggggataattgtggctacggcgccggggggaccctcccccctccagttgttagtaggcaccccaaaatcgctccccgcaaggggttgcctccgggtgtccacccgaatattcccttcgtgaaaggtgttccgctcccacccacccttataagaaacccacccctctaaaacgaatctgacgggctggtaatataaagaaaaaatcccccctacgcactgaaaaacctcgacccctaattggaggggaaaacccgcagtgcccccccacccgcagtgtgcgaggggtaacgatggatcgtttataattcccaccccactcatcttgattgtgcgcaacgccacccattgcggttcctttaggaaaattaatctcccggggggcgaaaatgacctctcgctacccaggggagaattaaagtttacccgcccgataagaaaagaaataggggtgatatagaggggttatttgaggaaactctatcacagacgggggactatagtgaagtttccctacggggggatacttan

SEQ ID NO: 92697 - protein, 44 aa, Zea mays
  misc_feature: Ceres CLONE 1581566
MGAGRGRVKGSGKALGRGGGPSRMVVRRRGDPPPYVERCKQQSC

SEQ ID NO: 92698 - DNA, 1148 bp, Zea mays
  misc_feature: Ceres CLONE 1581568
  misc_feature: Encodes the peptide sequence at SEQ ID NO. 92699
  misc_feature (10)..(10): n is a, c, t, g, unknown, or other
  misc_feature (18)..(18): n is a, c, t, g, unknown, or other
  misc_feature (1148)..(1148): n is a, c, t, g, unknown, or other
gggggggggntgctcccnactcaacctgagcgcggaggaaaacaatcattaatgattggtgtttgtattttatggggaggcgatttgagctacacgcggtggcggccgctctagactagtggatcccccgggctgcttgaattcgtctcacccctagaaaaaacctcgtgttcgttcggagcgcacctttcacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggaacggcgcacccttggcgacctacaccgccagaaggagagctacctccaacttgtgctccgcctcaggggaggcaggcaaatcttttaccaaaaaaccccggaaccggcaaagaccatccacccttcaaggtggaacccctccgaaccccatttgataaacctccaagggcccaaagacccagggaacaagggaaggggattccccctcccagaaccaagcaggcggggctcattccttttggctggggaaaaaccagcctgtgaagggaaacggggcggccaagcccttttgtccggaatctatcaaaaacattcccaagtatggggaggaaggccaccccctttccaaaccttgtggggtgggcctggcccgccccctcccgggggggggaaagggccctatgttcactaaatctttcttgccgtggtaaatgaaaccccctgggaacacgcggggctaataaaaattatgttcaccccaccttcgaaaagagtggggaaagttcccttgcaaaaaacaccgccattcagaaatataaacgtttaaaaaggacgccttaaaaaatccccaagggaaacaataaggtaaggggttatttttcccacccccataagatacagcgcgagaggggggcaccagatccttttgggctggggaaaaaagccagacccttggtggggataagggggggtacactttcctggggccctaattatacaaacagtctccggaaaagggagaaacacaaaccccn

SEQ ID NO: 92699 - protein, 188 aa, Zea mays
  misc_feature: Ceres CLONE 1581568
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEERRTLGDLHRQKESYLQLVLRLRGGRQIFYQKTPEPAKTIHPSRWNPSEPHLINLQGPKDPGNKGRGFPLPEPSRRGSFLLAGEKPACEGKRGGQALLSGIYQKHSQVWGGRPPPFQTLWGGPGPPPPGGGKGPYVH

SEQ ID NO: 92700 - DNA, 830 bp, Zea mays
  misc_feature: Ceres CLONE 1581570
  misc_feature: Encodes the peptide sequence at SEQ ID NO. 92701
ctccccgcggtggcggccgctctagaactagtggatcccccgggctgcaggaattcgtctcacccctagaaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcacctctccaactccaagtccgccaccgtggtgaccaacttcatgggcacgctcaacctgctcgccctcgtcggcggcttcctcgccgacgccaagctcggccgctacctcaccatcgccatctccgccacaatcgccgccacgggcgtgagcttgctgacggtggacacgacggtgccgagcatgcgtccgccggcgtgcctggaacgccgcgggccgcgcgcgcactagtgcttgccggcgcgccggcgggcagctggcgcttctgtaacgcggcgcttgtacaacgtggccggcggggggccggcggggctcaaggcgaaacgtggtccgggttcggggtcgggaccaagttccaacggggggcagaccccgcggggaggagcgccgcccaggggggttcctctctt

SEQ ID NO: 92701 - protein, 142 aa, Zea mays
  misc_feature: Ceres CLONE 1581570
MVSGAGHGGYGGGDDGQAVDFRGNPADKSRTGGWLGAGLILGTELAERVCVMGISMNLVTYLVGELHLSNSKSATVVTNFMGTLNLLALVGGFLADAKLGRYLTIAISATIAATGVSLLTVDTTVPSMRPPACLERRGPRAH

SEQ ID NO: 92702 - DNA, 1240 bp, Zea mays
  misc_feature: Ceres CLONE 1581571
  misc_feature (51)..(51): n is a, c, t, g, unknown, or other
  misc_feature (1240)..(1240): n is a, c, t, g, unknown, or other
gttttttgggtctttccttggtggtgggggagaggggaattgggcaccaangaaaatttggttgtgggccttggggggaggaggggagctccccgcggtggcggccgctctagactagtggatcccccgggctgcaggaattcgtctcacccctagaaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggccacaacgggcaggccgtcaacttccggggcaacccggcgggacaagtcgagggaccggaggctggctgggcgccgggctgatcctgggcaccgaactagccgaacgcgtgtgcgtggatgggcatctccatgaaacctgggggaacgtaccctcgtccgggggaagctggaccctcgtccaaacttcccaaagttcccgccaacccggggggggacccaaacttttcaggggggaacggcctcaaacctgggctcggcccccccggtccgggggggggtttttccttccgacccaaaaccccccaaaacctcgggggccgcgcttaaccgctcaagcgcattgtgggcccaatttgttccgggcgcaaagaaataattcgggcccgggacccacaccgggggggccggttggaaaaagaccctttggcgcgtggtaagaacagggtgtggtgggaaaaaaaacagcgaaaaacgcagggggggccccccgaaaaaacacaattagggagcgcggtgctccccgcccgcccgggggaggggtgggggccccctgggggagaaaccacccccccccctgacggggggggtgccatctgggaacgcgggggttcacaaacgaaaaaatgggggcgggggggggcctgcggagcacaccctctcgtggagcgggggggaacacacctcttgggggagcccccgtctcgtttatatacccgccggcgggcgcccctagttaaaaaaacgcggggggggccgccggccggtggtggggcccgcggcacggggggccttcacgagagcgggaaaaaaccggggttatccgcgggagtgttcaggtgtatgctaaacaaaaaggtttcgcaatggggggggtcgcacccccccccggggn

SEQ ID NO: 92703 - DNA, 839 bp, Zea mays
  misc_feature: Ceres CLONE 1581579
  misc_feature: Encodes the peptide sequence at SEQ ID NO. 92704
ggccgctctagaactagtggatcccccgggctgcaggaattcgtctcacccctaaaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaaagtgtgggggggaggcaactacgacctcgccaccgtgctcgcctttctcgccgtcctcgcctttcacatctccgtctacataatgtccagggcccagggccgggtaacctcatcgacttcccatggtacaagccgggcgaccaggctcaagtggcccaaggcgggagtttctcgaacctggccgcaaattccggcaaatttcaaacaagaaaagcctggcgtttccattcccgttctgctgggccaattccgggattcgggaaaaaattctaaatgccccggcttgcggttttaagcccaaagccggttggcgcccaccatgaaagaagggcccgccccaagggggcccaccgccatggtttccgggccctggaacaacctgtttcccaaaagggcccc

SEQ ID NO: 92704 - protein, 186 aa, Zea mays
  misc_feature: Ceres CLONE 1581579
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRKVWGGGNYDLATVLAFLAVLAFHISVYIMSRAQGRVTSSTSHGTSRATRLKWPKAGVSRTWPQIPANFKQEKPGVSIPVLLGQFRDSGKNSKCPGLRF

SEQ ID NO: 92705 - DNA, 802 bp, Zea mays
  misc_feature: Ceres CLONE 1581582
  misc_feature: Encodes the peptide sequence at SEQ ID NO. 92706
ctacccgcggtggcggccgctctagaactagtggatcccccgggctgcaggaattcgtctcacccctagaaaaaaaaaatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcaccggtgccaagagtaaccaggacccctcttttttccaagaaccagtacaaaccgcctcttcggcctcttaggagtagttcagtagtaaggcgatcgttgcagcaggacaagaggagagggtgggcccggcgtcctctgtctctgtggcctccggcgagcgacaggaggaggcgacggcgtcgcatcatgttggagggggttggatgaggccaaggcgtcgggccatgttggagaggcagataaaggaggccaaggagaaggcccacggcgaggagaagaggagcacagacgagcagcaggaggtgggactggaagtcagacgaagagttcaagaagttcatgggcaatccctccatcgaggccgccatcaagttggagaagaagcgcgcggacaggaagctccgcgagctggaccgcgagcccgacgccaaccccgtcgccgggctgttccgggggcttgggtaaagaaccagctggccgcgaaaaacagaggctggagctggcggacaaaacttcaaggactcgacctcaaaagcttaaaacctgttccggtaacacacgttcttcgcgtggaacgtccgg

SEQ ID NO: 92706 - protein, 41 aa, Zea mays
  misc_feature: Ceres CLONE 1581582
MGNPSIEAAIKLEKKRADRKLRELDREPDANPVAGLFRGLG

SEQ ID NO: 92707 - DNA, 1214 bp, Zea mays
  misc_feature: Ceres CLONE 1581583
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (81)..(81): n is a, c, t, g, unknown, or other
  misc_feature (82)..(82): n is a, c, t, g, unknown, or other
  misc_feature (115)..(115): n is a, c, t, g, unknown, or other
  misc_feature (534)..(534): n is a, c, t, g, unknown, or other
  misc_feature (844)..(844): n is a, c, t, g, unknown, or other
  misc_feature (1148)..(1148): n is a, c, t, g, unknown, or other
tggttggtggtagggggggtaaaacacaacnnaggtagngcggaaaacagcgggggggggaaaaaaaaaaannnttttttnnaacctggactccccgcggtggcggccgttctanaatagtggatcccccgggctgcaggaattcgtctcacccctagaaaaaaaaaatagcttatatagcaaaacaatagaagtagaacaagcacagaactgttaagctccgcaggctgcagctcgtccccaatgtcgtctgcttctcttgcatcttctctcttgtgcagcagcagtgcttctactagtagaagcgcaaccgtgccaagagtaaccaggacccctcttttttccaagaaccagtacaaaccgcctcttcggcctcttaggagtagttcagtagtaaggcgatcgttgcagcaggagcaagaggagagggtgggcccggcgtcctctgtctctggggcctccggcgagcgacagggaggaagcgacgggcggtccccatcaatgtttgaaagggggggggaaaaaggcccaaangggtggggggggggggggggggattgggtgttctctaagttcacggggtgggggacaatgggaagcattaaagcgatacgagagggcggcggccaggtggactacaaagcaccgcggtgagggctgggggttggcggttccaggggcttgtcgaccctctgcagcggagcgcccggagtatgggactcacaccctcccccagaccagagaggttgttttgttcgatatgacgacagagcaggcttaatcacacacctgtcctaagaatgtagacgatcttaagacataataagagatgttgataaggggntactcaatgaatgggcgcgagtgttcgagaattataagacgtgtcgttctaaaggctgaaatttgtcactactcctaatgatatgaaagatcgagagaggaagggaggttgaaataccagccgatatgtctgcgcgcagcgcactgcgtaccaaccgatgggaggaggtaatggagtcgagagctgtatgacctaacggcgctgagggtttatagaaaatgaggttgtgcgggagtgacaaagagccatataagggaaatgcgggagcctatccgcatgagatactaaagcaaagatcaaaggngagaattgtaggtggatagagaagcgtgaactgggggaagcgataatggggaggcgcatgaaggtc

SEQ ID NO: 92708 - DNA, 1279 bp, Zea mays
  misc_feature: Ceres CLONE 1581584
  misc_feature (61)..(61): n is a, c, t, g, unknown, or other
  misc_feature (62)..(62): n is a, c, t, g, unknown, or other
gggtgtggtgattgttttcattatttatataaaaaagaatagaggaagaaagagagggganngactggttactaaaattggagctcccgcggtggcggccgctctagaactagtggatcccccgggctgcaggaattcgtctcacccctagaaaaaagcctttcttcctcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcacccgcaacttctcccaaggtgctgttggtgccccaggggacacgcaactgggggaagtgtgtgcgtttcctttgcttgaatcaacctaaggttaagcccattttccttggccaccagtgtttcctcccaaattccggggggtgggggggaaacttagggcccaagaaataagcctggggagacctggccaccggtttttaccccttttcccaaaaaaaagtaacgaaaagggccggggggggggccgaaaggccgccaatatcgtttttttgtaaaggcggggggtacccctgagtttgttcgggcgcaccccactttaaaaaagtccatgtctgctccaaatatcaccacagaggggggatgccgataacttatatgccctggggggcgtacgtatataccccggtataccccgggggggtcgccctgtgggcgccggaggccgctggaggggagaacgcccgcgggtgagaaaatactgtgtgggttgataaaaaagaggcgccgggcgtgcgaggggaggatatcccactcccgcgggtgtggggggggagacaactcctgcatatctctctcattattccacaccccgcgttgtagtcgctgacccgcgcggggcgggcaaaagatttcatgttctctgttaccgctcgcgtattcaatatcactgagaagatacttggtctcggcatcccgcgagaagagaacgtattctcacagacgtgatcctgctcgagattgatttcgattggaggaggacaacagaaaagggggggggtgtccatgctctcaaggatctgggggagcattcacagggcgggagcgggagagtgaaaaatacgcc

SEQ ID NO: 92709 - DNA, 840 bp, Zea mays
  misc_feature: Ceres CLONE 1581585
  misc_feature: Encodes the peptide sequence at SEQ ID NO. 92710
ctggagctccccgcggtggcggccgctctagaactagtggatcccccgggctgcaggaattcgtctcacccctagaaaaaaaggaaaaaagaaaaatggcgcagctggtggagacgtacgcgtgctcgccggccacggaacgcggccgtggaatcctcctggccggggaccccaagacagacacgatcgcctactgcaccggccgcagcgttatcatccgccgcctcgatgcgcctctcgacgcttgggcctaccccgaccacgcctaccccacgaccgtcgcccgcttctcccccaacggcgagtgggtcgcctccgccgacgcctccggctgcgtccgcgtctggggccgctacggtgaccgcgctctcaaggccgagtttcggcccctctcgggacgcgtcgacgacctccgctggtcccccgacggcctacgcatcgtcgtctctggggacggcaagggcaagtccttcgtccgcgcatttgtgtgggactctggcagcactgttggtgaatttgatgggcactcaaagagggttctgagctgtgacttcaaaccaacacgtccatttcgcattgtgacatgtgggatcactcaaattttgtttactgtatccggtatgctcctgatggtagtaagttatcactgttgagtctgataagaagggtttgatatatgatggcaaacttggagaaaaataggaagactttccactgtaagcaatcatacagggagcatatatgctggttagctggagtcctgacagtaacaaggtctaacagtttctgctgataaatctgcaaaagatgggatatctggaagatgcaagtgggaaatga

SEQ ID NO: 92710 - protein, 185 aa, Zea mays
  misc_feature: Ceres CLONE 1581585
MAQLVETYACSPATERGRGILLAGDPKTDTIAYCTGRSVIIRRLDAPLDAWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGITQILFTVSGMLLMVVSYHC

SEQ ID NO: 92711 - DNA, 1159 bp, Zea mays
  misc_feature: Ceres CLONE 1581587
  misc_feature: SWISSPROT Homolog: EC 2.5.1.18 Glutathione transferase
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (60)..(60): n is a, c, t, g, unknown, or other
gtgttttttgtnnnnggngctatatctgggaaacactttcttatctttatcgtgaagggnagtgagagttttatgagggatacaggagctcaccgcggtggcggccgctctagaactagtggatcccccgggctgcaggaattcgtctcacccctagaaaaaaagcagatagcagcaagctaagcaagtgccaaccaacgagtagcaggaaacatgtctccgcccgtcaagatcctcggccactacgcgagcccgtactcgcaccgcgtcaaggccgctctgcggctcaagggcgtgccgtacgagctgggtccaggaagacctggggcaacaaaagcgacctgctgctcgccaagaacccctggtccacaagaaagtgcccgatactcctccattggcaacagggccgtctgcgaagttccctcctcttcggcgagttacgttaaagagggctttcgaaggggcgtccattcctgccgggccaacccccccacccaccgggccgtagggccggttttttgggggggaaacctttcgtggggaaacccaatttcttcccagccccattctggcctgggccgtacttggtgcgtgatgggcgatagctcaaaaaaagccccatggttgaataggatggggcccaagtggagagaaaaactgggggcggttcctctgggtaaggcccccatcttttcggtggggggaaaaaaagacttttttttttcgagcgagggagtggtgaacacgcgggcccccgggggtgtatcccttaccggaaaatatataaaaccccccagtgtgtcccccccttttgagagggactctcatttagagattatacgcgtggattgcgctccttatagatgcagtgggggtgcctggcgggaggctgggaccctctgggttggtggataagcccctgaggaataatgtttcctcccatgtgtcgtatgtgtcacgagttgggggaccgcgaggggtttgtccccatcttcccccattgaatataatagcttagcgttgtacctgttccccttcgtgggttgatcgaagggaaccgcgccgttcctgtgtggcagctagtatgctccgctgtaaaagatacttgcttttttttatgtccgtcgtacgagggctgtttcttgggtttaaccttttg

SEQ ID NO: 92712 - DNA, 1197 bp, Zea mays
  misc_feature: Ceres CLONE 1581589
  misc_feature: Encodes the peptide sequence at SEQ ID NO. 92713
  misc_feature (15)..(15): n is a, c, t, g, unknown, or other
  misc_feature (665)..(665): n is a, c, t, g, unknown, or other
ggggggggggttttnttatgttaattggcgggggacgcaatacatgtctgtggtaggggttctataaaaaaaagacagacaaataatccctcggtggcggccgctctaaactagtggatcccccgggctgcaggaattcgtctcacccctagaaaaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgaagagtctcactgacaagagcaagctcgatgcgcagcctgagcttttcatcccccttgtcccagacaaaggccacgaaacacgctctccatcgtcgacagcggcatcgggatgaccaaatcccacccttgtcaacaacctcgggtacccatcccccaggttccgggaaacaagggagttcaatgggaaagccccttggcgtgcccggcggccgaaatggtgtccccatggaaattgggcccaaatttccggggcgtcacgggtttttcctaacacctcggacccttaancccttcaggtcgaaccgaaaataaaaaaaatttgtttcccccgtgggaacccccccgccatagagggcaacacgatggcggtaatggtgaaccccgcaggcccacgggtttaacacactctgtgttctggcgggggaaaaacattccccccacaccataaaactctggggggaccgggtggaattttacgcgatatccccaacgctgggggtgtataaccaccccccgcagggaaaaccacacccttctcttcaggggggtggagaaggcccacagcccttttgtgtagcacgggggggaggcgcgcccccctcacagagaatttgctcggaacccttgtgtgctgccctcccatgggagggcaacgaagtttccggggcgtggggggaggaggtcgcccctctgaaaaggaaaaagccttcacccccctccctccgggtgaatatcgttggcgtccaaatagtagacaccacgctccggagaggggaatatctcgggaaaaccccccgttttctgcccggtgtggggattg

SEQ ID NO: 92713 - protein, 53 aa, Zea mays
  misc_feature: Ceres CLONE 1581589
MASETETFAFQAEINQLLSLIINTFYSNKEIFLRELISNSSDALDKIRFEESH

SEQ ID NO: 92714 - DNA, 1253 bp, Zea mays
  misc_feature: Ceres CLONE 1581590
  misc_feature (14)..(14): n is a, c, t, g, unknown, or other
  misc_feature (57)..(57): n is a, c, t, g, unknown, or other
  misc_feature (77)..(77): n is a, c, t, g, unknown, or other
ggggcgggccgctncccccttttaaataatattatagtaggggtggggagagatacntaaggttggaattatataantggagctccccgcgtggcggccgtctctagaatagtggacccccgggctgtcaggaattcgtctcacccctagaaaaaacgcggtccatctgtcttgtgtttctccttcctcattcctcagctcgagctcctcggcggctcgccagtctgccgccgcgcacggcgcatctgttccttctgctctgcgacggcgagcctctcccctcccctccgtgctcgtatcgtaacctatttttcgccgccacagcttgcccagttgctgttatcttgtgttccgcacccacctcaaaggctagaacccctcttcagggcgccctgggtagatccccccagactcaacccgggtaaaagcctttccggggcaccccacccatgggcccattccctccgcccgcctcccccggggggtcgaaaacccccgccccctcccgttataccccccttgacaaaaaggaaaacgggccgggggttccctttcccccattcaaaccaaaacaggaggttattgtattttcccagcccaaacccctctaaaccggctatacccgcttttaattattgggaagatttttttccctgggaaaacaccctctttttttttcttggggaataagcaaaaccccccccgcggataaaaaaatattttttccccccttttataaaaaaagtgttgtccctccggggaatagaccaaggttgatataaaacccctccccccggagagggacaaaaaacccccgcgggtttttggtgtattccctcccgtgggggggagggaaaagtatctttgtaaccccgttttggtgaaaaaaaaaagcgctcggctcttcgcgccacaaacacatttttggtgcattagccacagaaagaaccctctagggttgtcagacttgttttagcacgggagcctcccctcctgtgggtgataaaaaataacaaacattgtcttgcgtgggggattccgaggggtaaaaatatctctgtttggggtgaggccacgggggagtgaagatagttagaaccgcgcgccccgttgaaaaaacatgtccactctgttggcgttagaaaaaaatagcggggcggttgagaccacctctcttgccatcaaaaaaggagaggcgctagtgcttgcaatacagaggattttttgttagaattttgtccacacgcaatata

SEQ ID NO: 92715 - DNA, 792 bp, Zea mays
  misc_feature: Ceres CLONE 1581598
  misc_feature: Translation starting site: 596
  misc_feature (358)..(358): n is a, c, t, g, unknown, or other
  misc_feature (359)..(359): n is a, c, t, g, unknown, or other
  misc_feature (641)..(641): n is a, c, t, g, unknown, or other
ctggagctccccgcggtggcggccgctctagaactagtggatcccccgggctgcaggaattcgtctcacccctagaaaaaacaaacagagagctcaccaattcaactgaacagcaagcgcacctaccctacctgcaagcgcaccgcccgccgcccgccgtcgaaggcgaagacctagctcccggtccgtcgcgatggctgccgcggcccgccgcggccccggggcgcgcctccttgcggcgctcctcctgctggcgctggtcgtctccgggcactgcctggacgcgcaccaccgcgggctgaagcgccggcggcggaagcacgagatccattccccggtcaagacggtggtggtgagnnggtgatggagaaccgcagcttcgaccacatcctcggctggctccgccgcacccgccccgacatcgacggcctcacgggccgcgagtcgaaccgcctcatcgcctccgaccccgcctccccggagatcttcgtcaccgacgaggccggctacgtagactccgaccccggccacggcttcgaggacatccggggagcagatcttcggctccgccgacacctccgcggtgccgccccccatgtccggattcgcccagaacgcgcgcggcatgggcctcggcatgncgcagaacgtcatgagcggcttcaagcccgaagccgtccccatctacgcctccctcgcgaacgacttcgccgtggtcgaccgctgggtcggctccgtgcccaactccacgcagcccaaccgcctggttcgtcactcggcgacctcccaggg

SEQ ID NO: 92716 - DNA, 1279 bp, Zea mays
  misc_feature: Ceres CLONE 1581599
  misc_feature: Encodes the peptide sequence at SEQ ID NO. 92717
  misc_feature (896)..(896): n is a, c, t, g, unknown, or other
gggggtggggtggggtgtgtttttttctaagaaaacgagggggtaaggggaggcgggggggataaaaaagatgtgtgtggtgtggtttttttctcaggggggcggccgctctaaactagtggatcccccgggctgcatgaattcgtctcacccctagaaaaagtccactccaagacgaagcatccggacgagcccacccttccgaccccacccgctgacatccgacgccgacgccggcgcagacagccgcaccagcgccacccaaatcccgcaaaaccctagagacagaagacgcgaggggagagagagaggcgcccggcatggcgagcgcgacgtccccagcgatggccgcgaatctggcgggcaagtcaggcgtgcgggtcgtcgtgatcggcgaccccggcaccggcaagtccagcctcatcgtcgccctcgccaccgagcagtttcccgagaacgtgcctcgcgtcatgccccccacccgcctccccgccgattacttccccgaccggcttccccatcaccatcattcgaaacgtccgtccaagccccggagcaggaaacccaaaatttaatccccccgaagggtcaagggccccccaatggcggggtcggggctccatcccttaccgccctgggggacccggggcccgaccatccccttggaaaaacagggctctccggtttccggttttcttggggcctttccccccaaaaggcttccccgggggcgaaaacttcccaaggggctgggaaagaggggccccccccaggggtgtttataattccccttctagggttgtgtgggggggggattggtccccacataaagcactctggggggataaacaccccttgtggtgtgggcgggggaccccctcaaaaatcacaaacgnccacaggggggggtttgatgaccccctctgtttgtgaaatacccaagagggggtgtttatactggggggcgggtcccccccaacgtctcaagtgtggggcaaggaggggctcactttttccgcgcccaggagaaagaatttttgtataaaaaacaccccggggcgttatttttgtaggaagtggggatctccacgatattctcttttttccgtccacagataagatattcacgaggggggggcgcctccagcaggagaggttttttttcagccacctcagagtgggcccccaagaagataggggggtgtgtatatctttgtctcaccgcttatacagtgtgggcgcccactcgttttggtgtgaagacgcagagaaaagtcca

SEQ ID NO: 92717 - protein, 76 aa, Zea mays
  misc_feature: Ceres CLONE 1581599
MAANLAGKSGVRVVVIGDPGTGKSSLIVALATEQFPENVPRVMPPTRLPADYFPDRLPHHHHSKRPSKPRSRKPKI

SEQ ID NO: 92718 - DNA, 1211 bp, Zea mays
  misc_feature: Ceres CLONE 1581600
  misc_feature: Encodes the peptide sequence at SEQ ID NO. 92719
  misc_feature (23)..(23): n is a, c, t, g, unknown, or other
  misc_feature (43)..(43): n is a, c, t, g, unknown, or other
  misc_feature (46)..(46): n is a, c, t, g, unknown, or other
  misc_feature (47)..(47): n is a, c, t, g, unknown, or other
  misc_feature (69)..(69): n is a, c, t, g, unknown, or other
  misc_feature (70)..(70): n is a, c, t, g, unknown, or other
gtgggtggtggggttggttgttntctgtgtttgtgtttttatnctnncctttcctctgttgggaagaannatttaaaactggaactccccgcggtggcggccgctctagaactagtggatcccccgggctgcaggaattcgtctcacccctagaaaatagctgctagcttgtgatgccatgctccctcccccatgactgcgactgcgactcggcccgtgtcgtggctctccctcgtctcctcgctctggacggcatgggtggcgtggacgctgcctgtggtgctcgcgacggcggcgccaccggaccggcaaggagcagagccctgctccccgacgctatgcggcggcgtgaacatcttcttcccgttcgggatcgtcgccgaccacgccacggagaccagctgtggattgttcgggttccaggtcctctgctctaacgacaccccctacgtcgggtcctacaagactccgtactcgttccggatcctcaacatcttctacagcaaacgcctccctggctcgtcgccggaacgtccacaaagcttcggcgaccttcgtccaatgtccagttggcttccgccctcccggctcctttccaaagcccttgccaaactccccccgaacagggccaaacaagccttccctcccaaagactccgggccctccccccttttcctccggaatcagagcccccggggcccaataccaccggaacacccggggggtcccttttcccttaagcaaaaacctgagccctttggggaaaaacccccccgccacgaggtggccctacaaggggccatgggtgtttgtcccggtggcaggggagaaaacccccccccccagggggggcccctcccgatggggggatagacacacccggctctctgtttgtccgcgttgggtaaaaaatcagagggaaactcccccctgtggggccccgggggccgtttttgctacccaagggggggcggcccccccccacaaaacgtggtgacccccaagggggaaaagaccaataactcctccccctcttgggagaggggggctgtggccgcaacacggcatgaacaccaaattacgttgtgccgcgcggtgccgccttttttttaaaagagctccccgcggccaacgggtgtcaaatctccctcgcgcgataaattatccaccaggggaggccttcaatccccctttggaagaggagttttcac

SEQ ID NO: 92719 - protein, 226 aa, Zea mays
  misc_feature: Ceres CLONE 1581600
MTATATRPVSWLSLVSSLWTAWVAWTLPVVLATAAPPDRQGAEPCSPTLCGGVNIFFPFGIVADHATETSCGLFGFQVLCSNDTPYVGSYKTPYSFRILNIFYSKRLPGSSPERPQSFGDLRPMSSWLPPSRLLSKALAKLPPNRAKQAFPPKDSGPSPLFLRNQSPRGPIPPEHPGGPFSLKQKPEPFGEKPPRHEVALQGAMGVCPGGRGENPPPQGGPLPMGG

SEQ ID NO: 92720 - DNA, 837 bp, Zea mays
  misc_feature: Ceres CLONE 1581602
  misc_feature: Encodes the peptide sequence at SEQ ID NO. 92721
ctccccgcggtggcggccgctctagaactagtggatcccccgggctgcaggaattcgtctcacccctagaaaaactctctgtcctctcccctgctgccgccccctttcccaaatctggccgcacgacgcaccagccaccaaccgcacacaccccaaactcgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacgcagaaagaggagatactgaagagggagcagtcggcacatctgaatgctatatcagagtatgaaaggcgggaggagaacatgcggaaagcactgggtgttgagaaacaatgtgtcgctgatcttgaaaaagccttgcgtgatatacgagcagagatagctgaagttaaatttacatctgagaaaaagaaacagatgctcaaatctctgaggctagtttggaggaaaatccttggagatcgagggaaaactcatgctgcagatgccaaactgcagaggcaaccgcaagagtctcaagctgatcgtgatttgaa

SEQ ID NO: 92721 - protein, 179 aa, Zea mays
  misc_feature: Ceres CLONE 1581602
MFTPQGKGWTGWSTPTPANQRSGGGAPAASAPLGKGKGRVAELEQELHEYQYNMGLLLIEKKEWAAKFEEISEVLTQKEEILKREQSAHLNAISEYERREENMRKALGVEKQCVADLEKALRDIRAEIAEVKFTSEKKKQMLKSLRLVWRKILGDRGKTHAADAKLQRQPQESQADRDL

SEQ ID NO: 92722 - DNA, 840 bp, Zea mays
  misc_feature: Ceres CLONE 1581603
  misc_feature: Encodes the peptide sequence at SEQ ID NO. 92723
ggccgctctagaactagtggatcccccgggctgcaggaattcgtctcacccctagaaaaaagcacgcataggacgaactaccgatgcaagctgcgatcgatcagtcaccgcatctccggttccgcgcaggcatggacgacaagtcctgctacgtggcaaccggcctctccctggcggccatcctcctcgtcctccaccgcctcgtggtccgtgctggcggcaaggggaacgccgccgcgcggcggctgcctcctagccctcccgccgtcccgttcctcgggcacctccacctgctagcgtcggagtgccctctccactcgtcgctggcccgcctcgcggcgcgccacggccccgtgctctcgctgcgcctgggctccctcgccgccgtggtggtgtcgtcgccggagtgcgccgaggcgtgcttcacggagcacgacgtggcgttcgccaaccgccccaggctgacctcgcaggcgctggcctccttcggcagcgccgcgctggccgtgtccagctacgggccctactggcgcaacctccggcgcgtggccgccgtgcgcctcactctcacgcaccgggtggcgtgcatgtgccccgtcatctcggccgaagtgcgcgccatgctgctcccggatggggcgcgccgcctaagcggccgggcgcgtcccagctcaagggcaatcctgttcgaaactctccccccaaggtggctcttggaaaaccatccgcgccagaacaaaaaatttcctcggggccaaacgaacgcggaaacaacccccgtggtccgccccgaaaggcccacccaaatttccgggccgggaatccttccaacacaaaatt

SEQ ID NO: 92723 - protein, 236 aa, Zea mays
  misc_feature: Ceres CLONE 1581603
  misc_feature: SWISSPROT Homolog: EC 1.14.13.89 Isoflavone 2'-hydroxylase
MDDKSCYVATGLSLAAILLVLHRLVVRAGGKGNAAARRLPPSPPAVPFLGHLHLLASECPLHSSLARLAARHGPVLSLRLGSLAAVVVSSPECAEACFTEHDVAFANRPRLTSQALASFGSAALAVSSYGPYWRNLRRVAAVRLTLTHRVACMCPVISAEVRAMLLPDGARRLSGRARPSSRAILFETLPPRWLLENHPRQNKKFPRGQTNAETTPVVRPERPTQISGPGILPTQN

SEQ ID NO: 92724 - DNA, 1089 bp, Zea mays
  misc_feature: Ceres CLONE 1581604
  misc_feature: Encodes the peptide sequence at SEQ ID NO. 92725
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (58)..(58): n is a, c, t, g, unknown, or other
  misc_feature (59)..(59): n is a, c, t, g, unknown, or other
  misc_feature (61)..(61): n is a, c, t, g, unknown, or other
  misc_feature (874)..(874): n is a, c, t, g, unknown, or other
tttttttttttnntnnnncgtggtgttaatattctctaaaaaagaaagaggcctggcnntntactaatattaatattaattagaactccccgcggtggcggccgctctagaatagtggatcccccgggctgcaggaattcgtctcacccctagaaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcggtgctccaagaccggcggtgtcgacagcctcccgccggggcctccgggttggccggtggtggggaacctgttccaggtgatcctgcagcgacagcccttcatgtacgtggtgcgcgacctccgggagaagtacaggcccatcttcaccatgccggatggggcagcgcaccctcatcgtgggtcacctccgggggagctcatccacgaagccgctgggtgaaaacaggggccccattgtttcgccgaacccggcccgaggaaaaggccccaacccggcctcccttttttaaggggtcggggaaagtgggcaccgtcaaaattccgggcggccccttaaggggccccccctggttggggggggtccttcttggggcccccgcaaaacttttcgtttccgccccataaaaattcttggttcccccccgcccacaccgcgggttcaaaagagggcctttcccccccggggaaatccccggggaaagtggggggccccctctggaaaaacccctccacctttgggtgncccggccccttcctggcggcccaaaagaattctgcggggagggaaaaaggagggccccctggcgcggggttcatgtgtgggcaaagatgtgggccccgccttcacaccaattttggggaaaggaaatcccccccatctctggggaatatgggggttttcgggggggccccaatagaataccccccgaaaaaagagctttctatccccgggagaat

SEQ ID NO: 92725 - protein, 94 aa, Zea mays
  misc_feature: Ceres CLONE 1581604
MDVNDVLLVVLAAALAAMWWRRCSKTGGVDSLPPGPPGWPVVGNLFQVILQRQPFMYVVRDLREKYRPIFTMPDGAAHPHRGSPPGELIHEAAG

SEQ ID NO: 92726 - DNA, 1158 bp, Zea mays
  misc_feature: Ceres CLONE 1581607
  misc_feature: Encodes the peptide sequence at SEQ ID NO. 92727
  misc_feature (58)..(58): n is a, c, t, g, unknown, or other
  misc_feature (70)..(70): n is a, c, t, g, unknown, or other
  misc_feature (719)..(719): n is a, c, t, g, unknown, or other
  misc_feature (745)..(745): n is a, c, t, g, unknown, or other
  misc_feature (838)..(838): n is a, c, t, g, unknown, or other
gttttgggtgtgggtgtgattaattctcattctttcttttaaaccatgggaccaccanccacaaaataanaatattaaaaaagaagctccccacggtggcggccgctctagactagtggatcccccgggctgcaggaattcgtctcacccctagaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaagccacgaacacgctctccatcatcggacagcggcattccgcatgaccaaagtccgacccttgtcaaaaaaacctcggttacccatcgcccggggccggggacccaaggggaatttccttggaaaagcccctttgtcttgcccgggggccttatatttggcccctggaattgggggccaagttttcgggcgggttcgggggtgtttttttgaatttctgggcacaaaccccccacgggtgggccggaaaaaaaaaaaaggtagtgttgccccggggnaaccccccccccaacgacggggtcgnggaaacccaagttggagagacccacacagccccccactttcaaatcttgttgttgggggagggaaataactccccacaaaacaaatagagagnaacagggagggtccgccacttctccaatcccgcgggtggtttaactacctctggcgaaaaaacacccggagggaagggggggggggggaaaacaacacatgtggcacggagggggggcggagactattatatttatataccgccccaagggtgttcccctcctcgatcggggggcatatatcaaacccggcgaggggatgaacctctcagtcgggagagactagcctcccccctcctgcgggaattcttcgggtttcttgagataaaaccacaacgtggaagggtgagaggaatggagagaacacgccacactccccctc

SEQ ID NO: 92727 - protein, 86 aa, Zea mays
  misc_feature: Ceres CLONE 1581607
MASETETFAFQAEINQLLSLIINTFYSNKEIFLRELISNSSDALDKIRFESLTDKSKLDAQPELFIHLVPDKATNTLSIIGQRHSA

SEQ ID NO: 92728 - DNA, 881 bp, Zea mays
  misc_feature: Ceres CLONE 1581608
gcggtggcggccgctctagaactagtggatcccccgggctgcaggaattcgtctcacccctagaaaaacgtccacggagggtgagtcagggcctaagatcaggccgaaaggcgtagtcgatggacaacaggtcaatattcctgtactaccccttgttggtacggagggacggaggaggctaggttagccgaaagatggttataggtttaaggacacaaggtgaccctgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaccaaaagctcgaacgaccttcaacaaaaagggtacctgtacccgaaacccgacacaggtgggtaggtagagaaatacctaggggcgcgagacaactctctctaaggaactcggcaaaatagccccgtaacttcggggagaaggacttctgttctgcccaaaccccactccatccatccaaaataagctttggctaaactttatttatttcctttaccgacaaacaaaaaactggacacgggatcccgcacagaaccaaccaaactcgccccaatcccggctgcctgctgctggcacaacggaactcaattttcacgggcccccccgggcttggcagccattgcagacccagttcccgccctgggcattaaacggggggcggcggacagcgggcgggcacaagcaacaacttccgcccctcgaggagcaaacaccaaagcggggattcccgcaagactgaacccggggggcacagtacttgacgggggcaa

SEQ ID NO: 92729 - DNA, 816 bp, Zea mays
  misc_feature: Ceres CLONE 1581611
  misc_feature: Translation starting site: 171
gcggtggcggccgctctagaactagtggatcccccgggctgctggaattcgtctcacccctagaaaaactagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaactgcaccacaccctcgtacgtcgccttcaccgactccgagcgcctcatcggagatgcggccaagaaccaggtcgccatgaaccccatcaacaccgtctttgatgccaagcgtctcattggcaggaaggttttagtgatgcctctgtccagagtgatattaagctgtggcccttcaaggtcattcccgggcccgggtgagagccaatgatagttgttccgcacaagggggagggagaaacagtttgcagcccaagagaatctcctccctgggtctcatccagatggcgtgagatcgctgaagctttaccttggccgcacgatccagaaatgctggttgtcacgggtccctgccctacttcaacgattcacagaagcaggcccacaaaagatgccgggggtggattgcctggccctcaatgtggcgggcgtatcctccaggaagcccaacccctggcggcctattgcccttggggcctggacaaaaaagggcacccacccgtccgggggaaaaaaaatgtcccccactctttgga

SEQ ID NO: 92730 - DNA, 1049 bp, Zea mays
  misc_feature: Ceres CLONE 1581612
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (38)..(38): n is a, c, t, g, unknown, or other
  misc_feature (40)..(40): n is a, c, t, g, unknown, or other
  misc_feature (58)..(58): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
attttnttttnnnnntttgtgtttgggtcggctgcggngngggggcgggcggggtgcntaacaatnnnnnnnnnnnntggagctcaccgcggtggcggccgctctagaactagtggatcccccgggctgcaggaattcgtctcacccctagaaaaactgtccagcccacgggagggcgactagggttaggggcgaccggaggtccccgcgcctgcccaaatccacccatcccttccgttcaagccgccggagctcccaggccgctggtgtcgaagccgtcgtcccttccttccaggcccgcctcctctctgtccgttctgtcttggtcgacgaagctcaagaccacagtgtcaggaagctctccaatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtagggagaaggagagagatggagaacgggcggcgcctaaacgcgacgttccccgaccatgcctaacgagcatttgcccctggaaaccaaagttctgaaggaaggcagggcaaagggcaaaatggccttgccgcctgtggttggcccccaaacccagccaagaattttggcgcccacccggccccccccaagggggggcccctggtattcccccaaaatggtgggtttgcccaattttggtttgaaaaaagtttttgggcctacctgggtgaaaaacaacacaaatttggttaaattttttggccccggagaaaaagggagaagggttttttggaaaaaaaaaacccaattttcttcagagccccaaatttcctcggttttggcccccttagcgttgaaaagggggaccatccccaggggttggggcccttctccttggaacataataaataaaatagggggggcccctaatggaatccccccaaaaaatacgccaagggcccctttgaaaaaggaaaaaaaaaa

SEQ ID NO: 92731 - DNA, 2544 bp, Zea mays
  misc_feature: Ceres CLONE 1581614
  misc_feature: Encodes the peptide sequence at SEQ ID NO. 92732
agttgtccaattctccaagtggttcagaggagctagcagtacctcacgcggagtacatgagtgttggcactgggcactggcgctgtctatccgcctatcatccctccctcgtcgtcgcctcctcagcccgaaaatctatggccctgagctctcctccctcgccctggcgcaaagtgtagtgtaacgtacgtcaagccatccatccatccattggcagttcggcacccgggcggccggcgggcgcgctgggctgcccgcggctacacgtacgtcgtagtccctcccagtcgtcccggccacaactacacatagacacatggcgcatgatgagccaggtttcgcgtacgcggactacttcgcggcggcggcggccggcgccgtggcgacgttcgtgccggaggtggacgtcgacggcggaggcggtggcggtggggaggggggtcttcacctctacggcctgcagctgcagccgcaccaccagcagcccggggtggagatgtacggggccaggggccacatgccgccggccgcgatgatggcggcgcacggcggcaaggccgcgctcggtctcgacgtcacttctcccgtcgtcggcgggcacttcggcgacgaccacctccggcaggctctccaggcgccgctgtcgctgtcgctccacgacgacgggagcgccgacgccgcgccgctggcgctgcaccaccaccatctcagcggcggcggcggcgtaccgcaggcgcagcagtaccagccgccgggggcgtggccacagccgcagcagcagggcgcgtggcacctgcgcggctccaggttcctgcgcccgacgcagcagctgctgcaggaattctgcaccctgcccgtggacaccaccatcaccagcacgcccgcgaagccagcgagcgtggaggacggcgtcggctcctcgtcctcggcggccccgtcggcgcagataatccaggccatggatgcggccgagctgcagaggctcaaggccaagctctacgccatgctccaagaggtggagagaaggtaccggaggtaccgggagcagatgagggccgtggcggggtccttcgaggcggtggccggggagcgggctgcggcggcgtacacgaggctggcgcagcggacgatatccaggcacttccggagcgtgagggacggagtggcggtgcagatgcaggcggtgcgccgggcgctcggcgagaaggacgcggacgacggcggcgtcgtcccggcggcggccgggatgatggccaacaagggggagaccacgcccaggctgcgggtcatcgaccagtgcctgcggcagcaccgggcgtaccagaccggcgtcgtcctcgagagccagccgtggagaccgcagcgcggcctgccggagcgcgccgtctccatcctccgggcgtggatgttcgagcacttcttgcacccgtatccaagcgacgtggacaagcacatcctggcgcgccagaccggcctgtcacgcagccaagtctccaactggttcatcaacgcgagggttaggctgtggaagccgatggtggaggagatgtactcggaggagatgaagggccccaaggagggcgcctgcagtaacgcgaacagcagcgtgaacactggcgccggctacgcctccgaggagctagggcagccgctggggcacgggggcgcctgtggcgtggtcgtggacgagcagaagccgacgcgggcgcagctggtccacgacgccgggtcgctagactcagtcgtcagcatcggcagcagcagggaccagcagcagatcagcagcatcaacttccgcatgatggaccacctcgacttcgacgcgtacagcgccgaccccgccgcggccggcgggccagcagctgggttcggtggtgctggtgcttccggcggcgtgtcgctcacgctcgggctgcagcagcacgccgacggcgacccccacggcggcgtcaacatcgcgttcgccgcggctccgtcggccgcgcacgagttcctgttcatggcaggcggcggcgagcatcggatggtcgcggctggcgccgtgcacccgtcgtcgtcccacggccacggtcagttcgccgccagcatgcaaggcgacggcgccggtgtggcctcctcgcactaccaccggggcctcggcgccgccactgggttccagctcctccatgacctggccggctgatcgcattagcatggcaagggacggaccctgatgactaggccgatcgagcgctttaattggctttggaggttcacgcgcggccggttgacggggatgtgccaacggcagcagctagccggatggcattggcatgagcgcatggcgctcgcgcagcttgcgcgcttcggatttttgtagggtttagattcctctcgcttcaattcttggcacggtgtctctgtctacatgtgtatctgtatcgcttcggagaatgccattatctgccatggacatggacgtctcttgctccgcgcgaacactagcatctaagaatttttataaaatttactccctaaatcatcatataaaaaaaaaaaaaaaaa

SEQ ID NO: 92732 - protein, 621 aa, Zea mays
  misc_feature: Ceres CLONE 1581614
  misc_feature (158)..(285): Pfam Name: POX Pfam Description: Associated with HOX
MAHDEPGFAYADYFAAAAAGAVATFVPEVDVDGGGGGGGEGGLHLYGLQLQPHHQQPGVEMYGARGHMPPAAMMAAHGGKAALGLDVTSPVVGGHFGDDHLRQALQAPLSLSLHDDGSADAAPLALHHHHLSGGGGVPQAQQYQPPGAWPQPQQQGAWHLRGSRFLRPTQQLLQEFCTLPVDTTITSTPAKPASVEDGVGSSSSAAPSAQIIQAMDAAELQRLKAKLYAMLQEVERRYRRYREQMRAVAGSFEAVAGERAAAAYTRLAQRTISRHFRSVRDGVAVQMQAVRRALGEKDADDGGVVPAAAGMMANKGETTPRLRVIDQCLRQHRAYQTGVVLESQPWRPQRGLPERAVSILRAWMFEHFLHPYPSDVDKHILARQTGLSRSQVSNWFINARVRLWKPMVEEMYSEEMKGPKEGACSNANSSVNTGAGYASEELGQPLGHGGACGVVVDEQKPTRAQLVHDAGSLDSVVSIGSSRDQQQISSINFRMMDHLDFDAYSADPAAAGGPAAGFGGAGASGGVSLTLGLQQHADGDPHGGVNIAFAAAPSAAHEFLFMAGGGEHRMVAAGAVHPSSSHGHGQFAASMQGDGAGVASSHYHRGLGAATGFQLLHDLAG

SEQ ID NO: 92733 - DNA, 1019 bp, Zea mays
  misc_feature: Ceres CLONE 1581624
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (47)..(47): n is a, c, t, g, unknown, or other
  misc_feature (816)..(816): n is a, c, t, g, unknown, or other
gggtgttggtgnnnnntnnnccgaggggtggggaagagggggggcgnctcagttctccatagtcaggcggggttgggttgtttaaaactggactccccgcggtggcggccgctctagaatagtggatcccccgggctgcaggaattcgtctcacccctagaaaaagccgccgccggcctccaactctaaccccgttgcttccggctcccgcagcgtcgccgaccttcacagccggttccttcctccgccaccatggggaagacacgtggtatgggagctgggcgcaagctcaagacccaccgcaggaaccagaggtggggctgacaaagcatacaagaagagccacttgggcaatgagtggaaaaaaccttttgctggatcatctcacgccaaggggatcgttcttggagaaaaatgggattgaaggccaagcagcccaaattcggccatccgtaaaatgctgccccgtggttcagcttggtggaagaaatgggaaaaaaagatttgctggccttttgtgccccaaatggaagggttggccttaaaactaccctccgggggagaaatggatgaagggggtttgagattgcccggaattttgggtccctaaaggggtcccatgcccggttgggggaaaaacatttccccggggggggcacgggggtccaaagagggttgttgtaaagggggggcctctgggggaaatttcccccttgggggctttgtaccccccgctttctcgggggggggtattaagagtggggaaaaaaccccaggggggcccttaaagaaataacaccttttcccgggtaaatntccaaaaaaaatggggggaagaaaaactccccccccaagagaggcctttttgtgcccacaaacagcttgaaaagtgttccggcgcaaaaaaacccacccacgacggggttaaagaacagcagaagagggggcccgccctctatggggggcaaacacaacgatgccacacgaacacaaacacggcgttgtcggctccccccccc

SEQ ID NO: 92734 - DNA, 1330 bp, Zea mays
  misc_feature: Ceres CLONE 1581625
  misc_feature (1)..(1): n is a, c, t, g, unknown, or other
  misc_feature (11)..(11): n is a, c, t, g, unknown, or other
  misc_feature (47)..(47): n is a, c, t, g, unknown, or other
  misc_feature (53)..(53): n is a, c, t, g, unknown, or other
  misc_feature (740)..(740): n is a, c, t, g, unknown, or other
  misc_feature (816)..(816): n is a, c, t, g, unknown, or other
  misc_feature (818)..(818): n is a, c, t, g, unknown, or other
  misc_feature (858)..(858): n is a, c, t, g, unknown, or other
  misc_feature (889)..(889): n is a, c, t, g, unknown, or other
  misc_feature (1011)..(1011): n is a, c, t, g, unknown, or other
  misc_feature (1016)..(1016): n is a, c, t, g, unknown, or other
  misc_feature (1017)..(1017): n is a, c, t, g, unknown, or other
  misc_feature (1103)..(1103): n is a, c, t, g, unknown, or other
  misc_feature (1107)..(1107): n is a, c, t, g, unknown, or other
  misc_feature (1216)..(1216): n is a, c, t, g, unknown, or other
  misc_feature (1264)..(1264): n is a, c, t, g, unknown, or other
  misc_feature (1269)..(1269): n is a, c, t, g, unknown, or other
  misc_feature (1271)..(1271): n is a, c, t, g, unknown, or other
  misc_feature (1296)..(1296): n is a, c, t, g, unknown, or other
  misc_feature (1297)..(1297): n is a, c, t, g, unknown, or other
  misc_feature (1298)..(1298): n is a, c, t, g, unknown, or other
  misc_feature (1329)..(1329): n is a, c, t, g, unknown, or other
ntttttccctnccccccccgcaacgtctgatggatgggtgggagagnagacgncaaggctcgaaggagaggttgtgttatagtggagctccccgcggtggcggccgctctagaactagtggatcccccgggctgcttgaattcgtctcacccctagaaaaaatctcatagagcggggttgcgaggtagttctattctacaggagtagtgctttttcgtctcggtcgccatgtccttcatcgcaggacgaaccgatcatcctcttctccaaactcagggctcgaggtccgtacgcgatatccctgcccggcgatggtgcagactgggtgagcaaggaacaacagacatggtgtcctctggagtgtagaatacccataaaggagcttgcctttgagctagatcggccggcgaacttccacccagcgaaccgggacaggggcgttgaacttgggagggccccggcctggtactgtgaccgagcatgcagtgacacggccaagaaagaatcggaggaagaatgggaaggtacgtgcccatgaaaagttcggccggggtgaaaaaaggctcaaggctccccctgctagccgggcctcccccgcgctccgaacccccgctacctgggtatcaacgcgggcgaaccaggcaatccttgtgcctcccctagaccggggaaagcggtgggagtcgaaacggtaactatccaagaacccgccagagcctgtggcgacacagaggttgcanttccaagacgaaccaccgtccacagagtccccggtgtatcgaggggtaatcagcgccaatatactactctccactncngtatacctatcctcgctcgccggaacaaccagcgggagcntcgtcagagagggtcactcacttccgaggcntcagaaacctccgaaacgatacggcctgctaccaccactacccccttagttttcgcgccgcctctccttctttgtgggtgtgttaatacgttctcgcctctcgggattgccactcacaacanaggtnnctatcccgcacataacaccctcggggggccttatatattctcgcgaggcccgccacaagcagacccgctactaccgcatatgcgtngtcncaccaccactttcgcctacccggtcgacgaccatgcaaactttcgccggggtattctcgggagccgccctcagcacagtgtgacgagacccacatacataggagagggngaggaaaaaactcgccacgtccgcggcgcaaggtgatgatataactcntccgngncatccagcgcgctaccacacccgcnnnaccggactttcactgtccactctctatcctnt

SEQ ID NO: 92735 - DNA, 807 bp, Zea mays
  misc_feature: Ceres CLONE 1581626
  misc_feature: Encodes the peptide sequence at SEQ ID NO. 92736
ggagctccccgcggtggcggccgctctagaactagtggatcccccgggctgcaggaattcgtctcacccctagaaaaaaccttccattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcgtcctcttcctctaagcccacctccctttcccactccctcccctccaagcactcgctggccccaccccccgccgcatccgcatcctcccgtcgcggtctcacccccgtacccgcctccgcctccgccgccgcggctccagcgccggatccagtgccggttccagcaccggctccagcgccggctccagcaccggccgccccgccgtagaagcccgcgctgcaaggcgcggccatcaagccgctcctggcctccatcgcgactggcgtcctcatctggctcatcccgccccccgccggcgtgcccccgaacgcgtggcagcttctagccatcttcctctccaccatcgtcggcatcatcacccagccgctgccccctcggcgcggtcgccctcctcgggctcggcgccgccgtgctcagcggcacgctcacgtttgccgcggccttctcggcctttcggggaccccatcccctgggtcatcgcgctcgcctttcttctttgggaagggggttcaatcagaccgggcttcggcttccggcgtcgccttaaggctttcgtcggccgcccttcgggtcctccctcc

SEQ ID NO: 92736 - protein, 103 aa, Zea mays
  misc_feature: Ceres CLONE 1581626
MASSTAASPLTCHHLGSVGARPRLPSLSISLRRRSSSSSKPTSLSHSLPSKHSLAPPPAASASSRRGLTPVPASASAAAAPAPDPVPVPAPAPAPAPAPAAPP

SEQ ID NO: 92737 - DNA, 1232 bp, Zea mays
  misc_feature: Ceres CLONE 1581628
  misc_feature: Encodes the peptide sequence at SEQ ID NO. 92738
  misc_feature (13)..(13): n is a, c, t, g, unknown, or other
  misc_feature (14)..(14): n is a, c, t, g, unknown, or other
  misc_feature (20)..(20): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (1232)..(1232): n is a, c, t, g, unknown, or other
gtgggggggggtnnctcctnccgctgcgggggggcgtggtcaactcggaaggggaagaagaannnnaaaattgtttgggcaaagctgagactccccgcggtggcggccgctctccaactagtggatccaccgggcggtattaccccgtctcgcccctagaaaaaggaaaccatgttcctaccaaccacgggatattcccccccccacgagcagtggagctcggcagcgaagctccgaagttctgcaatggcgacgtcccacatcatcctgccccaagaagaggaggaggagacagctgcgagcacggcggcggaggtcggaatgcggagcagaggcggatgcggacgacgacaacggggcgtaccacaagcacggacccgggaaagccacgctgcccttctccgcgacatgcgtccggatctgccaagaatattaccctaacctgcacgcacagaaaaacgcgtcgagcaccacacttgccgacgatgacacacgacttatcaaagcgcgaggagggcgactaacagataagaaactcacacgatcctcccaggaacttcaccgcaagaccttcccgggaaactccccacctgttcccgagatccctcaaggaaaggagcgacccgaggcgggattgcaaaaacgcgaaaaagaaaaatattgggttggccccaatgtgagaagagaggaattaccgggggccccccgtataaaaagagttgggagaagcttcgccaaaaaaaaaaaaaccacggctcccaaggcaaaacgaaagagcttcccctacgttatcctccccacctagaaagacccctctgggaaaacacccccccggtatacaaaaaaagaggaaggtgggaaaattgtccctggtaagaattgtaaaaaaaaaaagaagaaacacagccaaaaagaggtgtatgggcaaactttggggataaatccccgcgggaaaagagaacaggacgccatttatgacacaccctgaggagaggggcgccaaatcataacgcgggggaaaaaaacacgcacaacagagagtggaggctttttgacatggagaagatggtgtcccacaaaaaatagtgtgtactcacgcgcggaaggataacaagtggcccaccttcccccacaaaaatagaaggaaaatggggcgcctcccagggggaggtggaaatatgttggggaaaaacataagagcgtgctcgcgccaaagacaccggccaagtgcn

SEQ ID NO: 92738 - protein, 64 aa, Zea mays
  misc_feature: Ceres CLONE 1581628
MATSHIILPQEEEEETAASTAAEVGMRSRGGCGRRQRGVPQARTRESHAALLRDMRPDLPRILP

SEQ ID NO: 92739 - DNA, 763 bp, Zea mays
  misc_feature: Ceres CLONE 1581630
  misc_feature: Translation starting site: 213
  misc_feature: SWISSPROT Homolog: EC 2.7.7.4 Sulfate adenylyltransferase
  misc_feature (763)..(763): n is a, c, t, g, unknown, or other
ggagctcaccgcggtggcggccgctctagaatagtggatcccccgggctgcaggaattcgtctcacccctagaaaatcagacaccagacgcagtcggctgccgcagactggtagtagccggcgcgccgtcaccgtatcctcagatcagcggcgagcagaaaccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggctgccgagatgaacaagcggtcattcaagtatgcgtgggtgcttgacaagctcaaggctgagcgtgagagaggtattacaattgatattgcccctgtggaagttcgagaccaccaagtactactgcactgttattgatgccccgggacaccgtgacttcatcaagaatatgatcactggcacttcccaagctgactgtgctgttcttatcattgactcaaccactgggtggttttgaagctggtatctccaaagatgggcagacccgtgagcatgctctccttgctttcacacttggtggtggagcaaatgatttgctgctgcaacagatggatgctactacacccagtattcaaaggcccgttatgatgagattggggagggaggtctcttcctacctgaaaaaggtggatacn

SEQ ID NO: 92740 - DNA, 1121 bp, Zea mays
  misc_feature: Ceres CLONE 1581631
  misc_feature: Encodes the peptide sequence at SEQ ID NO. 92741
  misc_feature (64)..(64): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
tggtgggggggtttttcttcgtgtcggggggggtgtataaaattatttaggttatagtgggaanaaaaggnnnnnnnnnnnnaaaactggagctccccgcggtggcggccgctctagaatagtggatcccccgggctgcaggaattcgtctcacccctagaaaaatcagacaccagacgcagtcggctgccgcagactggtagtagccggcgcgccgtcaccgtatcctcagatcagcggcgagcagaaaccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggctgccgagatgaacaaccggtcattcaagtatgcgtgggtgcttgacaagctcaaggctgaccgtgagagaggcattacaattgatattgcccctggggaaagttcgagaccccccaaagtatctcctggccctggttatttgatgccccccggggacacccccggaactttcattcaaaaaattatggatcgacctggggcccctttccccaaagctgggacccggggggcatgagtttccttttttccatttgggacctcccaaccccccctcgggggggggtttttctttgaagaggccctggggggggtattcctcccccaaaggggggaaatggggggccccaaaaaaaccccccggggagaaagaccaaagggcccccctcccgctctgtggccttttttcacacacactctttgggggtgggggggataaggccagaaattgggatttttggccctggccttgggcaaaaaaaaagatatagggaaatgggcgtaacctcacaccccccccccagagttaattccccacaaagggggccccgctttatttgagtaaaaaaattttgtgtggaaaaggaaaatgttcttccttgtcctaagccctggaaaaaaagaggtttgggaataaacaaaccccgtgaataaaaagagcaccctttcggtttcccaaatcctta

SEQ ID NO: 92741 - protein, 123 aa, Zea mays
  misc_feature: Ceres CLONE 1581631
  misc_feature (5)..(117): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNNRSFKYAWVLDKLKADRERGITIDIAPGESSRPPKVSPGPGYLMPPGDTPGTFIQKIMDRPGAPFPKAGTRGA

SEQ ID NO: 92742 - DNA, 2560 bp, Zea mays
  misc_feature: Ceres CLONE 1581646
  misc_feature: Encodes the peptide sequence at SEQ ID NO. 92743
aatatccgccacctcggggggtccctccctcctcggcctcgcgcgcgccttcccacacatcctcctcccccccacgccacgaaacgccaaagggagggagcccgagcctagcaggagcagcgcaaggaaacaatggcgcgggaggagcaggagcagtccgcattgggcgccgcccacgtccaccaccaccagcctccggccggcggatgcggcctctccgccaaccccaccgccgccgcagccgagtacgcccacgaacagggctacagtgtcgttctgcctgagaagctgcacactggaaagtggaatgtgtacagatctgcacattctcctctaagattaataaataaattccctgataacccggagattggaacgctgcatgataattttgtatatgcagttgaaactttccgagattgtagatatttgggtacaagaatccgcccagacgggacagttggagactacaagtggatgacgtatggagaagctagcacgagcagaactgcaataggttctggtcttatttatcatggaatatctgaaggtgcacgaattggtctatattttataaacagaccggagtggatcatacttgaccatgcttgtgcggcatactcatatgtatctgtgccgctttatgatactctcggcccagatgcagttcagtttatagtgaaccacgcaacggtagaagttatattctgtgtgccccaaactctaagcgctattttaagctttattactcaaatgccgtgtgttcgtcttattgtggtggttggtggagatgattcaaatatgccatctgcaccagcaactactgaatgcaaaattatgacgtacaacaggctacacaatgagggaaagatgagtcctcaaacttttcgtccaccaaaacctgaagatatagccactatctgctacaccagtggcactactggcacaccaaagggagctgtactttctcatgagaacttaattgcaaatgtagcagggtcaagtttaggcattaagttttacccctctgatgtgtacatctcgtatctacctttggctcacatctatgagagagctaaccaggttgcattgcttcactatggtgttgccattggattctaccaaggggataacttgaagctgatggatgatttggctgttctgagaccaacaatattcgcaagtgttccccggttatataacaaaatttatgctgcaattacaaatgctgtgaaggagtctggggggttgagagaaaggttgtatcatactgcatacaatgccaagcgacatgcaatgataaatggtagaaacccatcacctatgtgggacaagttggtatttaacaaaattaaagctagacttggtggacgaatgaggcttatgacttcaggtgcttctccattgtcaccagatgtcatggaatttttaagaatatgcttcggtgaagttcttgaagggtatggaatgacagagacatcttgtgtcatcagtacaatgaatattggtgacagatcaattggacatgttggatctccaaatccttcttgtgaggttaaacttgtggacgtcccagaaatgaattatacttcggaggatcaaccgtatcctcgtggagagatttgtgttaggggacctataatattctgtggttactataaagatgaagtccaaacaagagaggtcattgatgaggatggttggttacatactggagacataggtttgtggctgcctggagggcgtctaaaaattatagataggaaaaagaacattttcaagttagctcaaggagaatacatagctccagagaagattgagaatgtctatgctaagtgcaagttcattgctcaatgctttatatatggtgatagtttcaactcttccctagttgccattgtagcagtcgaaccggatgtgttgaaggcttgggctgcatcagaaggaatccagtacgaggacttgagacagctctgtgctgatcctagagcaacagctgctgtcctggctgatatggattccattgcgaaggaagcacagctgagaggtttcgagtttgctaaagcggttactcttgttgctgagccgttcacattggataatggccttctcaccccaacattcaaggtcaagaggccgcaagccaaagcatactttgcaaaagagatctcagacatgtatgcacggttgctagagacagagttagctaggtcgaagttgtaacttgtgcggtatcaggagaagggccatcaatacagccgtacaggagattggattctgcatttttttattccacctcacgaaataagtagtaaaatctttttactgatacgggaaataacggatcatgccatgctccggagtcgatagtttttttcaccagacggggcagtgcttggcgcatgctgaatatatggttctagttataaagaaatgtttttacagagtgtatattgggtctgaacagctgccctggaaggtagttcacagaaaatatattggtattacaaatgcaatactaaaaaaattgtgtcttccgatcgaaaaaaaaaaaaaaaaa

SEQ ID NO: 92743 - protein, 696 aa, Zea mays
  misc_feature: Ceres CLONE 1581646
  misc_feature (117)..(577): Pfam Name: AMP-binding Pfam Description: AMP-binding enzyme
  misc_feature: SWISSPROT Homolog: EC 6.2.1.3 Long-chain-fatty-acid--CoA ligase
MAREEQEQSALGAAHVHHHQPPAGGCGLSANPTAAAAEYAHEQGYSVVLPEKLHTGKWNVYRSAHSPLRLINKFPDNPEIGTLHDNFVYAVETFRDCRYLGTRIRPDGTVGDYKWMTYGEASTSRTAIGSGLIYHGISEGARIGLYFINRPEWIILDHACAAYSYVSVPLYDTLGPDAVQFIVNHATVEVIFCVPQTLSAILSFITQMPCVRLIVVVGGDDSNMPSAPATTECKIMTYNRLHNEGKMSPQTFRPPKPEDIATICYTSGTTGTPKGAVLSHENLIANVAGSSLGIKFYPSDVYISYLPLAHIYERANQVALLHYGVAIGFYQGDNLKLMDDLAVLRPTIFASVPRLYNKIYAAITNAVKESGGLRERLYHTAYNAKRHAMINGRNPSPMWDKLVFNKIKARLGGRMRLMTSGASPLSPDVMEFLRICFGEVLEGYGMTETSCVISTMNIGDRSIGHVGSPNPSCEVKLVDVPEMNYTSEDQPYPRGEICVRGPIIFCGYYKDEVQTREVIDEDGWLHTGDIGLWLPGGRLKIIDRKKNIFKLAQGEYIAPEKIENVYAKCKFIAQCFIYGDSFNSSLVAIVAVEPDVLKAWAASEGIQYEDLRQLCADPRATAAVLADMDSIAKEAQLRGFEFAKAVTLVAEPFTLDNGLLTPTFKVKRPQAKAYFAKEISDMYARLLETELARSKL

SEQ ID NO: 92744 - DNA, 817 bp, Zea mays
  misc_feature: Ceres CLONE 1581648
  misc_feature: Translation starting site: 241
  misc_feature (615)..(615): n is a, c, t, g, unknown, or other
ctccccgcggtggcggccgctctagaactagtggatcccccgggctgcaggaattcgtctcacccctagaaaaactctctggacgaacagaaaggttaccagcagcaccacggcgagatctccccttggcgggccaaaaccgacggcgagcttcaccggcgttggtcggctcccatctcttcgccgttttattttcctcccaggttaaggttgcaggcttttagcttgggattctgaaagatggggacctcttctggcgcgaatttccatcagcaacctcctccgacccaggggatgttgcctccaaggcatggtccacgcccctcagggttgcagacctcgctctcgctggcctcttcggagcaggttggctcgcctgacatgcaggagcctggttcaaactcggagccagggcatgattccgccactgagagcgccagttccaaagacacatggccagctgagccgaaccagagcaatggtggggtggctgccagtgatgttgtgagtaaggcggcggagaaggaggtggcaaatggtgtatccaagccgcaggttatccatggaccctcctccccgtgtgagtgggatgcttctgcgggaggttgcacgggnagagggttgatctggtcgctgaagagatgaagatgatgtcggatgagcacctagaggaaggtcagaatgagctcaggtcgattctggagggcactggaggttctcaccacatcgaagagttcttgtacttgcagaagcttgtccaggacaagcatgattttgacacatcccatgcttcagtggcacccatgtgcagcctgag

SEQ ID NO: 92745 - DNA, 1132 bp, Zea mays
  misc_feature: Ceres CLONE 1581649
  misc_feature (48)..(48): n is a, c, t, g, unknown, or other
  misc_feature (49)..(49): n is a, c, t, g, unknown, or other
  misc_feature (55)..(55): n is a, c, t, g, unknown, or other
  misc_feature (57)..(57): n is a, c, t, g, unknown, or other
  misc_feature (58)..(58): n is a, c, t, g, unknown, or other
  misc_feature (68)..(68): n is a, c, t, g, unknown, or other
  misc_feature (69)..(69): n is a, c, t, g, unknown, or other
  misc_feature (775)..(775): n is a, c, t, g, unknown, or other
  misc_feature (776)..(776): n is a, c, t, g, unknown, or other
ggggggtggtgtttttttccgcgggagaggggcgcggggggagggagnnaataantnnaaatatattnnatttaaaactggactcaccgcgtggcggccgctctagaactagtggatcccccgggctgcaggaattcgtctcacccctagaaaaactctctggacgaacagaaaggttaccagcagcaccacggcgagatctccccttggcgggccaaaaccgacggcgagcttcaccggcgttggtcggctcccatctcttcgccgttttattttcctcccaggttaaggttgcaggcttttagcttgggattctgaaagatggggacctcttctggcgcgaatttccatcagcaacctcctccgacccagggggatgttgcctccaaggcatggtccacgcccctcaggggttgcagacctcgctctcgctggcctctttcgagcaggttggctcgcctgacatgcaggaaccctggttcaaactcgggagccagggccatgaatttccccccactgaaaaagcgccaggtttccaaaaaaaacaactgggcccagacttgaaccccaaaacccagaagccaaatgggggggggggtgggccctgccccaactggaaatgtttttgtgaaaattaaaagggcggggccgggaaaaaaaaggaaggggtggggcgccaaaatagggggggggtaaactccccaaaaacccccgcccagggggtttttatttcccccatgggggggaaaaccccccttctccccttttccccccnnttgggttggagaaaccttggggggaaataagtgccttttttttttttcggaggggaaaaaggaggttttgtcccacccacggggggaaaaaaagagggggttttaaaacccttcggggcgccccccccttgggagaaaagaaaatgtaaaaaaaaaatttgatgttttcccggaaatgtagaaaccacccctcgtctaagaagaggagggtccacaaagaaaagaaagactccccaggggggtggaatttcttctggggaaggggggccccgggtgagaagggtttctcctcccccccactctcaggggaaagcttctctttgaaaccgtggggaaaaaacttttgttcccaagga

SEQ ID NO: 92746 - DNA, 887 bp, Zea mays
  misc_feature: Ceres CLONE 1581650
  misc_feature: Encodes the peptide sequence at SEQ ID NO. 92747
cgctctagaactagtggatcccccgggctgcaggaattcgtctcacccctagaaaaaattttccaagggctctacacgaagttaggcggccaagtgttcgcaaccaacccctcttcctcgcccactgaaaggttcagaggctcccgttttagcatagcgaccgagacgaaggagtgggggggcggagagctttgggccctggccaggatgaagtttatgagactcggcacccggccggacaccttcttcgccgccgccgactccgtgaggtctgtctgcacggaggtggccacggacctgcagatcctcgtggataactgcctctaccatctccacaagttccccctgctctcgaaatgcatgctcctgcaagcgctgtgcgccgacgccggcgacgtcgtcgtcgagctcccggggttcccgggcggcgccgaggcgttcgaggcctgcgccaagtactgctacggcatccccatcacggggagcgcgcgcaacctggtcccgctgcggtgcgcggcggggcacctcggcatgtgggaggccgccgaaaggggcaacctcgcggccaagctcgaagcgttcttcgcctccgtgcctcctgggcccctggaaggacgcgcctgggggtgttccactccaagggggccacatggccccggttctggggaggaaactggggccctctctttccccgctgggtgttaacgcccttggggccgccccttctgttccccagccccgggaaaaccggcgccgcaaacgtccaaggttcagggggttcccccgtggggtggggggcccaacaaagttccccccaaagatttcgggggtgtaaacacatccttctctgggggggatatcagggggggcgccccctctccaagggc

SEQ ID NO: 92747 - protein, 165 aa, Zea mays
  misc_feature: Ceres CLONE 1581650
MKFMRLGTRPDTFFAAADSVRSVCTEVATDLQILVDNCLYHLHKFPLLSKCMLLQALCADAGDVVVELPGFPGGAEAFEACAKYCYGIPITGSARNLVPLRCAAGHLGMWEAAERGNLAAKLEAFFASVPPGPLEGRAWGCSTPRGPHGPGSGEETGALSFPAGC

SEQ ID NO: 92748 - DNA, 1077 bp, Zea mays
  misc_feature: Ceres CLONE 1581654
  misc_feature: Encodes the peptide sequence at SEQ ID NO. 92749
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (36)..(36): n is a, c, t, g, unknown, or other
  misc_feature (45)..(45): n is a, c, t, g, unknown, or other
  misc_feature (627)..(627): n is a, c, t, g, unknown, or other
  misc_feature (673)..(673): n is a, c, t, g, unknown, or other
  misc_feature (733)..(733): n is a, c, t, g, unknown, or other
  misc_feature (751)..(751): n is a, c, t, g, unknown, or other
  misc_feature (829)..(829): n is a, c, t, g, unknown, or other
  misc_feature (831)..(831): n is a, c, t, g, unknown, or other
  misc_feature (851)..(851): n is a, c, t, g, unknown, or other
  misc_feature (852)..(852): n is a, c, t, g, unknown, or other
  misc_feature (880)..(880): n is a, c, t, g, unknown, or other
  misc_feature (888)..(888): n is a, c, t, g, unknown, or other
  misc_feature (941)..(941): n is a, c, t, g, unknown, or other
  misc_feature (942)..(942): n is a, c, t, g, unknown, or other
  misc_feature (978)..(978): n is a, c, t, g, unknown, or other
  misc_feature (997)..(997): n is a, c, t, g, unknown, or other
  misc_feature (1055)..(1055): n is a, c, t, g, unknown, or other
ttttttttnnnnttttatttagttattttttgtggntcttgttcntaaaggcccgggccgaggggaggtttattacttgcgtgaggtcccgcggtggcggccgctctagaactagtggatcccccgggctgcaggaattcgtctcacccctagaaaaacgtctcatccctccggacgacttctgacctggggcacactccgctgctccgccatggcgatccgctacgaggcctggatcatcatgctactcgcgctggcctgtccgctctccgcccaggaggacgaggagcccaccgccgcggcggagggcgaggccgtgctcacgctcaacgtccacagctacgacgatgccgacgccaagcaccccttcatggtcttcgagttctacgccccctggtgtgggcactccatgaaacttgctacagactatgagaatgcggccaacgtacttatctagctatgaccagtcgattggtctcgctcaggctgatgccttcgtaggacaaagaccgggcctctttgctaccaaggtaagagaatacacggggttcccttacccatcaacaatctttccggggacccacggggaaaggaaccatttctgagaaatacaaacgggccccgtanggggaggccttgattggccctttggtgcgaatttaacctttgacgnaattccaagggttggccccccctgaaagtttgaaaagggaagaaacaaagagttccgcgnaaaaaaaaaaatgggcgnaacgggggcccccccttttttcggagatgagaacccatgcctgggcctttcttccccttttgctaccacaaaatccgntnccgcatgatatatattgggnnggggcaccccgcgaattttatacaagancctttccntgggggaagggtttgctcgaatgaacacctttagggctcgtgacttaaaaaannttagcgcacccacacattcggaagtgtaccagcccncaactcctaacgtgggggnaaccagaccaaccctgaaaccggcgatgtggtatagggtgccgtcaacccttttttgntggacctttctttttataacgg

SEQ ID NO: 92749 - protein, 81 aa, Zea mays
  misc_feature: Ceres CLONE 1581654
  misc_feature: SWISSPROT Homolog: EC 5.3.4.1 Protein disulfide-isomerase
MAIRYEAWIIMLLALACPLSAQEDEEPTAAAEGEAVLTLNVHSYDDADAKHPFMVFEFYAPWCGHSMKLATDYENAANVLI

SEQ ID NO: 92750 - DNA, 822 bp, Zea mays
  misc_feature: Ceres CLONE 1581656
  misc_feature: Encodes the peptide sequence at SEQ ID NO. 92751
  misc_feature (625)..(625): n is a, c, t, g, unknown, or other
ctccccgcggtggcggccgctctagaactagtggatcccccgggctgcaggaattcgtctcacccctagaaaaaacagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagagccatcctgatatcccttttggcttcctcattctagtagtttaggaattcttttctgaccactttgatctgaccaatctctctggcctgctgcttcctgattatcgaccagttcccccagtcttgctccttggactccctcctccctcatctncagcattgtgttctgattcactgctccaatggctgttctttctgctgctgatgctccccggtctcagcttatcgggttgaggctatgagaaacgcctgagatcccatctctgaagcactgtctttgtgaccctaggggggtggttgggtgcctcctcaggcccaaatgactctgtctggatctgcagggggcaaacg

SEQ ID NO: 92751 - protein, 61 aa, Zea mays
  misc_feature: Ceres CLONE 1581656
  misc_feature (1)..(51): Pfam Name: AdoMetDC_leader Pfam Description: S-adenosyl-l-methionine decarboxylase leader peptide
MESKGGKKSSSSRSMMYEAPLGYSIEDVRPAGGVKKFQSAAYSNCAKSHPDIPFGFLILVV

SEQ ID NO: 92752 - DNA, 1073 bp, Zea mays
  misc_feature: Ceres CLONE 1581660
  misc_feature (14)..(14): n is a, c, t, g, unknown, or other
  misc_feature (58)..(58): n is a, c, t, g, unknown, or other
  misc_feature (60)..(60): n is a, c, t, g, unknown, or other
  misc_feature (61)..(61): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (728)..(728): n is a, c, t, g, unknown, or other
  misc_feature (729)..(729): n is a, c, t, g, unknown, or other
tggtggggggtttnttttatatcttttaatgggtttggtggttgagggttggagaggngnnacaaaannnnaaaagctggagctccccgcggtggcggccgctctagaatagtggatcccccgggctgcatgaattcgtctcacccctagaaaaaacatcgccccgaccaaagcttccccagacggcaggagacagcagcaggccggacgccggactcctcctccctcccccgtacgcatccactgagatccttcctgtgcgaaggaaatctccagttcttcggccccggccaggttttcaagtgttgcttgccccgccggagttttcctctaacccgcaagtccaattggctaagaagttgatgggatcggggggacactggaaggctgtgtgagatcgcgaaggggaccgtgaattccttgcagggctgcggcgattcggctgcgctgctgtatgaactgtttcgtgaaactggggactcaactcgaactcgaaccactacgtcgcctgccctcctcatcttcctggctgcatttcttccccccagttggttaaatccatcccaatcctaattcaaaatagtaaattgtggaaaggaagttcaacaaaagcttgcaccagaatgggcgaaaacaaccagcctcattatggggtgaaaaaaggcctaagggagaaaaagcccaaccacaacaacccaatcctggcctaaattgggttaaattggganngggggggggggttttttgcctgggggtacccttggcctggcctggccctgaaatgctctcctcccaaaaaaattggccattccccttccccaggggtttaatttcctccccgggaaaaaccccccgcgggaaaatgggaaattgggggggggcaagaaaatttctcaccacgcgaacaccacacccctttttggggggttttccccggggtccaatttttgtgggaaagcattctcttggggcttccccatgggggggtctcggtgaaaaaaaaaaattcgccttgggcgcccccaattaatttgggaaagggctttggaaattttcccacggtgaccgcccaa

SEQ ID NO: 92753 - DNA, 1306 bp, Zea mays
  misc_feature: Ceres CLONE 1581662
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (77)..(77): n is a, c, t, g, unknown, or other
  misc_feature (1038)..(1038): n is a, c, t, g, unknown, or other
ttttttttttggggggttgtttttatacttctgctgttacggacagggtgtagaatatnnnnnnnnnnnnnnnatantggggctccccgcggtggcggccgctctagaactagtggatcccccgggctgcaggaagtcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccggccgccgggtcctcctagggtttcgccgcgatgtcggctccgccgagcgagcgggagcagatgcggaagggcaacctcaggctgacggtagacgccggaagagagccgccgccgccgcgggggccagatggtggacatcctggaggtcaagcccgagggaaaggctccggaggaaagggccagcgtaaggggttaccgcgccccccccggcagggggggccgccgcatggggcgtctgcaatcgtggcagcgtggatgaaggctccgcggggggctccgccgggcaaatgggtggaaatggccggtgccgcttgctgggggaagcgggcgcggccagtaggtctgtggggggccaggcgttttgttgattttcaaggttacttctggccagttgccaagcgtgagagcaagagagtccacccccgggtatcgctcaaggatgcgcgtggtggactgcacacccggaggatgagggggggggggcctgacgaggtgaccttgcgggcgcgggagggtcggtggttcgtggcgcgatggtggaagttgggggtattcctttgacaaatagtgtaatacaatggccacagacactgtatgctgttttgctccttaccacatttcgtgggttggtgattgagcctcggagaaagggggtagacggcgagagatagagaggattattcctgtcgtggcgcggtggagtgtccttcaaaaagaggcgcgcacctgacaacatcgacacagacaatactaancacccgataacggacgtcgccgccggggacctctttggcgtctgtagtgggctgcatccgataaagtcactggcgatccaggggcggtgacgagacaatttgtgcacggtgcttgggagctatgccttccgattcggatggatgagtgctgtggctacacattgggcagcatgggcggatgaatcgcacacgtccgtgtgattgttacagtgtgtggcgcgtggagtacggggggtgatgtgcgcgaggcggagggtgccggcgcccc

SEQ ID NO: 92754 - DNA, 825 bp, Zea mays
  misc_feature: Ceres CLONE 1581664
  misc_feature: Encodes the peptide sequence at SEQ ID NO. 92755
  misc_feature (738)..(738): n is a, c, t, g, unknown, or other
  misc_feature (787)..(787): n is a, c, t, g, unknown, or other
  misc_feature (799)..(799): n is a, c, t, g, unknown, or other
  misc_feature (800)..(800): n is a, c, t, g, unknown, or other
  misc_feature (808)..(808): n is a, c, t, g, unknown, or other
  misc_feature (814)..(814): n is a, c, t, g, unknown, or other
ctccccgcggtggcggccgctctagaactagtggatcccccgggctgcaggaattcgtctcacccccctagaaaaaacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgaatcagttgtagctggtgaatttggcaagactcaatttctctcatctgagttcagaaacgtttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcactgcagcctgctgaagtctttacttgctgcattctgtgctcacttttgaaagctgctctcttctgctctgcgttgttgatttctgcactcaagcttctcttgcctgtgcactcaagcttctctcttcctgggcaactagtgatctccttgaaagcattcagcttttacctagagatctttctgttgntgaaagcaagagaggctttagggtgatggcgcaaactagcctgcctccntggttttcgttnnccacccancgatgntgagctcgttt

SEQ ID NO: 92755 - protein, 29 aa, Zea mays
  misc_feature: Ceres CLONE 1581664
MSAEVAGGHPYFLSCYFWFIYCIKFRDFT

SEQ ID NO: 92756 - DNA, 1159 bp, Zea mays
  misc_feature: Ceres CLONE 1581665
gagggggtgtgggggggggccctccccacccaaccaactccaatacgtacgtgggattagggaaaaatataatttatatgtgtaaataatggtactccccgcggtggcggccgctctaaaactagtggatcccccgggctgcaggaattcgtctcacccccctagaaaaacccacacaaccgcacctcgcacccattgaccagacggcggcgctcatctcctcccccacggttctccccatcggcctgctggcttctccccggcttccccgatactgatcctcatcactcatgtctgctgaagttgctggaggacacccttatttcctctcgtgctacttctggttcataaactggcataaaatcccgagattttacttgatacaaagtgggaacactcagagttttgtgcgaatactgtcctaccatgtgaaacagtctggtagctgggtgaatttagcaaaaactcaatttccccccaatctgaattccaaaaaaccctctgccttgggaccccccgcttttcccttggagttccttggcaaaaccggaaggttttcccccaccctctgctatttcccgagaactttgaaccaaaaaaatcctctttttttgggttccctaggtcaagcccctccgcaatataactcccccctttcccaaaaaaaaactatgtccccctaacgaagggttttggggaatttaggccccctgggccctttgtctcttgctttggggcaaatccgtactcccaccaccctagctctataaaagatgccccaccctctatcgctgtggcgggcggagaaaatttctctctgtgtgggcgcacctcaccgtgttttttgatagaaaaagcgtggggagggtctctcttttttatatgcctcacggtgacgagaaataaattgggaaaattaccactgcccaccacccaaatatagaattagcgccactggcgccccggggcggacacacataatgcactttgtttttcttttgttttccccggggaggaaaaaataataagtgggtaactcccccctagaaaaaactaggtttcacaactttgtttatcccaagatagagaatctttgttcatctcgggctgacaaaagggctcaaaacagaggtatttttggggggggataacgcccccc

SEQ ID NO: 92757 - DNA, 1104 bp, Zea mays
  misc_feature: Ceres CLONE 1581666
  misc_feature: Encodes the peptide sequence at SEQ ID NO. 92758
  misc_feature (13)..(13): n is a, c, t, g, unknown, or other
  misc_feature (74)..(74): n is a, c, t, g, unknown, or other
  misc_feature (75)..(75): n is a, c, t, g, unknown, or other
  misc_feature (83)..(83): n is a, c, t, g, unknown, or other
  misc_feature (1104)..(1104): n is a, c, t, g, unknown, or other
ttttttttttttnttgttttgggggggtggtgggggggtggggggttatttttttttttcgtgggtgacgtgtnntggggggngaggagtcacgcggtggcggccgctctagaactagtggatcccccgggctgcaggaattcgtctcacccctagaaaaagacccccttccccctgacgcctcgcgaagccatcatcttccaaaccctcgccgcagccgcagccgcagccgcagccacccttgcttccgcacgatagtgcccgggaccagccttctatggcggcgtcgctgctcctccgcgctgtgcgccgaagggagctcgcgtcccctctcggatccctgggtgccaacttacagtcaacatgtgctgccaacatatgctcaaaatggggaaattttgcaagaccttttagtgcaaaagctgctggaaatgaggttattgggattgatttggggacaactaactcttgtgttgctgttatggaaagaaagaacccaaaagttatttgagaatgctggagggtgcgaagaacaaacaccatcctggttgtcgcattttactcagggagggttggaaaagaactttggtttggtactcccagcccaagcggccagggcagtaaacccaatcccccagaaataacttttccttttgggaaacaaaaaaagggatggaatgggggccgaaccccttttgtattgaatcccccccggaccccccgaaaaaggaaaaatggaaaaaaattggggtggccccattaacaaaaaaattcgtgggaaaggggctcccccaaaagtgggggggaatgcgcttggggggtttgaaaaaaacacaacaggaaaggtggcaaaaggcaatttaccttccaccccgaagtctccagggggccggggtgtgcctatttttgtggcctcggacccacaggatgtgaaaggggggaaacccgccttgaaaatcctttacacctttgggggcaaaaattcaccttcctccaaaaggggggaagggggatttaactggtgtttccccagccttttattttcaaagggaagagggcccagcgggtgccggggccccaaaaaaaggagaattctgtgggccn

SEQ ID NO: 92758 - protein, 77 aa, Zea mays
  misc_feature: Ceres CLONE 1581666
MAASLLLRAVRRRELASPLGSLGANLQSTCAANICSKWGNFARPFSAKAAGNEVIGIDLGTTNSCVAVMERKNPKVI

SEQ ID NO: 92759 - DNA, 1148 bp, Zea mays
  misc_feature: Ceres CLONE 1581667
  misc_feature: Encodes the peptide sequence at SEQ ID NO. 92760
ttggtgtgggggttttttttccccagaaaggggagagataagagagataatatgaggagctgagaaaaatgagcgcgcccggagagaggtcaattgttggcggcctttctagaatagtggatcccccgggctgctggaattcgtctcacccctagaaaagtttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggaccacacgttggcccaagttcctggggcgtgggaaccgaaagacaatccaagaagatccgtgcccccttggggggctaatggttctttcctgcaatccgtcctttcaaactaacaaccaatccctggcggaggaatacccaaaagggaaccgtgacctttccgtccaatccacccccccccaaaggggggccaggccagggccgcccgcaaaaaaatctaatgtccccggggttctccctctccagaggaaacccccggggggggtggcaaaacaccccctgggccacccccatttggggggaagagttagcgcgacgccttttttaagagggagcggcccgtctctgtagcgaccccacaaggcactccgcgcccagaaaaatgttccccctctcttccccaagaggggagaggagggtctttctttttctattaacaccgcacggtgcaagttctgtttcctcgctgttgtaatatcggaccccttttttctatgaggggggcgcctgtttcgccccactgagagggtgctttttataacccccattgggcgggcaggaaaggccgtgtctcccaccccccatacttggggcgtgggcatgtagaattgcagtgccccttagggctcttgtatggcgggggccccggagattttctcttgggaaaaccatg

SEQ ID NO: 92760 - protein, 120 aa, Zea mays
  misc_feature: Ceres CLONE 1581667
MESGLVASHRLRVPPPSASAGHHHLIRHRHAHAPVAAAPLRLSLPRHLPRSTPLRLPAALPLRHCLPPLRAASAAAAAVPAPGDHTLAQVPGAWEPKDNPRRSVPPWGANGSFLQSVLSN

SEQ ID NO: 92761 - DNA, 911 bp, Zea mays
  misc_feature: Ceres CLONE 1581669
  misc_feature: Encodes the peptide sequence at SEQ ID NO. 92762
tccccgcggtggcggccgctctagaactagtggatcccccgggctgcaggaattcgtctcacccctagaaaaaaggctgaaatccaccttgcctgcgtggccctcctccccatcgcgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaaactgttcgtgtcggacatgataacctcagtgggggaaattatccgtcttggagggcgattcacctacaatccaaaggttatgaaggaaacagctgggacggatgggttatggaccccgggattggagaaaaaagaagccctcctttccggttgaattggggacccgggaaattcctgggaaaacatttttggaacgggtatcccggcggcccctccaaaaaaccccccgcctattaaggccaggggaaggggggatttttcccccgggggggggttccagttcccgggcccctgggaaaaaagatgtttttgggggggaatttcccccccacccaaaaactgggggtgtggggaaattgctccccccgggggggggaaattatttccccccccgggttttttaggaaacaccttggggggggcccccctggggggctctcccccccgggtgtcttggggggaaaaaaaatgttattgtgtgcccgcgggggggggagaaacccgtgggggggaaagggggcataatttgggtttcttggggcgaaaaaaaaaaaatttccccgcgccccccacgc

SEQ ID NO: 92762 - protein, 120 aa, Zea mays
  misc_feature: Ceres CLONE 1581669
  misc_feature: SWISSPROT Homolog: EC 3.6.3.14 H(+)-transporting two-sector ATPase
MAYGDRVTTFEDSEKESEYGYVRKVSGPVVVADGMGGAAMYETVRVGHDNLSGGNYPSWRAIHLQSKGYEGNSWDGWVMDPGIGEKRSPPFRLNWGPGKFLGKHFWNGYPGGPSKKPPAY

SEQ ID NO: 92763 - DNA, 1191 bp, Zea mays
  misc_feature: Ceres CLONE 1581674
  misc_feature (1)..(1): n is a, c, t, g, unknown, or other
ngtggggggggtttttttttgttcttgataacaacaccagccctcggggcgctcataccagttggaaatttaaattggaactcccgcggtggcggccgctctgaactagtggtcccccgggctgtgagattcgtctcacccctagaaaaagcctgtctgtcgcctcgtgacgtctgtccaagaacactcgctccccacctgttcgctgcttcttcttcttgccaatctgctccttcttctagctagatcttggatggagctggagatgacgatggaggtagcgaagatcatcgaggtatgtggagtaggcggctgcttattaagttcacaaggccaagcaagcgagctccagcttcgtccgatgcatagatgcgagctgtagcatgcgggcagccattcatcagttgtccgaattcttaaatttcccccccatgcccccgactaccaggtgggtggggttaggccaaatttcccagccaagtaacccacaccccggtccctcttagggtaagccgtgtgggggctttgggaaccccgtttccttaaaagggtgggccctggggggcttgggggggggcggttgggcgggggtttcccgggggtacttggggggtagttttccccccgagcggtgcccccttttccaagtcccaactcgcgggggggcccccggagcgaggggtgacacccgtggatggggggggccccaatgggccgcaaagggggtgtggccggacctagggggaggaatggtgatggggtgcgggcgcccggtagcgtgagctcgcccttattaggggccgggcccggtggggtaaacacagcctccccgcgtgtatgcctctaggaggaccccgagactactagttattctcgggcggcgtcgccttgtgactcttgcgggtatagagacgcccagggatcgccctctgagaaaaaaccacacgcccccaaatatatttgagttctgcaccgggagccgaccctttggtggaggggggctaccccacccaggggaagaggtgtgattccgcgcaacccacccactcgtgctccgatggtcactgaaacacaccctctaccccgtgggggagaggaaccatcaacgttgcggcccctggtggttgagtgcgggacgggagttgagcggctgctcccgggttgagctctctgttttactccaaaaaaaag

SEQ ID NO: 92764 - DNA, 973 bp, Zea mays
  misc_feature: Ceres CLONE 1581675
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnngggggnnnggtgcaagctgggactcaccgcggtggcggccgctctagaatagtggatcccccgggctgcaggaattcgtctcacccctagaaaaagcctgtctgtcgcctcgtgacgtctgtccaagaacactcgctccccacctgttcgctgcttcttcttcttagcaatctgctccttcttctagctagatcttggatggagctggggatgacgatgggagtagcgaagatcatcgaggtatgtagagtacgccgctgctagttagttcacagggcagcaagcgagctccagcctccgtcgatcaatgatgcgagctgtaccaacgtggcaccattcatcacgtgtccgatccttaaatcccccccatccccccctctaaattggggggtttgccaaaccccccccaacccggaaaacccccccccaaacgaaaaccctgggcccttgggatcccccctttttaaaaaaagggggcccccggggggctcccgcgggggggtttttccccccccggtttttctggggggggcccccgccccgggttttttttccccccggggggggggggggggttttttttttttgcgccccaattataggggggggggccccaccggggggggggggttcccccccccccgcggggggggggggcccccccccccccttcttaattaaaggggggccgcccccccggggggggggggtgtttttaataaaaaaccccccccaaaaaaaaaaaaaaccctcttttattcccccccccggggggggaggacacccccccccccccccccctcttctggggggcgccccccctttttttttttttcccccccacaccacccttgtgggggtgtgtaaaaaaacacttttttcccccccgcggg

SEQ ID NO: 92765 - DNA, 810 bp, Zea mays
  misc_feature: Ceres CLONE 1581677
  misc_feature: Translation starting site: 151
ctccccgcggtggcggccgctctagaactagtggatcccccgggctgcaggaattcgtctcacccctagaaaaaactcctccgtcctccctccgcgtttacacccgccgccactcctgccttggcgccgtagctagcaaaggcgatatccatggcgagccctgcacggatcgagctggacaagctgagcgtggagcagctcaaggggctcaaggagcagacggatctggaggtcaacctcctccaggacagcctcaccaagatccgcaccgccgccacccgactcgagaacgcctccgccgcgctccaggacctatccctccgcccccaagggaagaagatgctcgtgccgcttacggcgtccctctacgttcccggttcactggacgacgcggagaaggtcctcgtcgatgtcggcaccggttacttcatcgagaaaaccatggctcaggggaaagaatactgtgaaaggaaaattaatttattgaagtcaaattttgatgaattggttgaggtggctacgaaaaagaaagccatagcagacgatatgggtttgctactacaagccaagctgaggcaagcgtcaccgggccccaagtcatgagagctggatgcacacctcgtctaccttcctcccaactcgccgtcgtcttctgcggttctgccgtctacgcctccaatttggcctctctcccctgcaagccatgggtaaggagaagtccacatcaacattgtggtcattggccacgtcgactctggcaagtcgacaccaccggccacctgatctacaagcttggaggcattgacaacg

SEQ ID NO: 92766 - DNA, 785 bp, Zea mays
  misc_feature: Ceres CLONE 1581684
  misc_feature: Encodes the peptide sequence at SEQ ID NO. 92767
  misc_feature (432)..(432): n is a, c, t, g, unknown, or other
ctccccgcggtggcggccgctctagaactagtggatcccccgggctgcaggaattcgtctcacccctagaaaaaacacacccaattcctcgcaactgggctcccccgcctccacgaaccacgacactgccccccgcctcaagttcgccgtctccattcctcagctctcctctcctctgtagtctgcctgtacctattggctgaagcagagctgacccccactttatcaagagttgctcaacaatggacactggctgcctgtcatctatgaatattactggagctagccaggcaagattttttgcggggcaacttcctcctcagagatgttttgcgagtagtcactatacaagctttgccgtgaaaaaacttgcctcgaggaataaaggaaggagatcacaccgtagacatcctgccttgcaggttgtctgcnaggattttcaagaacctcactagaaagcacaataactatttggaagctggacagctctcctcattttttttagaaacagcgaacgccccaataagccgtttcaagtcctgggttccggggccaggattggctggtccatcaaaaaccaaaatatctggggaaaggctggccataaaacccatatggcttgaggcaaaaaaattttttgggggggaaaaggaacccgccttggaaaggatgaaaaaatggggaaattggttcccaaaaaagggggccctccaaaaactctttaaaacccgggttggggcgaaactttatgggtataagagggaaacctttttatcacagggggg

SEQ ID NO: 92767 - protein, 70 aa, Zea mays
  misc_feature: Ceres CLONE 1581684
  misc_feature (64)..(64): Xaa is any aa, unknown, or other
MDTGCLSSMNITGASQARFFAGQLPPQRCFASSHYTSFAVKKLASRNKGRRSHRRHPALQVVCXDFQEPH

SEQ ID NO: 92768 - DNA, 1204 bp, Zea mays
  misc_feature: Ceres CLONE 1581694
  misc_feature (13)..(13): n is a, c, t, g, unknown, or other
  misc_feature (14)..(14): n is a, c, t, g, unknown, or other
  misc_feature (17)..(17): n is a, c, t, g, unknown, or other
  misc_feature (1143)..(1143): n is a, c, t, g, unknown, or other
gggggggggggtnnttntccatcgtgtgtaatcaaatcacaccactccacaatcgtacttagaaataataatgaaagatgaactcaccgcggtggcggccgctctataatagtggatcccccgggctgcttgaattcgtctcacccctagaaaaaaccaccaccagtctgtcccgttccccacctcaccctcttcttccctatactcgggctacacctgcgaccactgctcacccgtcgcggccatgactcccgcatccacctcccctctcgccgccgccgtcctgcccacgaacttatcttccttctctcgctggcccacctccgcgcctcccgcgcatctcctgcctggcagcgccccaacgcggggggcaaccatgcgtcgaacgcctccgccggcaccgcaacacccaaggtgggggtgcctccgttatccgccccccctccacgggggccgttattgcccgcctcctatgcccaccctcccccccggaacctggagacaaattttgtagagcccaaaacaggggggggcgaaaatttcggccatttgggctccttgcccccccaagatttcgagcttcgggcccaatattcccaaaaaaaggggctgtggcccaccgttttaaagaaagaaaacctttcagggggggggccaaagatttttaaaaaatcccggcttgaaatttttgaaaaagaaagtcctcaaaaattttccatcggtgggtggtctcccgcacatatttacaaaagggagtgtggcgcccctacccctcgttgagaaaaaaagggggatgtgtgcggcgccttcttactaatgagcggcaagaaatatctttcccgcctgggggggatcctcgaaatatttttgggaggtgggtaaaacacaccgctgaagacgggaacgccccgactcggggtatgtctctaagaagggttaggagactagacccccttatagaagatagtagcccgtgtttccttggttgaacgagagaacagatccccccccgacgcacccgctaagggaatactctgagggatggaataacccctccttcttggaaagaggggcccgaacctctccctatgaatagcggcgtgctctttctgatacccctatacagccagaaaaacacgggcntcttattgttaaaaattttctcagatgtggggatacacaactccccaccggcacaaggggg

SEQ ID NO: 92769 - DNA, 1063 bp, Zea mays
  misc_feature: Ceres CLONE 1581695
  misc_feature: Encodes the peptide sequence at SEQ ID NO. 92770
  misc_feature (11)..(11): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (60)..(60): n is a, c, t, g, unknown, or other
  misc_feature (76)..(76): n is a, c, t, g, unknown, or other
ggggtggtggncnnnnntccctgcggccactataacaccgtaaccgtatatgcttggttntaaaacagcagaaatnaaaactgggactccccgcggtggcggccgctctagaatagtggatcccccgggctgcttgaattcgtctcacccctagaaaaggccggtggccgccactccacgctccacgacattcaccaccaccacggcaccaccctgtcccttcagctccaacgtgcatgagagacgccactcgcggtacccacgcggcggcagaggcgctggcggcccgtcgtccgcgccgagcaatggcgtccccactgctctgcggctgcgccctcctcctctacctacttggccacctcgcgacctgccacgccgccagggacaccatcacgccgagcagcccgctggcggccaacgagacgctggtctcgggcggcgacggcaacttcgcgctgggcttcttcaccccgcccggcgccaacagcacgtacctccggcgtggtggtacaacaaaggtctcccctccgcactgtgggggggggggtgggccaacccgcgaaggcccccaaattcgccggggcgcccgtcgggggaacaaaccccggggcgccccaacgcctggttcgggtctctccggggcggggggggcaacccctgggcccattttgccccggcgggggggaaagcggggaacccccgggggggggtgtgggggcccccgtccccccgggaaaaacgcccgtttccacaacaaaagggcggggtctgtggcaaaaaaacccccgggccccgcccccacaaaatcccccccgaaaaaagggggggcaaaccctggggggggccttaaaaaaaaaacaggggtgcccgaggcagggcgggcgggggccccccctggggccctggggggaaaaaggggttttctaacttacccccaagcggaaacactcctggctccccccgaaaaaataaaaaccttggggggaactcaacccccccgggaaagggggaaagaaacccgggaaccccttaaccctccggggaaaaaaacccccctccgaaa

SEQ ID NO: 92770 - protein, 252 aa, Zea mays
  misc_feature: Ceres CLONE 1581695
MASPLLCGCALLLYLLGHLATCHAARDTITPSSPLAANETLVSGGDGNFALGFFTPPGANSTYLRRGGTTKVSPPHCGGGGGPTREGPQIRRGARRGNKPRGAPTPGSGLSGAGGATPGPILPRRGGKRGTPGGGCGGPRPPGKNARFHNKRAGSVAKKPPGPAPTKSPPKKGGANPGGGLKKKTGVPEAGRAGAPPGALGGKRGFLTYPQAETLLAPPEKIKTLGGTQPPRERGKETREPLNPPGKKTPLR

SEQ ID NO: 92771 - DNA, 1147 bp, Zea mays
  misc_feature: Ceres CLONE 1581697
  misc_feature: Encodes the peptide sequence at SEQ ID NO. 92772
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (75)..(75): n is a, c, t, g, unknown, or other
  misc_feature (83)..(83): n is a, c, t, g, unknown, or other
  misc_feature (86)..(86): n is a, c, t, g, unknown, or other
  misc_feature (791)..(791): n is a, c, t, g, unknown, or other
  misc_feature (1101)..(1101): n is a, c, t, g, unknown, or other
nttttnnnnnccccnnncccccccacaatacccagcgacccgcacgaatggaaagaagaaaggacaaagagaganaagtaatntgngtggaactccccgcggtggcggccgctctagaactagtggatcccccgggctgcaggaattcgtctcacccctagaaaaaagctcccaatcccaagatgaatgctacgtaagtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgaccacgacaacgagcatcctgtgttggctgagcttctgcggctggcttcagcaaccgtgagggagcatccagagtcattgcttcctcagtgcaggcgacggggtcatgcaaggggttggaaagggcttcggtcttggaggaagcgaaacttggaaacaaaccttgaagctggtcaaagcatcggaatgccgccaacatgaaaagccaatcgtcaaaaggaaagatgggggccgtttctcccttcaccggggtgggccggcccggttccgcccgcttttccaaaaaggggccacatattatgggtgcgcacccaggtatacaaaggggacccccaagaataggagcccccgaaaaangacccccaaaacaacatttgtggcgtgtttgtaaaaaaaaaaagaggcaccctgttccactaagcccccctccagaaggggaaagaccccgcccgtgttttccacaaagggcgaatgcagtgggatagtcgtaggtcgcggggacaccgcgtgtctcaataaatagaaaagaccgaggggcgaactgggaagccgctcctccttttcagggggaaagccctagtttgggggtgggaaaagaaacaaaaacctccttgtgcgcacaaaaagatcgggtaaaacccctctcgaacgtttcaaaaaaacgaanagtaccccccactgcttcaagggaggttaccttcgaaattcacaca

SEQ ID NO: 92772 - protein, 130 aa, Zea mays
  misc_feature: Ceres CLONE 1581697
MGEAEEAPGDSNGEALELLMSMASSSLACSVSQFPAKWQSIKDKLQLLCCSLNSLCGGGGDHDDDHDNEHPVLAELLRLASATVREHPESLLPQCRRRGHARGWKGLRSWRKRNLETNLEAGQSIGMPPT

SEQ ID NO: 92773 - DNA, 1015 bp, Zea mays
  misc_feature: Ceres CLONE 1581700
  misc_feature (15)..(15): n is a, c, t, g, unknown, or other
  misc_feature (84)..(84): n is a, c, t, g, unknown, or other
ggtggtgggggtttntttttttccccccagcccgggagcaattctactataaaaaaagggaggggttttttttaaagaggaaanaaaaattggggctccccgcggtggcggccgctctagaatagtggatcccccgggctgcaggaattcgtctcacccctagaaaaatcaccgccgcggccacctgcgtccgcccgtcccgacctccgtcctccacctccggcaccgtcgcggccccctgaacgcagtccgattccagcctccgccagcccgcccaccagccaccggcttccggcctccgtccgccggcggcggcctctgctctccgcccacctggccacctccgcatccggactcagcctccggtgtccggtgtccgcccccgcagtgggcgtgccgcactgggctgaggaagaacagcttccagttcctgctgctgatcttgaacggcgcggcgctcaggtccgaggaggcctgccgaccagactgaggtagcagaaggagccataccaaaaaaagaatcttcctccgccactgtcgactcccatctgcgagggtagcttcacgccaatgcagtcagtggcgcgatgaacgtccctggtagtacgatccatatcaaggaggaaattttcctgaagacaaatcgaaggagtactttgcatccacggcaactatggaaaatggaatcggcggccttaaacccccaaaggggaacacctttctttggctggcctggcaatgcctcaaaatgcggtaagcctgtcaattaattctggcggacctttctgtaaaacaaggggggggctttggccaaaaaagaattttccggtggatttaaaagatttaagcaacccggcgaccctaattaaaacaaggtggtgggtcccctggttcccaaagggtattaggcccccccgggttttggctttgtgccctccctggccttacctgaaacaaaggatccattttgacccaccctttgtggggaatagttggccccaaccctgggggggaa

SEQ ID NO: 92774 - DNA, 947 bp, Zea mays
  misc_feature: Ceres CLONE 1581706
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (31)..(31): n is a, c, t, g, unknown, or other
  misc_feature (32)..(32): n is a, c, t, g, unknown, or other
  misc_feature (49)..(49): n is a, c, t, g, unknown, or other
  misc_feature (50)..(50): n is a, c, t, g, unknown, or other
  misc_feature (54)..(54): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (65)..(65): n is a, c, t, g, unknown, or other
  misc_feature (68)..(68): n is a, c, t, g, unknown, or other
  misc_feature (73)..(73): n is a, c, t, g, unknown, or other
  misc_feature (74)..(74): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
gggggggggggnnnngttttgttaacggggnnttcttcgctcgctcgcnncgcnnctnnnngggntgngggtnntnnnnnnnnttcnnnnnnnntnnnggctggaactccccgcggtggcggccgctctagaactagtggatcccccgggctgcaggaattcgtctcacccctagaaaaaattacaaacagataagaatgtgcatgaagattcactaatagctcctgattttccatcatcaagcaatcaagatggcttgcctgtcccatcaagcaatcaaaatggatcacatgttcatttttcaagcatcaaagcagatgaggaagaatctgatacatcggatgagattgtcccagttgtggttcggcctggtcacattcgctttgaaccagcaggtggagaacccgacaaatcgccagcaaaggagttacagggcacgttccaatggagtgcaacaatgagcaaaaagaagggccagaagtggggaatgaatagctcaaacaagaaaaatgctgatatcggctatcatgcaggaatagctggatgcagcacagaagttaacaatcatgtcatggacattaaggttactgaaaatggcttttgtgctgtcaataatcgaaggaacaatgaaggcagtaacattgagatgtccagtgtgcaaaatattgctaatgaagaaaagtctagcgaacctttcaattttgagagcttgtaccccctaacacgacttcccaaaggagggagatctgattgcctacccgattgggttgagctgtccttcccatggtggtgtcccggagctctccttctaaccgggggggggaaaaaattcctggttatatgaatccccgttatcaattgcggtattcaattccccggaaaccccgttttcaaagaaagaatccccaaatcccccaaccccgggggggatataaggaaaaaaccaa

SEQ ID NO: 92775 - DNA, 1088 bp, Zea mays
  misc_feature: Ceres CLONE 1581711
  misc_feature: Encodes the peptide sequence at SEQ ID NO. 92776
  misc_feature (10)..(10): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (29)..(29): n is a, c, t, g, unknown, or other
  misc_feature (42)..(42): n is a, c, t, g, unknown, or other
  misc_feature (43)..(43): n is a, c, t, g, unknown, or other
  misc_feature (57)..(57): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
gggggggggnggnttnnttttcnncntcnctttgtcgtgtgnntatttttctctcangatgcgatatanaannatttagtttggtcnnnnnnnnnnnnntaaactggagctccccgcggtggcggccgctctagaactagtggatcccccgggctgcaggaattcgtctcacccctagaaaaaagccgagcgcgcttctccacttccacggagacaaaaactcgatctcccgggccccacctccccgcccgcgcgccagcgacacggagaagcttccggtttccagccggcccgcctccaccgactcttcctttcccaccggccgtcgaggcgtccaggcggattagcggagagcgtcggggcggcgagatgtgggtgttctacctgatatcactgccgcttacgctgggcatggtcgtcgtcacgctccgctacttcgccggccccgccgtgccgcgttacgttgtcatcaccgtcggatatgcttggttcagctccctccccatcatcatcctcgaccccgccgacatctggcagacattaactgggcagtgccaaagggtgggcttgggattccttttgggaactgggtcttatttggaaggacaatttttccccaaccatggggggttgtgagttcccctaactttcccaagggccttttgaagggaccgcctggggaaaactttcccgggggttaaaaaaaaaagggcgcggaaaaaaaccttagccaatttcccattattgggaacccccttaccctttttttcctcaatttccaaattgggtggggagggaaacccctttttggggccccttaaatttgggggcgctccataaaccaaacctccctataaaaccaactccgcactaaaaagcctttggggaaatgggcggggtaattgtgggcggggcaactttggaaatgggggcaatggcaccccatatttcccttttcgggaatttgggagaaaccggtgggcccttttcccctccccggggtttctgggggtttaaggagaaaagttttccgaaaaataaatttcgggaaaaaatgtcgaatgggggtctcccccggcccaaaaaaa

SEQ ID NO: 92776 - protein, 88 aa, Zea mays
  misc_feature: Ceres CLONE 1581711
MWVFYLISLPLTLGMVVVTLRYFAGPAVPRYVVITVGYAWFSSLPIIILDPADIWQTLTGQCQRVGLGFLLGTGSYLEGQFFPNHGGL

SEQ ID NO: 92777 - DNA, 796 bp, Zea mays
  misc_feature: Ceres CLONE 1581715
  misc_feature: Encodes the peptide sequence at SEQ ID NO. 92778
ccccgcggtggcggccgctctagaactagtggatcccccgggctgcaggaattcgtctcacccctagaaaaaaaccactctgctccactccgccatggccacctccctcctacgcctctctcgccaccgccgcgcgctgctcgccatctcctccgtccgccttgcgctctccacccagccccacgtcccatctccgtccccatcccctaccccctcctccgcccgccgcctcccgcatttcctctccttcctcgccgccgccgccgccgccgccgctgggggagcaaccgtcgcgctctgcgactccggcctagatcaccgggtcgggggcaaggacagcgccgatctggtggttcgtggggagcggaagttcgtgccgcaggagttcatcgacgagctcgcgtccttcctcggggacaacatcactctggactacgaggagaggagcttccatggcacgccacagaacagcttccacaaggcggtcaacctgcctgatgtcgtcgtgttcccgagctcgcaagatgaggtacaaaggattgtgatggcctgtaacaagcacaaggttccaattgtaccatatggtggggctacctcaatagaggggcacacactggcacctcatggtgggtgtttgcatcgacatgacctttgatgaagaaataaaatcccctgaatgttgaggatatgggacgtagttgttgaacctgggagttggaatgaatagaacctgaaccaatacctgaaagccctatggggctaattttttcctccttgaatcaaggaaaggtccctt

SEQ ID NO: 92778 - protein, 186 aa, Zea mays
  misc_feature: Ceres CLONE 1581715
  misc_feature: SWISSPROT Homolog: EC 1.1.2.4 D-lactate dehydrogenase (cytochrome)
MATSLLRLSRHRRALLAISSVRLALSTQPHVPSPSPSPTPSSARRLPHFLSFLAAAAAAAAGGATVALCDSGLDHRVGGKDSADLVVRGERKFVPQEFIDELASFLGDNITLDYEERSFHGTPQNSFHKAVNLPDVVVFPSSQDEVQRIVMACNKHKVPIVPYGGATSIEGHTLAPHGGCLHRHDL

SEQ ID NO: 92779 - DNA, 821 bp, Zea mays
  misc_feature: Ceres CLONE 1581719
  misc_feature: Translation starting site: 174
  misc_feature (405)..(405): n is a, c, t, g, unknown, or other
ctccccgcggtggcggccgctctagaactagtggatcccccgggctgcaggaattcgtctcacccctagaaaaaacgcactcgctcgctcgctctcatacccagctgacaacgaagaggtttagagagagagagctgagagaatggccgacagcaggagaagtgtagtgtacgatgctgaaggcggcgacgatcatgagaggcaagggacggcgtggacggcgacgtcgcacatcgtggcggcggtggtgggctccggcgtgctggcgctggcgtggacggtggcgcagctggggtggggtggtgggtcccctcgtgctggtgggcttctcttgcgtgacctactacacgtcagcgctgctcgcagactgctaccgctacccggaccccgtccacagcgccgtcnaccgcgagtacatcgacgccctccgatgctacctggaccggaagaacgtggtgctgtgcggggtgcgcccagtacgtggaaactgtggggcactctcgtcggcttcacatcaccgccagcgcaagcatgatcgcgattaagcgcgtcaactgcttccaccggggacggctacagcgccgccgggctgcaacccgtcggggagcacgtacatggtgggtgttcggtctcctcccagctcctggctgtcgcagcttgcccagcctccccaacattcgcctggcctgttccgtggggggccggtggacaccctccctggggctacttccttcattcagcccgggggccggggctcccgcccagttgggcctttcgccacgggcggggccaccttggccgcggcaccccctgttccgggg

SEQ ID NO: 92780 - DNA, 821 bp, Zea mays
  misc_feature: Ceres CLONE 1581720
  misc_feature: Encodes the peptide sequence at SEQ ID NO. 92781
ggagctccccgcggtggcggccgctctagaactagtggatcccccgggctgcaggaattcgtctcacccctagaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccaccacccttctggtggtgctgcctccaactctggaccagtttctaatgctgtcggtcgctccaactactctggttctatttcgtctgcaattctaacactggaggatcttctaggacaaaaacaattctgggactctcaatagcatggagaacaacaaagagggcatctggcccccaatctggtggagtaaccccgatggccgtcagaactctgggcctctgcctcctgtacttcctacaactggcctaatcacatcagtcctatccactctggtcaggtaaattcatcgggtgctcacg

SEQ ID NO: 92781 - protein, 127 aa, Zea mays
  misc_feature: Ceres CLONE 1581720
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPPFWWCCLQLWTSF

SEQ ID NO: 92782 - DNA, 876 bp, Zea mays
  misc_feature: Ceres CLONE 1581723
  misc_feature: Encodes the peptide sequence at SEQ ID NO. 92783
  misc_feature (572)..(572): n is a, c, t, g, unknown, or other
ctccccgcggtggcggccgctctagaactagtggatcccccgggctgcaggaattcgtctcacccctagaaaaatccatctcttccccacgcgcacaacaaaagatctcagagccacacagcgagcgcgagcgagaggcgcgctgttgcggaaatgccgctcccggcgttcctggcggcggcggcgaggctcgcggtcctgctggccgccgccgtgactgcggccaacgcggcctccttcgcgcgataccggcgccgccacctccgccgcatccccaaccccatcgacgagtccgccgaccccgtcgccgacttccacgccctccgccccgcctccgccgaggacgccgcagaagatgacagcttcttctttgggctagcgaccgcgccggcacatgtggaggacaggttggaagacgcttggcttcagtttgcggtggagcactcctgcgacgacaaggaggccatgcgcgaccctacgacagcagatgcggtgatggcgtccgctgcaggggacggaggtgctcagttggcttctcgtaggtcgtccagaggggatgatgataggtggtngggttgtggagaaaattttaagaaaacctttttaagattgccatggggagcgatggctcaggggggtttgaaaatgtttgctggaggggggtgaagttaagggtccggcggctggtggccggggacagttgccgccaccaccgttgccggcttggcacaatgtccccttgccccgcaagaaagggctaaagttttgggcctgatccctgatacccggggtgaaaccttggctaagggaaccggggatccgggtgcttccccttgggggatggtttgggacaggggttatgccccaagggaaccc

SEQ ID NO: 92783 - protein, 170 aa, Zea mays
  misc_feature: Ceres CLONE 1581723
  misc_feature (140)..(140): Xaa is any aa, unknown, or other
MPLPAFLAAAARLAVLLAAAVTAANAASFARYRRRHLRRIPNPIDESADPVADFHALRPASAEDAAEDDSFFFGLATAPAHVEDRLEDAWLQFAVEHSCDDKEAMRDPTTADAVMASAAGDGGAQLASRRSSRGDDDRWXGCGENFKKTFLRLPWGAMAQGGLKMFAGGG

SEQ ID NO: 92784 - DNA, 960 bp, Zea mays
  misc_feature: Ceres CLONE 1581724
  misc_feature: Encodes the peptide sequence at SEQ ID NO. 92785
  misc_feature (5)..(5): n is a, c, t, g, unknown, or other
  misc_feature (6)..(6): n is a, c, t, g, unknown, or other
  misc_feature (33)..(33): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (75)..(75): n is a, c, t, g, unknown, or other
ttttnntttttttttcttcttcttctcccaaangaagtagtaatggggggtggggggtgttgggttcnnnccntnttaactggtactccccgcggtggcggccgctctagaatagtggatcccccgggctgcaggaattcgtctcacccctagaaaaatccagcctcgagcaccgggacctgccgcgtgcttcttactggcaacttggcaagtggcacggccgcacggatccatctccatcgtcgaggcgaggacgaggaagcagatcgaagcacccaaccacaccacactggtggtgagtggttgctggcgatggcgatggaagcgatgatgagcgggctcaactccggcgtggtgctcagcctgatcgccgtgctgtggacggtggtgtggcagaacctgcagcacctgcagctgcagcagttcttcgcgcggcagctgagccggcgcgcgcggcggctggcggcgatggtggacccgtacctgtcggtcaccatcgccgagtacgagggcgggcggatgaagcgcaccgacgcgtacgaagaggtcaaggcctacctcagcgacgccagcgcccacggcgtgcgccaccttccgggccgagtccggccaaggacgccgacaagcctcgtgctcagcatgttcggaccgccaaggaagtgggaagaacaacttccaagggcccccaaggggtcctgggtgggtggggcctaacttcaaaaaaagccgcccccgcttcgaaggcccccccgcttttgttagaatccgggctgtgggggggccgggcagcccataaaaaaacccccaattttttaccccccccttttttcccggggaaaaccacaagggtacgcttttgtgcttggaaaatatatccttcccggcggtgaccgccaaaagggaggcccccccccttccattttggataaaaaaccccccactgaaaataattgtttacct

SEQ ID NO: 92785 - protein, 133 aa, Zea mays
  misc_feature: Ceres CLONE 1581724
MAMEAMMSGLNSGVVLSLIAVLWTVVWQNLQHLQLQQFFARQLSRRARRLAAMVDPYLSVTIAEYEGGRMKRTDAYEEVKAYLSDASAHGVRHLPGRVRPRTPTSLVLSMFGPPRKWEEQLPRAPKGSWVGGA

SEQ ID NO: 92786 - DNA, 1052 bp, Zea mays
  misc_feature: Ceres CLONE 1581726
  misc_feature: Encodes the peptide sequence at SEQ ID NO. 92787
  misc_feature (63)..(63): n is a, c, t, g, unknown, or other
  misc_feature (72)..(72): n is a, c, t, g, unknown, or other
  misc_feature (82)..(82): n is a, c, t, g, unknown, or other
gttttgggttggtggtgtgttagtatttatttccattagtggttctggcttgcgcgggggggntttctgttntaaataaaantgggactccccgcggtggcggccgctctagaatagtggatcccccgggctgcaggaattcgtctcacccctagaaaaagtgcctccctcgggcctcgcttctcgcgctcttcctctcttgcctccgcctgcctccaggctccaacaacccgggagggcgccgtccgcccccgcctccgggagcgatgatgatcgcgcgacgcctgctccgacccaatgcccccgcccaggcaagcagcttattgaagcatgtaactggcaccgcaagtttgcaaggctatgcggatagcttgttggatgcgacagtcagacattttggttcagcaccgtctgcccagcctgaagaaaatgggttcaagggccacggcatgctggcgccttttacagctggctggcagagcaatgatttgcacccctctgatcattgagagatctgagggttccctatgtctatgacattaaatgggaaacaagtatctggaaccctctttgcaggattatgggtgcacaggctttagggtggtaagcgaagcctcgatttagtcaaaggcagcctactggagcaatttaaacaaaacttaccccttttctacccattccctttctgggaaacccggaaccaacaaaaaaccctttccgttgggaatcttttgcaacagggaaggatcccctttaagcaaggttttcaccttgcccaaggggaagaaaggggggaaaaagttttttcctttcccaaaaaacagagggggtttccggaaaaccaaaaagggacctcctccaggggccacaaaactaggttttggggaatttattaacccaattccctcttgggggggagggccccaaaccccgaaacaaaaattttttttgggccccgatccaaaaaggctttttcctggggaatctacacaatgggggttttcagcggaaggcccaaaaacgtggggcctttcctgtggcccagaaaacct

SEQ ID NO: 92787 - protein, 80 aa, Zea mays
  misc_feature: Ceres CLONE 1581726
MMIARRLLRPNAPAQASSLLKHVTGTASLQGYADSLLDATVRHFGSAPSAQPEENGFKGHGMLAPFTAGWQSNDLHPSDH

SEQ ID NO: 92788 - DNA, 1333 bp, Zea mays
  misc_feature: Ceres CLONE 1581729
  misc_feature (1)..(1): n is a, c, t, g, unknown, or other
  misc_feature (8)..(8): n is a, c, t, g, unknown, or other
  misc_feature (37)..(37): n is a, c, t, g, unknown, or other
  misc_feature (78)..(78): n is a, c, t, g, unknown, or other
  misc_feature (79)..(79): n is a, c, t, g, unknown, or other
ntttgggnggtgggggtggtataattgttttatttanagaaagagaagagggaataaatatttcttcttttttggttnntactttcccctgtggcggccgctctagactatggatcccccgggctgcaggtattcgtctcacccctagaaaaaagcgcgcggacgagaggcgaagagagcagcccaaacacgactactgcattacacacacacacaggataggagtacgtgtctgcttctctctccccgctggcctcctcctccagtacttcagacagtgcaccgtgctgcggcctctttcatccctcaaggccggccgcccccagaaccagagtcggagtgaatccatggctcctccgcccctctcctcctggccatgggcaagccctggccagtacaagtacgtgctgctgggggcctctggtgtggaatgtgctgccaagaatggatggagcaagggggcctgctggttgtgtcccccaccctggacctggcaagctggtgttagaaggaggggggggcgcaccgtaacaagttccgggattcatactggcgggattcaatgggtgctataatgtaagccggcccggcctcccgtcgttctgtgcgactaaacggggggggctgaaagtggcccggcctggattctcgaactgccccaatgtgggggtaactgtggggtatcataatttatttgtgtctaggggggagttgcgacgaatgcgagcatgatagatagtggggggtggtccctacaaagaattggaggtacatataatgtggctgttccctgcttttgggcgctgtccgccacggtggggagactcgcgggggcgtgaatcgcgaatagacgcgcctctctgtggggcgcgccagtgatgagtgagggttataagaaccaccacactcagattaaggagagtgttggtgtaccgggatgactagagttcataatgcaaccctcacgtgacgtgatggtggaacgagccaatgttatgtaggtaagggccagatatctcgcgagtcggttgtagtgctcaacgttatatcactaaatgcaatgtgagcgatggaggatgagctccaatacgccagggggtgagggcgtgtcatgtgtatgaggggggtggctccccaccaagctatatcgtatgcgtgggctcgaagggatggtagacgcagagacgccaacggagagaaggtcagtattgatatgcagctttatgaggtgatgctatcatacactcaatggtttgtgacgatagtacaaacgcacgcaggtgagttttgatggtggagagcgcagcgtatggtagtggtgagagacctcggt

SEQ ID NO: 92789 - DNA, 1223 bp, Zea mays
  misc_feature: Ceres CLONE 1581733
  misc_feature (16)..(16): n is a, c, t, g, unknown, or other
  misc_feature (77)..(77): n is a, c, t, g, unknown, or other
  misc_feature (962)..(962): n is a, c, t, g, unknown, or other
  misc_feature (1027)..(1027): n is a, c, t, g, unknown, or other
tgggggggggtttttnttattaaattcggggataacaccatccttctcctagcgtgtgggggttggggtggggaaantgggactccccgcggtggcggccgctctagactagtggatcccccgggctgcatgaattcgtctcacccctagaaaaagagcccgttccagcgacgcactactgcggcgaaatcccgctcccgcgttccccatcctccggccgcctcgcttcggcctccctccggaaggtgtcttaaatcatggcgactggccaacttttctcaaaaactacccaagcattattctacaattacaagcaacttcccatccaacgggatgcttgatttttgacttcctctgtgggaaagaaacacccttctggttgctggaaatatcaatcctgggttccgaatggttttcagaaaacttttcttttgggaccagaggaaatttacctattccggtttcctccccccggttggaaagctggcatccaagtgcaaacccccaaacatatggatgggtttttagtccaacctttgcaaccccttcccgaaaggggcggccggccctcctgtgaaggggtgagcctttgtgaaaggcaggcccaaactgataataggggttttatatcccccttattccccccgaaagggggggtcccccgggaaatgcgagaagtgcgcccagaccatccttcattgtttagtttttatagcccaccctcggctgttgagaaaaaggcaggagggtgtacttctaatggttgtaacctcttcgcgcattacatattcctgttgggaggaataaatttttccttaaaaccctcggcaatggcgtctttttactaaaaaaatatatgggtgtttaatacgttcgccgcccgggggtgagaacgcgcgtgtgtgatgaatgacgatacgacttttttaccctgagtgggaaagagactcttttctatatanagggccttgtgggaaacctcttcggagtgggttgttgtggtgatgtctctctcatatatcattgncgcgcgggccaggcatatcgaaaacatcgagggagaggtgtgagaacaccctttgtttctcccatatggaggcgtaccaacttgggcgggcgttccaggtagcggacggcgttaaaaattgcgcatagtgaggatttttattccgccggtgtgaggggcatgttcggttacaaaacaacacacgtacgagtgtgtc

SEQ ID NO: 92790 - DNA, 856 bp, Zea mays
  misc_feature: Ceres CLONE 1581735
  misc_feature: Translation starting site: 89
  misc_feature (456)..(456): n is a, c, t, g, unknown, or other
  misc_feature (516)..(516): n is a, c, t, g, unknown, or other
ctccccgcggtggcggccgctctagaactagtggatcccccgggctgcaggaattcgtctcacccctagaaaaaattcccacggcacgatggcctccgccgaaatccccaactccagccccgacgccaccaaccccgcccccgccgccgccgccgccgccaccggccccgacctctcctcttcgccgccgccgctcccgccgcgcaagcgccgcctttcgccttccccaccaccaacgcggtccgcgtcacgctctcggtccccccgctcccgctccccgcacggccgacgctcgcgcagccggagccgcagcccgcagcagtacccgaccgatggcaagcggcaacggcacaatggccttaccgtggatgcgtgccgcgatttcctgcgcgacaggtgcacccgctccgacctcgagtgcagatacgcgcaccctcacaactccgtttccatcgnacctgtgcgtgcgcgcgagatcctgccgcctcttgcgcttgtagcagtatggtttccgtnctaaattttggtttgtttgctggtgcgtgggacctggtcgggaacaataaggggactgccggggcggattctctgaggaacaatgctttccgggggatgacatgcccgtactaccatccgcctccacatttcaggagaaattactgaaatcagttgggcggggaagacccaagggggaagacgatccgcagaagatttttcccccggggaaggggttcaagatccgcaaaaggatggccaattcttggaccaattcatcctggtgaaaaaagtttgcaaatgggttggcaaagaacttccttggcggggaaagggacattcccctatggcaagtgaggtg

SEQ ID NO: 92791 - DNA, 835 bp, Zea mays
  misc_feature: Ceres CLONE 1581736
  misc_feature: Encodes the peptide sequence at SEQ ID NO. 92792
  misc_feature (254)..(254): n is a, c, t, g, unknown, or other
  misc_feature (349)..(349): n is a, c, t, g, unknown, or other
  misc_feature (590)..(590): n is a, c, t, g, unknown, or other
  misc_feature (598)..(598): n is a, c, t, g, unknown, or other
agctccccgcggtggcggccgctctagaactagtggatcccccgggctgcaggaattcgtctcacccctagaaaaagatatgacccaaaaataacaggggtcaaggtcggccagtgagacgatgggggataagcttcatcgtcgagagggaaacagcccggatcaccagctaaggcccctaaatgaccgctcagtgataaaggaagggtgggggtgcaaagtacagccaggaggtttgcctagaagcagccacnctttaaagagtgcgtaatagctcactgatcgagcgcccttgcgctgaagatgaacggggctaagcgatctgccgaagctgtgggatgtcaaaatngcatcggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgataagcgtagtcgatggacaacaggtcaatattcctgtactaccccttgttggtacngatggacngaggtagctaggttagccgaaagatggttataggtttagggacacaaggtgaccctgctttttcagggtaagaagggggtagagaaaatgcctcgagccgatgtccgagtacaagcgctgcacgcctgaagtatgagccccgtggactagccattgcttctccacgaggctcataccagcgctacggcgcttgaattatgtacccttgccatactcccaggaaaagctcgaacgacc

SEQ ID NO: 92792 - protein, 49 aa, Zea mays
  misc_feature: Ceres CLONE 1581736
  misc_feature (45)..(45): Xaa is any aa, unknown, or other
MGDKLHRREGNSPDHQLRPLNDRSVIKEGWGCKVQPGGLPRSSHXLKSA

SEQ ID NO: 92793 - DNA, 1170 bp, Zea mays
  misc_feature: Ceres CLONE 1581737
  misc_feature (77)..(77): n is a, c, t, g, unknown, or other
  misc_feature (79)..(79): n is a, c, t, g, unknown, or other
  misc_feature (749)..(749): n is a, c, t, g, unknown, or other
  misc_feature (881)..(881): n is a, c, t, g, unknown, or other
  misc_feature (1027)..(1027): n is a, c, t, g, unknown, or other
tttgtttttgggtgttgctttttctacacaccgacccaccccaatacaacttattgttgaaatttgggggagggacntntaatagtggagctcaccgcggtggcggccgctctagaactagtggatcccccgggctgctggaattcgtctcacccctagaaaaagatatgacccaaaaataacaggggtcaaggtcggccagtgagacgatgggggataagcttcatcgtcgagagggaaacagcccggatcaccagctaaagcccctaaatgaccgctcagtgataaaggaggtgggggtgcaaagacagccaggaggtttgcctagaagcagccaccctttaaagagtgcgtaatagctcactgatcgagcgcccttgcgctgaagatgaacggggctaagcgatctgccgaagctgtgggatgtcaaaatgcattccggtaggggagcgtttccgcccttaaagggaagcaaaaacgcaaaacccggggggccgaccaaacccgaaaaccgaaaatgttccggctttaaataaaccaaaaacattgggtggaggaaacccaaatggcccccgaaaaaaacccccaaaggtttttccctccccccaaaagggtttccgttccccccccgaaagggggtggaaattccaaggggggccctcaaaaaaaattccacagggcccccaaaaaaagaaggccggttttatcttccccctattggggggaaaaccaacccaagggggggcgcnaaaaatatatattttttccccctcggggtttaaaaagtataagaccccccccccccttttgtggttttgtgggggtatacaccccccgaaagggggggtatacacccggataaaaggaagataggcgcttanaagggtttatataacccccccacaaaaaaagaaaagggggggtgttattataggaggtttctctaagggggaaccaccccaaagggtgggtgaaccccccctccgtctttttttttctcagtgggttaaaattaaaaggagggggngagaaagaaaaaaattggccctcccaagagccccaaagggtccccaaaattataccaaaagcgccctgtcaaaacgcctttgaaaaattatgaagacccccccgtggaaatctacccatttggcttttctccccaagaggctt

SEQ ID NO: 92794 - DNA, 1140 bp, Zea mays
  misc_feature: Ceres CLONE 1581739
  misc_feature: Encodes the peptide sequence at SEQ ID NO. 92795
  misc_feature (71)..(71): n is a, c, t, g, unknown, or other
ttttttttttttttggtgacaaccactattcaaactagtcccagtggcggcagggggggggcttatttgtnacaagaggaagactggtgggtgcggccgctctagaactagtggatcccccgggctgcaggaattcgtctcacccctagaaaaactctcgaaaccctagtcccctgctccattctcagccgccgccaatcccttcccgtgctccgcaaccgctgagtgagaaagaagagatggccggcaagggcgatggcccggctatcggcatcgatctcggcacgacgtactcttgcgtccggcgtggtggcagcacgaccgcgtcgagatcattgccaacaaccaagggaaaacgcaccacgccctcgtacgtcaccttcaccggactcccagcgcccccttcggaaatgcggccaaaaaaccggttgcccttgaaccccatcaaacacccttcttttgatgcccaagcgtcttcatccggccggaaagtttcaagtgaagcccttcctgtccaaaaatgaatttccaagtttgtgggcccctccaaaggggcattttctggggccctgggggagaaaacccaaatgaatgggttggtccaagaaacaaagggggggaaaagaaaaaaacaatttttgccagctgtaaaaaaaaaccccccccccaatgggggtcctttaaccaaaaaaagggcaggaaaaattttcctttaaaagatcctaaccttgtggggggggcccgcggatccaaaaagaaagtgccggggtgggggccaccacaagacccccgtagtgccataattttcaaataagaccccccgccagaaaggggcgagggcccccccaaaaagaaaaagatctacggggggaggaatatttgcggtgggcccgctttaaattggggcgggtgggggtatctatctccagaagaaagagcaaaaaaagcttggtctaacggtgtttgcccccctttagggtgcttctttaaaaaataaaagggccccccccccccgggttccaggtgagagaaaaaaaaagagcgccccccccgccctcttagaaacatttggggaaggggggagggcaaccccctgttagagagatggggcaccccccttgtgccgtagtgttgaagaag

SEQ ID NO: 92795 - protein, 94 aa, Zea mays
  misc_feature: Ceres CLONE 1581739
MAGKGDGPAIGIDLGTTYSCVRRGGSTTASRSLPTTKGKRTTPSYVTFTGLPAPPSEMRPKNRLPLNPIKHPSFDAQASSSGRKVSSEALPVQK

SEQ ID NO: 92796 - DNA, 1333 bp, Zea mays
  misc_feature: Ceres CLONE 1581740
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (71)..(71): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (83)..(83): n is a, c, t, g, unknown, or other
  misc_feature (819)..(819): n is a, c, t, g, unknown, or other
  misc_feature (891)..(891): n is a, c, t, g, unknown, or other
  misc_feature (950)..(950): n is a, c, t, g, unknown, or other
  misc_feature (1125)..(1125): n is a, c, t, g, unknown, or other
  misc_feature (1177)..(1177): n is a, c, t, g, unknown, or other
  misc_feature (1190)..(1190): n is a, c, t, g, unknown, or other
ggggggggggnnnnncgggacacccataaaaaatataaaggaggggggaggagaaggggagttgttttttngnnnnnngnngnctccccgcggtggcggccgctctataatagtggatcccccgggctgcatgaattcgtctcacccctagaaaaaatcgcagctccaggctccagcgcacagccgccgccgtttcttcatcttcttcgcagagccggcgctccatcttcagctccctcccttacttgcgctcggcacgcaggcggcggcggcggcgctgtggctcgggatctcagtgacggcatcagaggattcccctcccgcctctcgcgagtcgcctccggtcctccgcacaccggccggtgatctctctcctcccgcctccggtggatcggcaacgacggccggccccgggcggctgggccgcgcaccttcctgaagggcaaatgcaggggggtggtccacctagggtggtgtggggggctccggggagggggttttatgcccccaaaaatgaagacatggttcttaggggccgcctcttttgaaaaccccatgcacacctggcaggttataaggtgacgcggacccttttcaggtccttgcctagaaaagccggcccactggttgggggtttcacacgaattcctcgaattatatggggggaaagcgcccaagggagcggcggcgggcctggtgtatcggccgaatatgttgcttttcgtgtattaaccacgagatcgtacccgcagcacaaacgtgcgggaggggagcctggttatttgcagaagagtgaaacatcttctctgtctctgacgnccaacctggagagcagtctgtttcggggacagatgatctgtgagcggcgcgcgggagggctgctattgagancgatagagtagcacgccaacgcgtgtggatatagatgatatcacagtcttgcggcgcgngatacgtgtggtcgttgagggaggagaaacgctgggtgtcttgagaaatcgtagagcgatgccgtgagggggtatggcactgggctaggactggtcggttctgcgcggtgtagaccgccgccggagagaagaaatagagtgatgatctgttctctaggatctctacgtatcgtgntggtggagggtgcagagtagctctacccattatgatgtcagaggagacaagnctcggcgacaatnggagctgcggcggtgtgaatagaagcttttactatcattatactagactaattggaagagaggctgagtggtgtatggagtgagccatgacagactacccactgcacgatacagagagaccaagggtgtcacacaaacgtatc

SEQ ID NO: 92797 - DNA, 827 bp, Zea mays
  misc_feature: Ceres CLONE 1581742
  misc_feature: Translation starting site: 702
  misc_feature: SWISSPROT Homolog: EC 1.14.13.88 Flavonoid 3',5'-hydroxylase
  misc_feature: SWISSPROT Homolog: EC 1.14.13.68 4-hydroxyphenylacetaldehyde oxime monooxygenase
ctggagctccccgcggtggcggccgctctagaactagtggatcccccgggctgcaggaattcgtctcacccctagaaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctgccgctcctgctccgctacctcgcagcgtcggcgtcggcgtcggcgacaaaccgaaacggaagcggcgccggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaaccgtggtggtctcgtcgccgcgcgtcgccgaggccgtgctccgcacctacgtacacgtcttctcctcccgcccgcgctccctggtgtccgacatcatcatgtacagcgccaccgactcgtgcttcgcgccctacggcgaccacttccgcaaagcgcggaagctggtcaccgtgcacctgctcacgccagctaggtgccggtccacgccccggttatataataaa

SEQ ID NO: 92798 - DNA, 968 bp, Zea mays
  misc_feature: Ceres CLONE 1581745
  misc_feature: Encodes the peptide sequence at SEQ ID NO. 92799
  misc_feature (7)..(7): n is a, c, t, g, unknown, or other
  misc_feature (15)..(15): n is a, c, t, g, unknown, or other
  misc_feature (16)..(16): n is a, c, t, g, unknown, or other
  misc_feature (65)..(65): n is a, c, t, g, unknown, or other
  misc_feature (67)..(67): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
ggggggngggggggnnggtttttcttctactaacacacgtcgggggggggggggggggggggggngngnnnnnnnnnnaaattgggactccccacggtggcggccgctctagactagtggatcccccgggctgcaggaattcgtctcacccctagaaaaatccgctgctttcctcgcaactatcggatcttgcgaaggcatcatcctcctatcctataatcgcatttcgaatcgcaaacggagacttcgcccctcttcacagattctaatcgaatttgccaatctgcaagctaacgtagaacaatcaccaatcaccatccttaagaagatgatgcgatgcactgtaacgggcggcgggtgcgttgcttcgtggattggtgatcggaggtcgccggctgtcaaccccttcagcgtgcggatgtcgacgggcaacggtgggtggtgcggcggcctgaggtcgcgggcggcggatctctccggcctcgagatggcccatctacgtggcggcatcggggggctcttccgcgcgagcccgcgctatgggcgcttgcaagccacggccgcagttgaccctgaagatattccactggagaaggttcaagctaaatcctcaggacatgttatgcccatatgttggtggttgcttggtttggggggctatttctgtttgggttatcatccttgggtgtgggtcaaatgggggcgctttgaaatatcttggccaaaggaaccttggggattggcctgaaaaaatgcccttctttacaggggaaagggggtgggtttaagcaccatccccctaggctgggggccaaacacttaggggtcccctttttaaccggggggggatctctttgggccagaaaaaaattttgggggccggggaacaaaaaaaaccatttcaattccccgggaaaaggccaggccccccacccgtggggctggttaagggggggccatctttccct

SEQ ID NO: 92799 - protein, 139 aa, Zea mays
  misc_feature: Ceres CLONE 1581745
MMRCTVTGGGCVASWIGDRRSPAVNPFSVRMSTGNGGWCGGLRSRAADLSGLEMAHLRGGIGGLFRASPRYGRLQATAAVDPEDIPLEKVQAKSSGHVMPICWWLLGLGGYFCLGYHPWVWVKWGRFEISWPKEPWGLA

SEQ ID NO: 92800 - DNA, 811 bp, Zea mays
  misc_feature: Ceres CLONE 1581747
  misc_feature: Translation starting site: 142
  misc_feature (632)..(632): n is a, c, t, g, unknown, or other
  misc_feature (733)..(733): n is a, c, t, g, unknown, or other
ggagctccccgcggtggcggccgctctagaactagtggatcccccgggctgcaggaattcgtctcacccctagaaaaagacctcgtccccatcccgcaaccgcaagcaaccaccgatccagcccgttcggcctttcggcgaatggtgacgaaccaggacgcggaggcggcatcggcggcagccccggggccaggggcgacggtggacccgatgcgcctagcgtcgcggtggcggtcccagacggagtgggaccgcgcggtgccggagctggaggctgagccggagccgtccgagctcaacaccgtcaacagttcgggactcttctccgtcgtctctacggacaagttgtccgtgaaatacctcggcagccatcaccacggccacgacgtcggtgtcgtgcaggccgaccgccccgctcccacgcgccgggccgtgtactacttcgagatggccgtcaggaacgcgggatacaaggggcagacatccatagggttcacgagcgagagcttcaagatgaggcgacaaccgggttgggagtcaaaacagttgtggataccatggtgacgacggccacctttaccggggtctagggaaaggcgaaccgtttgggcaaaattcacatctggtgacantattgggcgctggcatcactacttgtcacaggagttcttcttcacgaaaaatggagctccggttggagccattcaaaagaaattaaggcccactatatccntacatttgcagtcatagtcaggggtgaagagttgactgtaaaacttggaaaggaacccatctgttttgacattgaggg

SEQ ID NO: 92801 - DNA, 1193 bp, Zea mays
  misc_feature: Ceres CLONE 1581748
ttgttttttgtttttgtccgtattcgtcagtttatttttggcctgtgcatggggagggtacctaagacggtgagcaaaaattttcacatctttggcggccgctctaaactagtggatcccccgggctgcttgaattcgtctcacccctagaaaaaataccaagtcgtaacccgtattgtcgcaccttccccactctaatgcgcgatgcgcccctatttcggatcacgccggcggcctcgcctccgcctccggcggccacgcaagcccacttctactccatggatccccctcttccagtcctccgcgagcttccgttcaccttccttcggaacggcctcgcacccgcctggagcgttcgtccaacctggatattccctcccccatgatcgtcttctcccatcgtcctactgagaatacttcggaatcttctccggacacgcctaccacccaatccgtttgaacccccccaagtaacggtagccggtccccaccccgggcaccgagagaccattttccggaccaataaatctttgctgcaccaacgggcgcgttcaccgggcaaatgaacattcataagatgggggattcttcctcaggaggttcattgtttccaagccctttggaaaggagaggttgggccgtgtattccccccctttaaacccatggtgtgttcagctccctaaacccaggggcgcctggtagtgcatcgaagcgcgcctggaattcttgagaaaaaaggactcggccatccaaatttcaaactggtctcaaataatttgggcactttataggccctattggggatcagttttcacatcctttctccctctccgccacttacgtggggaatagccccccgggctgtaaccacctatatgggtgtaagggaccccgtatttaaagagtagctcggcggcgccgcgttataactcttaaggtcgcgaccaaatctacaattctggatgggatacccatctgccaaaacctctcccaagaaagaaaatttatcgttcccttatccaataatgttgtctactgaagtaataaacctattcatttaaagcccccgcgtatatattaacatgcctaaggtggccaaaaacgaaaagagagatggcacgagatcaaacacccattgggtgtgtaggtcaattattttagttacccttgcgggccaccgaggagtggggtc

SEQ ID NO: 92802 - DNA, 963 bp, Zea mays
  misc_feature: Ceres CLONE 1581749
  misc_feature: Encodes the peptide sequence at SEQ ID NO. 92803
  misc_feature (32)..(32): n is a, c, t, g, unknown, or other
  misc_feature (99)..(99): n is a, c, t, g, unknown, or other
ttggggggggttttttttcgtctctctttccnccgtgtgcttgtggcgcggcacccccccaaaggaaagagcgacaaatggtttgttatgattgccccncgttggtggctagctcgagactagtggatcccccgggctgcaggaattcgtctcacccctagaaaaaacctcgtggactccttccccacaaaactaaaccctcgcttcggaggcgcgtgaacccaagaccgacaggcgaacgaagcgagggtcctcacaaccaccatcccctgctgcaacgacgccgccggcgatggcgtccatctccggcgcggcggcgccgccatcttccgccgtgtgccggcttcagctgcgccggcaccttctgctccagccctcccacctccgcctccgcgcgccccactccatcgccgacctctcccgctcctccaattccgccccgagcccggcccgcccagcgctgggctccggcccggagaacgggagcggcggcgtccgcgcggtggagaaggacccgatcaagctgtgggagcgctacatcaagtggctctaccagcacaaggagctcgggcatcttcgttctaacttcagcccggattggggtttcacgggaggaatttcccggcggcaaaagggagccccccggatggcaagcagggccttgcctccaaaattgcgggggaagcttcgaagaaagggcccgccaatccggccaataccccgaacctaaagggccaatatggggtgggggcccacttacttggggctccagcgaaccccgggcccctcagactcccaaaagtacgtttcctctccgggaaaccaaggatcgggaataacccggctctcctgaagaaaaaattccctacgcgctttccccccgcaaagaaagattccatcctcctggggaaaaaagaatttcgttttcccccacatccggggagggctgttgttcccaaatct

SEQ ID NO: 92803 - protein, 145 aa, Zea mays
  misc_feature: Ceres CLONE 1581749
MASISGAAAPPSSAVCRLQLRRHLLLQPSHLRLRAPHSIADLSRSSNSAPSPARPALGSGPENGSGGVRAVEKDPIKLWERYIKWLYQHKELGHLRSNFSPDWGFTGGISRRQKGAPRMASRALPPKLRGKLRRKGPPIRPIPRT

SEQ ID NO: 92804 - DNA, 837 bp, Zea mays
  misc_feature: Ceres CLONE 1581752
  misc_feature: SWISSPROT Homolog: EC 4.1.1.35 UDP-glucuronate decarboxylase
  misc_feature (675)..(675): n is a, c, t, g, unknown, or other
acccgcggtggcggccgctctagaactagtggatcccccgggctgcaggaattcgtctcacccctagaaaaaacacccaccaggccaccaccaggtcaccaaccacgcacgcgcctccgcctgcccgctctcccgccatgaagcagctccacaagtcttcccctacccacgcgccatcgccggcgcacgcaccggctcccaaggccgccaagacggcgcgcccaggtccgcgctcctggatcggctacgtcctccgcgagcagcgcctcctcttcgtcctgctcggtgcgctcatcgcctccaccttcttcctcctccggccctacctctcgctctccccgtcttcccacctccccgacgcccgcccgctcttctccttcgccacccgctccggtgttcccgccggcttccgcccgccgcagcgccgcgtcgtcgtaacaggcggggcagggttcgtcggcagccacctcgtcgaacggctttctggagcagggggacagcgtgatcgtggtcgacaacttcttcaccggcaggaaggagaacgtcgcgcaccacctcccggaacccaggttcgagctgctccgccacgatgtagtcgagccatcctcctcgaggtgggacggatctaccacctcgcgtgccccgcgtcgcctgtgcactacaagtacaacccantcaagacgatcaagaacaatgtcatgggaaacttgaatatgttgggtctggcgaaacgaattggtgccaagggttttgttgactagcacaagtgaaagtttagggggatccgcttgagcatccacagaaagaattatactggggggacgtttatcctattgg

SEQ ID NO: 92805 - DNA, 1186 bp, Zea mays
  misc_feature: Ceres CLONE 1581756
  misc_feature (41)..(41): n is a, c, t, g, unknown, or other
  misc_feature (42)..(42): n is a, c, t, g, unknown, or other
  misc_feature (62)..(62): n is a, c, t, g, unknown, or other
  misc_feature (63)..(63): n is a, c, t, g, unknown, or other
  misc_feature (71)..(71): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (794)..(794): n is a, c, t, g, unknown, or other
  misc_feature (1037)..(1037): n is a, c, t, g, unknown, or other
tttttggttggttttttggggggggggatttttttcaccannggtaatatgggggggggggnnagacgagnggggaggnnnggggagttatcgcggtggcggccgctctagaactagtggatcccccgggctgcaggaattcgtctcacccctagaaaatctttcccaacctcccatcccataccaccccccttcatgtcgtcgccttcctccccgcgcacttgcccctgcatctctccgctgcccaccactccctcgcattaacgacgaaggctcatcatctctgatggaggtaacagtcggctaacacaccgccccgccccgcccctgttgtctgtcccttcattttctagcttagaagagtattcttgttccggtttcttcgttccgtcgagcgcggcattctgtgggtcgtgtggattttgggcccggggacgaggaggaggctgggtcaagatctgtggtcaaaaaatgatggggggggttcatggaatggggtgcatgactgggttgctgtggggacgccttcctgggagtgcgggaggggatcatgaagggccccccattaatataagcgggctgggggaggccagggaacccacagggaaggggggaaggccgcccgctttaagcaaccccccccaaacaaaacccccggggggccgggtaaggcaaaagacaagccccctgggggggggggaaaagaacctttcgttttcaccccaacaccccgtggttcccaattgggggagaaaaaaaaaggtccgggtccgtcggccctgggcgcgtggtcntgggccagtgcccccaaccacaaaggggggggcccccccttgtgtaaaaagggctttccccttgtgttccaatgtggggaaacacccctgttttccggggggggaaaccttttctttctcccgggggccggggagaaaaaaaacccggccgccccccggttcgggggggtttcaattgtgtgggcagaacacctcttattcttttttaaaaaaggagaggggggggggcgctctcctctattntctctgtgttacacgtctaacggtggcacagagagcgcgaggggtaggggatacgtctataagagagggagaatgttttgcaacacacagaacaaaagaatgtttcgagtcgggagagagagtatttaattatctatctcaattacata

SEQ ID NO: 92806 - DNA, 857 bp, Zea mays
  misc_feature: Ceres CLONE 1581758
  misc_feature: Translation starting site: 473
ctccccgcggtggcggccgctctagaactagtggatcccccgggctgcaggaattcgtctcacccctagaaaaaacagctgagaaccgcagagactggcgtcttcgtagtcgcctatctccgcgacccaaagcgttcccccttcgcccattcttctgtcatgtatctcaccaccggcgccgctacaccctttcgacaacaccatgagggagtgcatctgcgaggcacataggccagggaggtatccagagtcggaaacgcgtgctgggagctgtactgcctcgagcatgggattcgagctgatggtcagatgcccggcgacaagaccattgggggaggtgatgatgctctcgacaccttcgtcagggagactggcgctgggaagcacgtcccccgtgctggtatgtagtatgaccgtgagcccactgtcatcgatgaggtgaggactggcacctatcgccaggtcttccatcatgagcagctcatcagaggcaaggaggatgctgccaacaactgtagctcgtggtcactacaccattggcaaggagattgttgacgtgggccttgaccgcatcgaggcgcttgcagataagtgcactggcctccagggcttcctcggatcaacgctgttggtggaggtacgggctctgggcttggtgctcacatcgtgatagcgctgtctgttgactatggcaagaagtccaagctctggtttcgacgtgtcgcatgaccccaagtgtgcaggtgcgtgggggatgcatacagaagagtcctgtcaggccactatcttcgagaggaaaaagatgtggctgtcctgcgcgacaatgaggacatttatgacttctgccggcggatccc

SEQ ID NO: 92807 - DNA, 1255 bp, Zea mays
  misc_feature: Ceres CLONE 1581762
  misc_feature (13)..(13): n is a, c, t, g, unknown, or other
  misc_feature (929)..(929): n is a, c, t, g, unknown, or other
  misc_feature (998)..(998): n is a, c, t, g, unknown, or other
  misc_feature (1127)..(1127): n is a, c, t, g, unknown, or other
  misc_feature (1200)..(1200): n is a, c, t, g, unknown, or other
ttttttttatttnttggcgggggggaactaaccacaggcgcacgttgcggcgtggggggaaggagacaagaagcccggctgggggggtgacgttggttgtttttttcaactagggggtcccgggggtgtttttatcgtctcacccctagaaaaagccgcacgcttcttgttgccaaagaatttcctcccctagccgccgccgccgctcgtctccctgagaggtgccgggaccgagggaactggccgagttctaggtagagaatcggttttgcttgtctcagcacggggtctgctgcgtctgggggtggtgaaggggaagaaattcgtgagatctgttccggatcaggcttccaacctccggaatcaggggtttcacacataagcgcggcgatttgaatttgatgtactaatggagcctaaggggggctaaaaagcctagcagcgagtcgtgtcctgaaggtatggaagcgccccctgggccacaggcgttggaagggaaggttccaacccgtgccgggagggggtggaaaaaaagttccgggggtgggggggcgtaagtcgcaaccggggcgcggaagaaaggcccatgcccgggagtagtgccccttttttgggggttgtcccgccagtttctaagagggaggtttttaaggaaatgttttgttttttttccagaagaaacgctgtgtgagaatagtcggtgagaacaaaagattgctcaccccttgcgaggcgccgcgcgccatgttgtatttattcccgcgggaagaaaaaaaagggcggagagagccgaaaggggtcgtccgcgcccacggagacgatagtgtggggcgctcccccttctggtagaagaaaaagagacggttccccggtgggagagatggaaaaagtgggttttctcgccgcacagaagatgtgcgggttgggtntcgtggagagatgacaccccccctcttgggtgcgcgctgcagcagagggggtggggggagtgatgtganatctggttccgggcccgcaggcgttaaggaggagagcgccatcgccccccgcgggtgcgatttctaacacagaacgatagcatagataattgtttttgtgggatgtggtcctctcttatataaatgaanagtcggggccgggcgcagagaaagagaaaaagagacggtgagctcggcgaggagggtggcgaccccgtctctntctggaattgggagagcgccccacacggaatggggtgggggcgccgggcgcacct

SEQ ID NO: 92808 - DNA, 1188 bp, Zea mays
  misc_feature: Ceres CLONE 1581765
  misc_feature: Encodes the peptide sequence at SEQ ID NO. 92809
ggggggggggctttttttgcgggaggaccctaaaataagaaagacatcgggtctgccgttttgggtgggggtagggttggggctccccgcggtggcggccgctctagaactagtggatcccccgggctgcaggaattcgtctcacccctagaaaaatccaccatcacacagcaatccacacaagcacttcgacgtcacacgggcgctgcgcacagacacaccaagcgtcggcaccaatggcttactaccaggaggtggactactgctcggaggaggtgaggtcggtggccccggccggcttcgggccgccacgggggcggcgtccagcagcacgtcgtcaaggagaaattcgaggaggtcgacacggtctcacgcggccggggccaacccaccacccacaaccatgggcaaccacgggggccaccggccttcgtgggggcgccaaaaccagggccgaagaagaaatcaaacacctgggaaccggccaaattcccacgaaacccaggggaagagctttcctccccccggggcttaaatttaaaccccccccgggggggcggggatccccaaccccccccttccgggacttggccctggagtggccctaaatagaaaagggccccaaggggtttgaaaactgggttgtgtgcgcagaggtctcaaccccaaaaacctgtgggggttttacgcggagaggggtaacaaccctaaaataaagggcggcctccggtggtggcaaaaattgtcgggtaacaatatattaagggcccccgcgggagaaccccctggaaatttatataataagacgggcagcaccccaaccacaaaattcttcggggggaaaattcctcatgcagtatattgtttgtgtcggaaagattatcgcgagccccgcacgataaagggccacataaagacccaagctcgcaaccgtcggtaagtctgggggagaaaaagaaacctcgaagaataaaagagggcccaatataagtagggggcagagcaccggctatgttaaggagaaaggagaagagatccagttattgttgatggtggggcgcccaaaaatagtcgccccggtgaggcccggtggtgggaagacgtatgctcgggtgtaaaaggtgtacatgagcccccgacgggcggaagagtggggccctgggggatggaggggagggggcctcgccc

SEQ ID NO: 92809 - protein, 123 aa, Zea mays
  misc_feature: Ceres CLONE 1581765
MAYYQEVDYCSEEVRSVAPAGFGPPRGRRPAARRQGEIRGGRHGLTRPGPTHHPQPWATTGATGLRGGAKTRAEEEIKHLGTGQIPTKPRGRAFLPPGLKFKPPPGGRGSPTPPFRDLALEWP

SEQ ID NO: 92810 - DNA, 855 bp, Zea mays
  misc_feature: Ceres CLONE 1581766
  misc_feature: Encodes the peptide sequence at SEQ ID NO. 92811
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (684)..(684): n is a, c, t, g, unknown, or other
  misc_feature (685)..(685): n is a, c, t, g, unknown, or other
  misc_feature (688)..(688): n is a, c, t, g, unknown, or other
  misc_feature (689)..(689): n is a, c, t, g, unknown, or other
  misc_feature (692)..(692): n is a, c, t, g, unknown, or other
  misc_feature (695)..(695): n is a, c, t, g, unknown, or other
  misc_feature (708)..(708): n is a, c, t, g, unknown, or other
ctccccgcggtggcggccgctctagaactagtggatcccccgggctgcaggaattcgtctcacccctagaaaaagaaagagagagagagagagagagagcagtgtgcttgtggtggccatgggcaactgctttggctccaacgtggcggaggtgggggccgtcaaggcgatggcgcaagcccatcacgcgcacccgcaagtggcgctggcgaagcacgtcgtcatgtccgccgcgccgtccagtgctgcccaatcccatcacgccgcggcgaggcaccagggggtgcccgtgcccgtgcccgggaagttgccgccgccggccacggccacggccacgggaggcgccggcggcagcaggcccccagcagctgcgggcgggggcagcgatcgtcagccggacgggaggatcctggaggctcccaacctccgtgtgttcacgttcgcggagctcaaggcggccacccggagcttcaagccggacaccgtgctcggcgagggagggttcgggcgggtgtacaagggctgggtcgacgagcggaccatgggccccgcgcgggacgacagcggcggcctgcccgtcgccgtcaagaagctcatccccgagagcttgcagggcgcgcaggaatggcaggtacgtactcctcgtcttttttttttttttgttgcccccnnnnnnnnnnnncnntgnnggnccncccccctcctggnccgggggccccccgcctcggggctccccgccccttggggggccctctttccgctggggggcgggttgctgggtgcccgtgggcccctggctcttcccgccggttgggtggcgggtcgccgcggcccccgccggggtgtgtgtgttgg

SEQ ID NO: 92811 - protein, 245 aa, Zea mays
  misc_feature: Ceres CLONE 1581766
  misc_feature: SWISSPROT Homolog: EC 2.7.11.1 Non-specific serine/threonine protein kinase
  misc_feature (185)..(185): Xaa is any aa, unknown, or other
  misc_feature (186)..(186): Xaa is any aa, unknown, or other
  misc_feature (187)..(187): Xaa is any aa, unknown, or other
  misc_feature (188)..(188): Xaa is any aa, unknown, or other
  misc_feature (189)..(189): Xaa is any aa, unknown, or other
  misc_feature (190)..(190): Xaa is any aa, unknown, or other
  misc_feature (191)..(191): Xaa is any aa, unknown, or other
  misc_feature (192)..(192): Xaa is any aa, unknown, or other
  misc_feature (193)..(193): Xaa is any aa, unknown, or other
  misc_feature (197)..(197): Xaa is any aa, unknown, or other
MGNCFGSNVAEVGAVKAMAQAHHAHPQVALAKHVVMSAAPSSAAQSHHAAARHQGVPVPVPGKLPPPATATATGGAGGSRPPAAAGGGSDRQPDGRILEAPNLRVFTFAELKAATRSFKPDTVLGEGGFGRVYKGWVDERTMGPARDDSGGLPVAVKKLIPESLQGAQEWQVRTPRLFFFFVAPXXXXXXXXXPLLXRGPPASGLPAPWGALFPLGGGLLGARGPLALPAGWVAGRRGPRRGVCV

SEQ ID NO: 92812 - DNA, 1333 bp, Zea mays
  misc_feature: Ceres CLONE 1581769
  misc_feature (50)..(50): n is a, c, t, g, unknown, or other
  misc_feature (57)..(57): n is a, c, t, g, unknown, or other
  misc_feature (58)..(58): n is a, c, t, g, unknown, or other
ccttttttttctctcccctcttttctctccctcttatctcgctttttttnttttttnntttttttctggagctccccgcggtggcggccgctctagaactagtggatcccccgggctgcaggaattcgtctcacccctagaaaaaagcgccggccgggccgttgcgctccgtccatcctcatccccatccgccacccacccctcgcccctccttctcactccagtgctggctgccggccatctcctcccccggggtccttgagctggaggtggcggtggatgaccagctctcagagttttctgaggcgaggatcggacggcgttgcgttacgtccgcggatggtgatcggctgtccgaacggtctcccccgcggcgggggtcgtctcgacgacccaggaaatcgcccttctgggagggtgggaaattcctcgcggctcgcgcgtcaagggtgctccaattaatttaacccccccaatgtttaaagggggggacgcccccgtcgagcccgaatctgttccctggtgccaccgaactcccagaaatctgggtaatttttgtttggtaatccgggcatcccttattggggacgttgcccccctggttgtgtgactggactgctccccccgccattaagtgggccttgaaaccaaatttttctcctgggccgtcctcacggttatttcccataggggggttacccctcttctttaaaataactctataaaggctttcgattttcgctatcctgcttgtgtgtggccaccctttatattttgcctttcgtgcccctatattcagcaccaatctgtttattgcgttgtcaccactttcccgcgataaaagagcggcgcactatatagagattatgcccgggtgttcatttccgctcgtccgcggtatgttgtttatacgtctcctccaccccccctgaaggatacattatcttgcgggtgggtgtgtcattgttctctctatgagagaggatggcttttttcgacttaccacattttctctcatcattcccgcaccgctcccccatctttctattacattttggtagtggcgcggtcctctcccaattaaccagtctttcgtgaatgtgtttcacacatacaattctattgctcctgcgcacgagtcgcttcatttctctaacttctccttctcaactatattcctacctcctctgcctctactcttatatgccgccctcccctgtattatacctatattgtttcctctcgccgcgcgaggtttctgatatctctactcttcgattaccattttagttcactgtcctgcaccccaccacataatcgtggtcgtgtgctg

SEQ ID NO: 92813 - DNA, 1333 bp, Zea mays
  misc_feature: Ceres CLONE 1581770
  misc_feature (1171)..(1171): n is a, c, t, g, unknown, or other
  misc_feature (1179)..(1179): n is a, c, t, g, unknown, or other
cgctttcttctttttctccttctttcttccccctttttcctctcctttattatatatttttttttttactggaactccccgcggtggcggccgctctagaatagtggatcccccgggctgcaggaatgtcgtctcacccctagaaaatcgcccgagcaaaccgtcgccggtgcctaccgttcccgtcgccggtgcctaccgttcccgtcgccgcccgtcctctctacggaggtcctttttcagatatcgctagggattgcccatataaaagttgatctcatgaattcgggaagaacagcggcatccaacgtttcctgttcagcgggaaacagcggcagcttcccttccctgcctccttccaggaatttcttgggtttcccaatttgttttcgtcaatttcccacttgttcaagggccatgtttcgcaacccctgccttcttccgtttgtcttgggaattgtgtggaaaggacccctccctttaattgggggccccaagaccttcccttttctttttgtgggaaatctcccttagggtccccaaaaagaggttttcctcctgaaaaaaaacccctgttcaccatttaacccctggtttatgggcttccagacctttttttataatgggaaaaatacccctccgccccaggggggaaccctcccagaatttcttggggcccttctctgaaaaaagttggtgaatgcttcaaatttctttcccgaatatttttttccgggggcacttgtggtgtctgttcctattaccacgtctcccaattaatttgaggcccattcctttcttttcttgtggggcaacttcccgcctatccccctgttgggtgtgtagtgtcctaatgccgcgatagggggtttttatcaaacccctatcctctttgttcatccgatttacgtagaacaaacgtaacgcacgtccttgttaccgagcgggggtgtgggtgccctctgtcgtacggctcacgtgtagagtgttacccaattaccgcgatcgtctatctaatattgagacaccgccgcccgccttattccgatcgaaagatgaacacaacacctgctgccgcgatagtagactatgtttgtaagcgtgatgtcgtctgtcctcgccgataggtaaaggaaaagatttactcaattcgctagctcgcgtcgccccntttttacntaaatactggcttccatatccctcgttcccccctactcctatttctgcattttttttgtgtgctgtcgcgccgatgatatatatactactccgctctctctctctgatttgtgtcatgttccggccctgtcggcagtcgcatgtgtgtctccct

SEQ ID NO: 92814 - DNA, 901 bp, Zea mays
  misc_feature: Ceres CLONE 1581773
  misc_feature: Encodes the peptide sequence at SEQ ID NO. 92815
  misc_feature (423)..(423): n is a, c, t, g, unknown, or other
ctggagctccccgcggtggcggccgctctagaactagtggatcccccgggctgcaggaattcgtctcacccctagaaaaatctccaatctcctcgccccccacggacctgaaccgagaaccgttaccgccgccgcctctcgcctagccgccggagaagcgccgctcgctcaggaggacagccatggcgccggagccggaggatgatattatgaacgagaagaatccccgcccgctcgacgaggatgacatcgcgctcctcaaaacctatggactggggccgtattcgaccagcattaagaaggtcgagaaggagatcaaggaaatggccaagaaaatcaacgacctctgtgggataaaggagtctgatacagggctggctccacctagccagtgggatttggtttcagataagcagatgatgncagaagaacaaccgttacaagtagcaagatgtacaaagattattaagccctaatacggatgatgcccaatatgttataatgtaaaacaattgcaaagttggttgtcggattgggagataaggtctctcaactgatttcaagaaaggatgagggttgggtgttaatcccgacaggtccaaattcaatccctcctccccaaaattggcccccagggttccctgatgaccgggggggaaaaacccaatgggcccccccaatttttccgtgggctcccagggcccaattggaaaaccgccggaaattgtttaaaatcccctggcttccccccaaaaaaattgttccaagctgggttttgacccccccaaaaaagggccttttggtttgggcccccctggttttgggggaaaaacctctctgtggggaaaggggggaaccccgcgagaggagggtgtttttccccccggaaaatgaggaagag

SEQ ID NO: 92815 - protein, 97 aa, Zea mays
  misc_feature: Ceres CLONE 1581773
  misc_feature (81)..(81): Xaa is any aa, unknown, or other
MAPEPEDDIMNEKNPRPLDEDDIALLKTYGLGPYSTSIKKVEKEIKEMAKKINDLCGIKESDTGLAPPSQWDLVSDKQMMXEEQPLQVARCTKIIKP

SEQ ID NO: 92816 - DNA, 928 bp, Zea mays
  misc_feature: Ceres CLONE 1581774
  misc_feature: Encodes the peptide sequence at SEQ ID NO. 92817
  misc_feature (471)..(471): n is a, c, t, g, unknown, or other
  misc_feature (571)..(571): n is a, c, t, g, unknown, or other
ctccccgcggtggcggccgctctagaactagtggatcccccgggctgcaggaattcgtctcacccctagaaaaacttcgctcgtggttgcgccatccctcactctcctccgaagccatcgtccccgtcccagcctccccggactccaggggcaaaagctgcagcgtcgagatggtgaaggggcgcacggggcagcgcgtgaggctctacgtccggggcaccgtccttggatacaagcggtccaagtcgaaccagtacgagactacgtcgctggtgcagatcgagggggtgaacaccaaggaggacgtcgcgtggtactgcgggaagcggatggcctacatctacaaggccaagatcaagagcagcggcacccactaccgctgcatctggggcaaggtcgcccgcccgcatggcaactccggcgtcgtccgcgccaagttcaagtccaacctgccgccggaatcccatgggncgtaagggtcagggtgttcatgtaccccagcagcatctaaagataatctgaatgtgtggaggaaccttttcttctagattttatcttcagctgtccctgntaaagggttgtgtttcaggttgagaaattagcaagtttgaactgtctatctgaaaaccatttaaaagttccctgaattttgggtgtgtatggaatccctgggaggtattattatggagtttaaggtaaaaaccaaattggtttgcccacacttctggaagaagactcctttatccccaaaaaatgctcctagtgtcccttaaaaaaaaaaaaaaaaaaaaaataaaaccggtaacccccccgaatcaaactatcccccctcgcctcttggcgggggctttaaccgccctaattcccattagtgttttcatggggcacggggcagccgtgtaggtctacctccggggcccgtcttgga

SEQ ID NO: 92817 - protein, 100 aa, Zea mays
  misc_feature: Ceres CLONE 1581774
  misc_feature (12)..(102): Pfam Name: Ribosomal_L35Ae Pfam Description: Ribosomal protein L35Ae
MVKGRTGQRVRLYVRGTVLGYKRSKSNQYETTSLVQIEGVNTKEDVAWYCGKRMAYIYKAKIKSSGTHYRCIWGKVARPHGNSGVVRAKFKSNLPPESHG

SEQ ID NO: 92818 - DNA, 1318 bp, Zea mays
  misc_feature: Ceres CLONE 1581777
  misc_feature (46)..(46): n is a, c, t, g, unknown, or other
  misc_feature (55)..(55): n is a, c, t, g, unknown, or other
  misc_feature (56)..(56): n is a, c, t, g, unknown, or other
  misc_feature (59)..(59): n is a, c, t, g, unknown, or other
  misc_feature (61)..(61): n is a, c, t, g, unknown, or other
  misc_feature (63)..(63): n is a, c, t, g, unknown, or other
tcttaccccttgcggtgccctccttctcgcccttgtcttccccttnttttttaannaantntnatgctggggctccccgcggtggcggccgctctagaactagtggatcccccgggctgcaggaattcgtctcacccctagaaaaaccctctccacttccgtttccggatcccgtttccagctccgatccaacccagcatctgtaccgcgccgcgcgagcacgtccggcgccggtgcggcaggccaaatcctagagcactcctcccccgctacgccgcaccgcccatgggtcggagctagcccccagatagatagaggcccatggccaggggcgtggcaaaatccagatccgggtgggccgggaaaggacttgatcgccccccacaccattggccgggggccgtggtcggggcctccttcccagctgggaaaagaaagggccccgttccccttcttggggctagataaccaccggccaacccttttccgggttgaatgggccaagacggtgtttttcttaaaaagcttcccccgaccaggggaggggccattttccgaaaaaggccccccccccctgggggttttataggaaaaaccccgggcggtggattgtaaaggtgttctcccagaccgacaaaaaatggtggttttaaacgcaaaaaggaggccttgttttccagaaataaggtataatacccggagttgagaaattcctccgctctgtttgctttctcagcgcggggttaaaaacaaatctgggtgtgtttataggtcgccctacttcttcctatagagagaaccctgtaggagagaaaagaaatctcccctctcctaaaaaataaaatattcttcgccgaccccccgatgcgatattaaaaaagtggcttcctttttgttcaataaaaaacagattgtgacttcgtttgcgtggtgctctcccttccgctacacactccttgtgtgccgggctagaaaactccgtagtggtggatgaatgtccccttcccgaggtgggcgtattggggtatatcttggagggtgggatgttgcagccttcgccatctttactccactcgtattttggttcggaagtcgaaaaaaaggtgtttgattcacgtttcatagaagttatccaccgggggtcattctttggttgaccccggagaatagattgagggtggtcaccttcggggagctataggcgacgcaaggcggtccttcctgcattctagtattatgtgcctctacgtcgcccaaagtttgtttgcgaccagacttgtggcgggggtggggggcgcgtactttactagactgtgat

SEQ ID NO: 92819 - DNA, 922 bp, Zea mays
  misc_feature: Ceres CLONE 1581779
  misc_feature: Encodes the peptide sequence at SEQ ID NO. 92820
ctggagctccccgcggtggcggccgctctagaactagtggatcccccgggctgcaggaattcgtctcacccctagaaaaaactcacctccctgtctctcttctccttccctcccgcggtggttataagacccctccgccccgtcctctcctctcctctctgctcccgtcgatctgccatcctctgcctgccccgcttgcgcggcgcgtctgctctagtgatttgagacggagatccgccagagattgaggagagggagggaggcgccggggccggggagcggcggcggcgagggatggacggccacggcggcggggcgggggccggcaagctgacgcggacgccgtcctcgctgctgcgctcgcccacggtgcgcaactgctcctcgttccaggccgtggttgtcgacgacccggagcccgacgacaagaaggcgcaggcgcaccccaagcccccgccccaccacttggcacccccggtggcggccccgcccacccgcggctcgtcctcgcgctcccgctcgccttcctgctcgtgctgctcctcctccgcggcggcggggacgggcaccacctcgccctccttggcgggtccgcggccgtcgcgctcgcccgccgccgcgggggccgcgcgcctgctcccgggacgtctgcgccgctcgccaggctccgctcgggccagtggtttctcggggacaacaacaacagccccagaagcgggggacaagggcgccgcgcgcacggccccttcgtgcgggagggcgcaagttctcagcaatggggacggtacgaggcgagtttcacaggggcgctgcaacggagcggggtttacaatttcttggaaagggaattcaaggggaccgggcccaggcgatatcaaggcccgctccagagcgggcgggggggatccggtacccggccaaa

SEQ ID NO: 92820 - protein, 49 aa, Zea mays
  misc_feature: Ceres CLONE 1581779
MGTVRGEFHRGAATERGLQFLGKGIQGDRAQAISRPAPERAGGIRYPAK

SEQ ID NO: 92821 - DNA, 1302 bp, Zea mays
  misc_feature: Ceres CLONE 1581784
tgtctccgcgcttttttctctcccatctttccccaatgtggcgcggcggcacacccctcttattattttttttactccccgcggtggcggccgctctagaactagtggatcccccgggctgcaggaatgtcgtctcacccctagaaaaaagctcactcgtgccgtgcactcgtcccgtccgcctccaccctccaagacctcgcattgccaccgccgccgccgagtccaggggtagaggagagaggccagccgcgtcgcggcgggccggaggaggaggacgatcgggagagcggagcgagccggcccgggcaggatgttcggggcgggatccctggggcggggcgctgggagatctccaacgccgactctgcgactgaccacctaccgcctccgcggaccttgaacgggcgggcgttgaagctgctatcctggaccaaacccatccataaattggggtccctgggctgggccgggcaacccccccccgggcccataaaaataaaactggaacttgtaccttcggtgtgcctctttggcgaaccccacggttttttctggtggcatcgttgggaacccgtcctggggatttcgggatgctttcctccggctttggttgttaatatgatactggataagcccccccctcttaataaaaggccccccgtttagagaagcccgcccccatcattattttcccctcccgggtgtgtttcctccctgggtgcgctccgatgttttttctctccattcgtctgggtctattgctgctggcggtccccacgttacaagaaaaacataattgtccccgtcactcactcgatagagtgtgcacccacctctcgcctttattgagagaggaaggtggctctctctataaatagattattacgctcgtctcggggtagaggtttcgctggtatgttgcggggtctctcatttacaactcccgtgtgtggaggtcgtgctgttttatggcgtctcaactctcccccccacacttgttgctcgtgctctcttaactcgctttgttcctcctacctcgcttgttatgcgttttttcactatcagacgctgtgcttgtattctcccggcaccctactttacttacctccaccctcccactattattcgccctgtttcacccatatctatcgtgcgagcacatataaccctcgctcttttgcatatatgcccgtttttttccttcgtccccacatcacgattttctcccgttgggcgcctccgcttataactccctcattttttgtcacgcccacccttgcctgtattgtccgagatccc

SEQ ID NO: 92822 - DNA, 1062 bp, Zea mays
  misc_feature: Ceres CLONE 1581790
  misc_feature: Encodes the peptide sequence at SEQ ID NO. 92823
ctccccgcggtggcggccgctctagaactagtggatcccccgggctgcaggaattcgtctcacccctagaaaaaaataaatattcatgtcctcatggctcttgcagcatttgcttctatatttatgggaaatgcattggagggtggcctgcttcttgcaatgtttaatttggctcatattgctgaagagtattttacaagtaagtcaatgtttgacgtgagggaactgaaggaaaatcacccagaatttgctttgttgttagaaacaagtggagaagaatctgtacagttttcaaatctaagttacaccaaggttcctgtgcacgatcttgatgtgggttctcatatcttggttagagctgggcagttcttgtattctttaggctgtgccccttgatggtgaagtctacccaggttcatcaactgtcccaattaacccccctaatgggggaaacaaaaccctttaaaaaggaacatttggaaaatcccaacccaggggggggccccgaaactttggaaaggaagttttaattggtaaaagggaacccaaacccgggggagggttttccacccctccaaaaaaattttttgcccattttgaccataaaagggcccccctttaaacaaaccccaatttttccacaaaaaaaggcctttttataaaattttgggggggaaactctttttcacccaccatttttgtggtgaaccccctctttctttttggggtggtggtcaccccttttgtgaacacccttctctttttttagaggggcctctctttgttggtaaacccccgcgggggttttatttttcccgggataaataaacacctatggggggcgccacctcccgccgcggtggtggggggagggcacccctggtgggaaaaaacaccaccacctctcctttctctctaaaaagaatatttttttcagaggggggccgcttcgtaaactctcctcctccccattattttttttttttagaccccgctccctccccgcgtttttttttgaacatatcccccccctgtctgggtgtgggagggcgcacccctccc

SEQ ID NO: 92823 - protein, 100 aa, Zea mays
  misc_feature: Ceres CLONE 1581790
MALAAFASIFMGNALEGGLLLAMFNLAHIAEEYFTSKSMFDVRELKENHPEFALLLETSGEESVQFSNLSYTKVPVHDLDVGSHILVRAGQFLYSLGCAP

SEQ ID NO: 92824 - DNA, 1046 bp, Zea mays
  misc_feature: Ceres CLONE 1581793
  misc_feature: Encodes the peptide sequence at SEQ ID NO. 92825
ggcggccgctctagaactagtggatcccccgggctgcaggaattcgtctcacccctagaaaaactctacatgttacagcgactcggcctgccgcgatttttataatgcgccgcggtggccgtcgctagtggtacatatcagcaccgcccctgcctcgaggttgcgtgttttgttctctgtgagcgtcgtgggtgttgatggcgtcaacggcgtactcgcggccatccaagccgcctgggccggcggccggagacaggagcggaccgcggctggccaaggagctcggcaggatcgagcccaagaagctgggcatcgggctggttgccggctgctgcttcgcgctgctcatctacctctcctttgcccggctgtttgccatctactcgccggttttcgacagctcgtcgtccatggtgtttaagaacatgccgccagcaacgacgacggtgccggggtacagctacagggtgcgctgcccggtggagggagcaaaaagaggtgtcgtgacccctgaggcgggacccgcacctgcccgaaactttaccgggatggtcaccaaaaaaaggatccttcatggaggaagggccaccggccgtactaaacccaggaaggcccaaagaatccacctggcgaacgaagaaacgggggttccaaaataatgtggtttctccccataaaccaaaaggtccccgcccggtttttgtttttatattatagccggggcgaaacattcccgggtgtttagtcccttaataggagaaaaaaaccatgttaatttttggttttaacccctttccggggtgccggtgtccgtttcgaatcccaatgggggaaaaaaaaaaaacccaaccgtttccccccgcaaggaacaaattccttcctcccccggggtcgtggaaggtcacaatcaaattcctggttcttcggcccaaccccctccaggttgaacccccggaccaacttcccggggtggtctttctcctggcgggttcacggaatattttcacgaaaaaggaggtttgatcccttttcctccagggttctta

SEQ ID NO: 92825 - protein, 153 aa, Zea mays
  misc_feature: Ceres CLONE 1581793
MASTAYSRPSKPPGPAAGDRSGPRLAKELGRIEPKKLGIGLVAGCCFALLIYLSFARLFAIYSPVFDSSSSMVFKNMPPATTTVPGYSYRVRCPVEGAKRGVVTPEAGPAPARNFTGMVTKKRILHGGRATGRTKPRKAQRIHLANEETGVPK

SEQ ID NO: 92826 - DNA, 1307 bp, Zea mays
  misc_feature: Ceres CLONE 1581794
  misc_feature (1138)..(1138): n is a, c, t, g, unknown, or other
  misc_feature (1307)..(1307): n is a, c, t, g, unknown, or other
cgcttcgtttccttcccctaatatctccccctgttgctcacttatccttcatttttatttttttttttctggttttcacctcggtggcggccgctctagactagtggatcccccgggctgcaggaagtcgtctcacccctagaaaaagtcgtgtcgtccccccggccccgacccccctccgtttgccaacgactccgggctccactgtcgctctcgctcccttccctcccacgcaatggtggccgatcgcctccgcctcgcgctgctgctctccacggtgcctctgctccgcgtgggcgcgcccacgcctcgagccgaccatccgcctgccgtccgatcgcgcggctgcctacaaaacgaacgaatactccgtctgggaccggtgggtccgtgctcatcgcctgctccaaacggggtactatcactactgctctccttgcgtacctcctgccctggtatttccccccccccggagggaaaggggggaacctagagtattaaaaatttctccgcgcttcccagctatcattaattatatcctcacattcccgtataaattccccaatgcccggctgttttttacatatatcacctctcttcggtctggtgaaacctgcccaattctatggggtgccccctatggatttccaccctgtgggggaaactggtgtaatagtcctttaaatacttttgtcctctatccatgcgtgcgctttgtccaacccctatttattccctttctcccacctttattcgggccacatcgttttttggttgtgccgcactcacgccgttgccggaccgctcatggtggttattctttctcccgcttcgtgcactctagcgctccaccctcttttttggattaatccgatgaggagtgtcgctcgtcggctactctccttattaacgaacgacgagttctgcttcactcatggttgcaactcaatcttcttctctcctattcattttatttactatctatttctcctctgcgccttcacttgttatgaaatattgtaaataatggttgtacaccttgatactcctatctctaacagtatatacggagtagacggctttcgttccatacagataacactacgctatacttcctcgcggaaatcatatgccctgntgggacctgcacctcttacccccaccccattattatacttatgtttttctctctccggcacacatgttcgcttttatacttgtatcagtattagataattttccgctgcgcgacctagtctatcctctacgaaccataaccaactctatatgcccctgcttttgctatn

SEQ ID NO: 92827 - DNA, 1253 bp, Zea mays
  misc_feature: Ceres CLONE 1581796
  misc_feature: Encodes the peptide sequence at SEQ ID NO. 92828
  misc_feature (60)..(60): n is a, c, t, g, unknown, or other
  misc_feature (61)..(61): n is a, c, t, g, unknown, or other
  misc_feature (63)..(63): n is a, c, t, g, unknown, or other
  misc_feature (640)..(640): n is a, c, t, g, unknown, or other
  misc_feature (697)..(697): n is a, c, t, g, unknown, or other
cgtggggttgcttgcggcttctccctccctgtcctccgcggcgtttggctcgcttatctnntnttttgtgggacttcccgcggtggcggccgctctagaactagtggatcccccgggctgcaggagttcgtctcacccctagaaaatctccaatctcctcgccccccacggacctgaaccgagaaccgttaccgccgccgcctctcgcctagccgccggagaagcgccgctcgctcaggaggacagccatggcgccggagccggaggatgatattatgaacgagaagaatccccgcccgctcgacgaggatgacatctcgctcctcaaaacctatggattggggccgtatttcgacagcattaagaaggtccagaaggagatcaaggaaatgggcaaaaaaaccaccacctctgtgggataaaagagtctgaatatggggtggctccccctacccccccccatttgcgttcattaatagcaaattatgttgaaaagacaccccgttcccagatcgaagatgtttctaggatttttggccccttactcctggagtatgcccaaaaccgttttaaattgttaaaacataattggcaaattttttggcgccgggaattgggaagaacaagagtctcttccccnctccgtattttctggagggcatgggcttccactgggttcgggcttccttaattccgnccccacttttttcccctagtgccgcgtatctccccctttcatttttaccaaagaacgcgatactccctgtggggtcatacctaggggttgtaaaccgccgcgtgggtggataaaaacacccccgaattgttgtgaatttaactaatgttcatagttcttcgcttgatgcttttctcttcgcctatgttctttcttttttgggtgaaaaaaatactgcgtgtacagagtactcattatataaattgatttggggcggcggcctcgccctcccatatagaatatgtctatgcgcgccaccgcgtgtgatctctatctaccccgtcttacaataagatgggcaccatcgcttcacaagtgtgctccctcactcgattagtcagggctatatagacctccctgctcgtgaataatagcgctgcccatattgacactgttgttagtgtgtcgcgcatggttttactccctctacatgtatacgttaaatgcattttctcgtcgctactatatttattcgctgcgttctttcttctcgcctcgctcctcgtgcattgtgtag

SEQ ID NO: 92828 - protein, 57 aa, Zea mays
  misc_feature: Ceres CLONE 1581796
MAPEPEDDIMNEKNPRPLDEDDISLLKTYGLGPYFDSIKKVQKEIKEMGKKTTTSVG

SEQ ID NO: 92829 - DNA, 1177 bp, Zea mays
  misc_feature: Ceres CLONE 1581801
  misc_feature: Encodes the peptide sequence at SEQ ID NO. 92830
acccgcggtggcggccgctctagaactagtggatcccccgggctgcaggaatgtcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggactctaagggtggcaagaagtctagcagtaatctttccatgatgtaccaacctccccttggctacagcattgagggacttcgacctgccggaagggcgaagaagttccagttctgctggtttactccaactggcgcaaagaaagccttcctgataagccctttttggcttccctcgttcctgtgggtttaggaattcctttttctgaagacttggatttccttaccaattccccccggggcctgctggctttttcctgtaaaattggatcaatttcccccaggtttgtgcctccccgggtatatcccatccccccccctcttttttgcaagcgggtgtggttttcttgagatacgccctggtgcacccaaggggggtggtctcctcttccctcccgggcgcggggagttgtttctcccgtgcggctcccagcaaaattatcggggtggtggagaagcgttctatataaaaaccaggtcctcttatggtaacacccctcccctctggaggaggggtgcctgctctttttgtgtggggcacccccctatggtgttcccgcgcgttgtggggtcccctcctctttgaggtccgccccataatgttctcccgttgggcgcgattatattgtcggagtgtgtagcctgataacctgcggaaatcttctctcttccgcagagagtgagtgtctactgccctgtgtttcgccccgcacgcgacgtgcatgtgtgctgtttcgtttctcgccctgttgatactcatctccaccacattactgggtggggtgaacgagagcgcgtgtgggatgtcttgagtacctggatagatataattggtt

SEQ ID NO: 92830 - protein, 64 aa, Zea mays
  misc_feature: Ceres CLONE 1581801
  misc_feature (1)..(50): Pfam Name: AdoMetDC_leader Pfam Description: S-adenosyl-l-methionine decarboxylase leader peptide
MDSKGGKKSSSNLSMMYQPPLGYSIEGLRPAGRAKKFQFCWFTPTGAKKAFLISPFWLPSFLWV

SEQ ID NO: 92831 - DNA, 926 bp, Zea mays
  misc_feature: Ceres CLONE 1581804
  misc_feature: Encodes the peptide sequence at SEQ ID NO. 92832
  misc_feature (433)..(433): n is a, c, t, g, unknown, or other
  misc_feature (483)..(483): n is a, c, t, g, unknown, or other
  misc_feature (726)..(726): n is a, c, t, g, unknown, or other
ctccccgcggtggcggccgctctagaactagtggatcccccgggctgcaggaattcgtctcacccctagaaaaagcgcatccgcatcactgcgtgtcctcctcctctccccctcactgcggcgcatccacatctgccaatttctccacctcctcctcctcgcccctgtgcctcgacatctcgcatccgctccatctatggaaggccaccacgcgccatggatcgccgctctctaccgccacctcaattgaaggttcaccgctctctacgcggatccgccacctcctcctcggccgccgtcaatagaaggtcccagatctcctctcccattacttctctccccattaccgcgctcgaggtctgccatttttggaggtccgccacttccgcctctgctcgccgtcaatggaaggtcctagatctcctctccctantaccgcgctcgagtcagtgggaggtccgccatttttgggaggtccgccanctcctcctcgaccgcggcaaaaatggcgtgggagatccgccacctccctcctcggccgcgggaaaaattggtgtgggagattcgccacctaacctcctcccatttctcagccccccgcctggatatgtaaggtccgcccgaaggaactccgacgtccaaggcatgggttgatccgaaccccctttctccccctgcctcgcgcgcggcgggcccaaaatgggtttgggctgggttgttttcggnatggtgggcctaaccggcccctcccggttttcccccccccaaaatcaacaaaaatatggcagcccccaattctgaaggggagaggcccctgcacggtccaaaggaaagggttcaaaaccccccgggggggtccctttaaaatgagaaaagaaatggggtgtcacccaaacaatggggccaccggtggttggcccctctaa

SEQ ID NO: 92832 - protein, 145 aa, Zea mays
  misc_feature: Ceres CLONE 1581804
  misc_feature (73)..(73): Xaa is any aa, unknown, or other
  misc_feature (89)..(89): Xaa is any aa, unknown, or other
MDRRSLPPPQLKVHRSLRGSATSSSAAVNRRSQISSPITSLPITALEVCHFWRSATSASARRQWKVLDLLSLXPRSSQWEVRHFWEVRXLLLDRGKNGVGDPPPPSSAAGKIGVGDSPPNLLPFLSPPPGYVRSARRNSDVQGMG

SEQ ID NO: 92833 - DNA, 2507 bp, Zea mays
  misc_feature: Ceres CLONE 1581805
  misc_feature: Encodes the peptide sequence at SEQ ID NO. 92834
aggggctctggcgttcggcatccctccccgccgcaactcagccgcgccgccgtcgccgtgcacgcaccagcgccaccactcggcgcttacccatcaaacattcaaaccccacgacgccgccggccacggccaccgctagggttttagcctcctccgatgcagccgcctcgccgcgcgcttgtcacatccctcctccgcctccgctccttctcctccattgcctatcctcatccctacccacccgcgccccagcgacgccaccagttcgtcgccgaccccaccacctccacaaaccatggtatcgtcgggggcctcggcggcgtcggttccgggaacgggaacctcttggacccgacgcagctcctccgcgacgacccggtggcaatcaccgcttccctttgggtatcctccttccgcgccgccgcctccacctccggctcttggacccccacaccgccgcagccactcacccccttcctctcgcgcctggagctgtgggtgctcgcctaccagaaggcgtacgctgacgagaccggctcctatctgccgcgctcctccatcccggcctccacgctcgcctccctcctcacgctccgcaacgccgtactcgacggccgcttccgcttcggcaaccgcctcacccccatcctccagtccccgcgcgccgccaacgcgccggaccctgccaccctctccaagcgcaagctccgcgccctccttacaacccccggcccatcgcccttccaggaccgcgtcgtgcaggagctgctcctactcctgctcgagcccgtctacgaagccaggttctcgccaaagtccttcgccttccgcccaggtcgatccccgcatgccgcgattcgcaccatccgccgcagctttgctccgtacctctggtatatcaagggcgacctctccccactcctgcactcgcctgatcctgctctcgtggtcggtgcgcttatccgtgatgtgcgtgataaaaaagtggttgatttgatccgttcggccctgctcaccccggtggtgaccgcaagcgatgatgctgcagtaaagaagaagaagaccaagaggaaataccagaagaagaaggtgctgccagagggggagccgaagcctgacccttactggttgcagacgttttttgggtttgcaccagaggaagcacagacacagcctgattggggccattgtggggtgctgagcccgttgcttgccaatgtgtgcctggatgagtttgataagtggatggaagagaggattaaggagttttacaagccatccaagtccgatgttgtgggaggggatgatggtattgagcagggcaatacatcatggccagagtttgttcccacgactggccctgacaagacaaggaaggtggactacattcgatacggcgggcatttcttgattggtgtgagggggccaagagcggatgcggcggtgctccggaagcagctagttgagttttgtgatcagcgattcaggatcaaacttgataacgagagcctccctattgagcacatcacaaaaggagtcatgttccttgaccatgtgctgtgccgtcgagttgtgtacccaacactgcgttacactgctacaggaggcaagatcattagtgagaagggagttggtacactgctctcagtgacagctagtctgaagcagtgcatcaaacaattccggaagcttgagtttttgaaaggagaccgcgaaccagatccacaaccatgcttccgtatgttccacgccacacaatctcacacaaattctcagatgaataagcttttgctgacgatggcagagtggtatcgctacgctgataaccgcaagaaggttgtcaacttctgctcttacattataagggggtcactggcaaagttatatgctgccaagtacaagttgcggtcaagggcaaaggtctataagatcgcgtcaagaaatcttagtcggccattgaaggataagaaaggccagtcgccagagtatcacaatttgctgagaatgggccttgttgattcaattgatggtcttcagtatacaaggatgtcgatggttcctgatcctgattacacgccgttaccatttggatggcggccagatcatgagaagattttgctggagtacataaagctcacagatcaacagacattgaaagagcagagaaactgcatcagggaggacgggcttataacaccacaggacaatatttcgatgcttgtatggggctacaagaaaaatgctgttttacttccttcaaaagtgagtgatgcccaaggatccacagaggaccttggttcagataccgatgaattgaatgaaaaagagctaggaaatgagggtaaccaaagtttccaaaagcttgctgaaatgtcatgagttttggcaaactctgtagtgttcccaaggggtatttgacttgttgactggatggttggtttgtgactttgaaaacacaaaaccatctgctagttctttgttgaaaaaaataaaaaaaaaaaaaaaaa

SEQ ID NO: 92834 - protein, 740 aa, Zea mays
  misc_feature: Ceres CLONE 1581805
  misc_feature (493)..(627): Pfam Name: Intron_maturas2 Pfam Description: Type II intron maturase
  misc_feature: SWISSPROT Homolog: EC 2.7.7.49 RNA-directed DNA polymerase
MQPPRRALVTSLLRLRSFSSIAYPHPYPPAPQRRHQFVADPTTSTNHGIVGGLGGVGSGNGNLLDPTQLLRDDPVAITASLWVSSFRAAASTSGSWTPTPPQPLTPFLSRLELWVLAYQKAYADETGSYLPRSSIPASTLASLLTLRNAVLDGRFRFGNRLTPILQSPRAANAPDPATLSKRKLRALLTTPGPSPFQDRVVQELLLLLLEPVYEARFSPKSFAFRPGRSPHAAIRTIRRSFAPYLWYIKGDLSPLLHSPDPALVVGALIRDVRDKKVVDLIRSALLTPVVTASDDAAVKKKKTKRKYQKKKVLPEGEPKPDPYWLQTFFGFAPEEAQTQPDWGHCGVLSPLLANVCLDEFDKWMEERIKEFYKPSKSDVVGGDDGIEQGNTSWPEFVPTTGPDKTRKVDYIRYGGHFLIGVRGPRADAAVLRKQLVEFCDQRFRIKLDNESLPIEHITKGVMFLDHVLCRRVVYPTLRYTATGGKIISEKGVGTLLSVTASLKQCIKQFRKLEFLKGDREPDPQPCFRMFHATQSHTNSQMNKLLLTMAEWYRYADNRKKVVNFCSYIIRGSLAKLYAAKYKLRSRAKVYKIASRNLSRPLKDKKGQSPEYHNLLRMGLVDSIDGLQYTRMSMVPDPDYTPLPFGWRPDHEKILLEYIKLTDQQTLKEQRNCIREDGLITPQDNISMLVWGYKKNAVLLPSKVSDAQGSTEDLGSDTDELNEKELGNEGNQSFQKLAEMS

SEQ ID NO: 92835 - DNA, 978 bp, Zea mays
  misc_feature: Ceres CLONE 1581807
  misc_feature: Translation starting site: 543
  misc_feature: SWISSPROT Homolog: EC 5.1.3.2 UDP-glucose 4-epimerase
  misc_feature (353)..(353): n is a, c, t, g, unknown, or other
ctcaccgcggtggcggccgctctagaactagtggatcccccgggctgcaggaattcgtctcacccctagaaaaactccctccattccatcgtcttcgcttccactcctcacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaggaccgtgctggtcancgggcggggcgggctacatcggtagccacgccgtgctgcagctcctcctcgcggggcttcgcgccgtcgtcatcgtcaacctcaacaactcctccgagctgtgcgtccgccgcgtcgccgcgctcgcgggggaccactcccgcaacctctctttcacaagattgatctccgtggacaggagcacgggaaatgggttttgcttctacaagatttggagctgtcattcacttcgctggattgaaagctgtgggtgaaagcgtacagaaaccctttactttattatgaacacaacgtctttgggcacgataaatccttctaaaaattatgtcctgtttacggggtgccaaaaagttgggtgttctcatcctccagctgccagtttttgggatccccccaaaacccccccttgccccaaaaaatttccttcttatctcaaaacaatccattttggcaaacaaaggcccggtggttgaagaaatttggccgggaattttaccgtcccaatcctgaatgggagaactttttccctagggcctccaccccggtgggcgccctcccacgggaaccttggggaagaccccgggaatttcccaaatcttttgcccctgtttccaaagtggggggg

SEQ ID NO: 92836 - DNA, 910 bp, Zea mays
  misc_feature: Ceres CLONE 1581809
  misc_feature: Encodes the peptide sequence at SEQ ID NO. 92837
  misc_feature (572)..(572): n is a, c, t, g, unknown, or other
  misc_feature (796)..(796): n is a, c, t, g, unknown, or other
  misc_feature (885)..(885): n is a, c, t, g, unknown, or other
ggagctcaccgcggtggcggccgctctagaactagtggatcccccgggctgcaggaattcgtctcacccctagaaaaatttgccgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgngtcaacctgcccatggcagtcggcttcatgctcctctacaccaagctcgccgatgtcctctccaagggagcgctcttctacgccgtcatcttcccgttcatcgccttcttcggcgcctttcgctacgtgctctaccccatgcgcgacgccatccaccccactgcgctcgccgattgcctcctcgcctcgctcggggccagcttcctcggaaccgttgccatccntcgcgtctgaagctttctgctcttctacgtcatggccgagctctggggcagggtcgtcatatccgtcccttttcgggggtttgccatcngattacacagtggaaaaggccaaag

SEQ ID NO: 92837 - protein, 220 aa, Zea mays
  misc_feature: Ceres CLONE 1581809
  misc_feature (65)..(221): Pfam Name: TLC Pfam Description: TLC ATP/ADP transporter
  misc_feature (143)..(143): Xaa is any aa, unknown, or other
  misc_feature (218)..(218): Xaa is any aa, unknown, or other
MESGLVASHRLRVPPPSASAGHHHLIRHRHAHAPVAAAPLRLSLPRHLPRSTPLRLPAALPLRHCLPPLRAASAAAAAVPAPGDDASPKFLGVETKTIKKIVPLGLMFFCILFNYTILRDTKDVLVVTAKGSSAEIIPFLKTXVNLPMAVGFMLLYTKLADVLSKGALFYAVIFPFIAFFGAFRYVLYPMRDAIHPTALADCLLASLGASFLGTVAIXRV

SEQ ID NO: 92838 - DNA, 920 bp, Zea mays
  misc_feature: Ceres CLONE 1581810
  misc_feature: Encodes the peptide sequence at SEQ ID NO. 92839
ctccccgcggtggcggccgctctagaactagtggatcccccgggctgcaggaattcgtctcacccctagaaaaacctcgccgtcgcggcagttgccgccggcggggctgcggcgaacaccaccctcaccgcgtccctctccggcaaccagatcaagatcatctggtccggactcccggccccggacggcctcgactacgttgccatctactcgccgccgtcctcccgcgaccgcgacttcctcggctatctcttcctcaacggctccgcctcctggcgcggcggctccggggagctctccctcccgctcctcccgacgctccgcgcgccctaccagttccgtctctttcgctggcccgccaaggagtactcctaccaccacgtccaccacgaccagaaaccggctccccccacgggcaagcaccgcggtccccgtcctcccgccgacgttctccggtcggggaaccccccccccccccccgaagaagctgccaccctccccggtttggccggaatgaaggtccaaaccaaaatgccgggggcccctggtttcggtggggggggcgcaaccccccggggggaaaaaaggggttcctttccaggggtacccggggccttggcctaaaagggggggggaccccacacctagggggttggggaaaaaggggggggtggggggccaccgtgattttgtttaagcaccccttaccgaaaacccaaaagggccccctttggtggcgcaaatatggggccggggcccaaaaaaaacacagtgttgtccccctggggaggggggacccccggggaattttcttttctttttaaaagggcgccctctttgtataaggggatttttgtgcccccccccaatgagaggaggatattttttttttaatgaggggggggtgggtgggaacaccc

SEQ ID NO: 92839 - protein, 36 aa, Zea mays
  misc_feature: Ceres CLONE 1581810
MKVQTKMPGAPGFGGGGATPRGEKRGSFPGVPGALA

SEQ ID NO: 92840 - DNA, 1013 bp, Zea mays
  misc_feature: Ceres CLONE 1581811
  misc_feature: Encodes the peptide sequence at SEQ ID NO. 92841
ggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctccagaagaagcgccgcgatgggtttcccgcctccgccgccggtgtgccgccgatgggccactccaccgcgcttcagcataagctcgatggcttgccggccatggtgcaggccgtccactccaaagacccctccgtgcagcttgaagcccccacacagtcaggaagctgcttttctatagagcggtagtcccccaatcaaagaagggatcagcaccaaggacgggtgcccgcgaattcttttgatttttctaaccccttggaggacccaccccctaaatcccagttttgagggcggcagtgggccactacacccaaaatttgtcattctgggcaacatcacaaaaaacaacctacagtggggtggtcttgaatatgggtggctgtagcccattctttctggtaaaggcaactctaaactcccctataaggaaggagggttccttaacaaagggctgatagggccttattaggtaaggttggccgggaaccacccccaaattgcccgcggtcctgtttctgtgtgtaagggaggggtataatccattttgacgcagaggcttatagaggatgggtaacctttcttgtcttattaaatcccatggtgtccctctcccctctttgtggggggaacccacaccatattgttgaaatttgcgttccatttacagcgctttccccttt

SEQ ID NO: 92841 - protein, 106 aa, Zea mays
  misc_feature: Ceres CLONE 1581811
  misc_feature (4)..(97): Pfam Name: IBB Pfam Description: Importin beta binding domain
MSLRPSEREQMRKGNYKQTVDAEESRRRREGQMVDIRKAKREESLQKKRRDGFPASAAGVPPMGHSTALQHKLDGLPAMVQAVHSKDPSVQLEAPTQSGSCFSIER

SEQ ID NO: 92842 - DNA, 1149 bp, Zea mays
  misc_feature: Ceres CLONE 1581813
acccgcggtggcggccgctctagaactggtggatcccccgggctgcaggaattcgtctcacccctagaaaaaccctattcctcctcagcataccccttcttccttcgtccccattgatccccttcccccctccactcgtctcccaaatcgccagcgagcgccatgccgccgcctcccctgccctcgccgcccctgaccggctgacccgacctccccactgttctttcccttccacctgggcgccacagcgtttcccttcccgtcaccacgatatcccggagggacgaggagggagttcgtcgcctgatcgatcggccgatccacgccgccgggctcccaatccttcgctggcgccaggttcaacaagaataatcagaggggaaacccccagggggcccgcggggacaacccggaagtcgcccccgcgccccgcagcggccttcttttttcctcccggaaacggttgtcggggggcccggggggaaccccccccccgtacaccgttaaaacccgcccttccgggggcaaaggggccttttttccgtgggtgtgcccacattttttcccaaacgtttgggcccccttccccgtttttgtgcaaccaaacccgcgcgggggggggggggtggggggggttaccacctccccccccttgaaggggggcttctccggttcttccccatgggaaatatgtcccccccctccaaaaaaaaggggtggggggggcccttctctccctccggaagaaaggctcccccccgccgaggagggggaggcgcttttctataacctccttggggtagaatccctatagaagccccgcggcggtgaaatgaggggggggccaacacccgggggcggcccccccctaggctgtgtaaaaatatatggggagggggcccccttttagaggggagggggggggaaaaagagcgctacgggccctccgataaaataattataagagggaggggtgttattggtagcattttgtaaaaaatacttgtccgcccgttctcccccttggtatatagtatctcccccctaataatactctgggtccgcccgacaaaagagaagaagaattgttgcctcccgccccacctcccgcggcgttgattgccctccctccgtgttgtatcaaaacaa

SEQ ID NO: 92843 - DNA, 1052 bp, Zea mays
  misc_feature: Ceres CLONE 1581820
ctccccgcggtggcggccgctctagaactagtggatcccccgggctgcaggaattcgtctcacccctagaaaaaccacccaaaagacaccgcgatcccgtgcttccttctcgcacctgcggatctactctccgcacctgcggatctaccccccggcgaaacaagcgccccgacgcctcagggaatgcggagcgatgaggcggcgctcaggcactgacgtcgccggtcagcgcgagctgcgcggcgaccgaacctgccatcgcaagcacgtcgaggacgggtagactcgtccatccttccttcctcttgttagtggtcgtagggtagtttgcactttgcagatagctagctagctagtaattaggggatcaggcctgggtgaagggcaacccaaagttaaaggggggggtgcttcaaggccccttacaatttttgccccgggctggggtcccggaaatttttgggggcggccccccggggggggtgaccttgccccccggggggggccctggggggggaaaaggtgtccccaaaagaaaaaaataatctcccccccgggcgttttagggggaaaaaaaataagcgccaaaaactccctccctttgagaagggggggggcccccccccccaatattgggtggaggtccccccccaggggttgtggggcccgcgcccccacaaaaaaaaccttccctccggggggggacccccccccggagggaggggggatatcttctccccacaaaatttagcccccccgggcggttctatagaaaaaagagggggggggcggcctttttttggggagcgttcccaccccggtgtttatatttcccccccgggggggggtgctctcccccccgcagctaataaagaaccttccttacaaaagggaagaaaaaatatggttttttttttttttggtgtgcggtgtcaccacacacgggggggtggtgttctcttttcttccgcgggctttgtcttggggggtggggattaaacccgcccccttttttgtgttggcatttttctctcctgggggggggagaagaa

SEQ ID NO: 92844 - DNA, 986 bp, Zea mays
  misc_feature: Ceres CLONE 1581821
  misc_feature: Encodes the peptide sequence at SEQ ID NO. 92845
  misc_feature (971)..(971): n is a, c, t, g, unknown, or other
agctccccgcggtggcggccgctctagaactagtggatcccccgggctgcaggaattcgtctcacccctagaaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacgcagaccgtgctggacgagctcaccgggtacgcggagcccgggtcgctgaccgcgctcatggggccctcggggtccggcaagtccaccctgctcgacgccctcgccggccgcctcgccgccaacgccttcctctccggcaacgtgctcctcaatcgccgcaaggccaagctctccttcggcgccgcggcgtacgtgacgcaggacgacaacctgatcgggacgctgacggtgcgcgagacgatcggctactcggcgctgctgcggctgccggaacagattgcgcggggaggacaaccgcgcgctggtggaaggcaccatcgtcaagatggggctgcaggactgcgccgacaccgtcatcgggaactgggacctccccggggtcagccgcggggaatagcgccgcgtcagaatcgggctcgagctaataatgggccgcgcctccttttcttgaagaagccaccaggggcctcaaaagctcgttgggnttttcgtgaccaaat

SEQ ID NO: 92845 - protein, 256 aa, Zea mays
  misc_feature: Ceres CLONE 1581821
  misc_feature: SWISSPROT Homolog: EC 3.6.3.30 Fe(3+)-transporting ATPase
  misc_feature (252)..(252): Xaa is any aa, unknown, or other
MRRVGGDLQGDGTTPRSAAAGQAMMELQANGSAAVGGAMVVGLSPLSEALWRDSKALPPGAGPAALIGDVSARLTWKDLCVTVALGPGKTQTVLDELTGYAEPGSLTALMGPSGSGKSTLLDALAGRLAANAFLSGNVLLNRRKAKLSFGAAAYVTQDDNLIGTLTVRETIGYSALLRLPEQIARGGQPRAGGRHHRQDGAAGLRRHRHRELGPPRGQPRGIAPRQNRARANNGPRLLFLKKPPGASKARWXFRDQ

SEQ ID NO: 92846 - DNA, 987 bp, Zea mays
  misc_feature: Ceres CLONE 1581826
  misc_feature: Translation starting site: 208
  misc_feature: Pfam Name: DUF618 Pfam Description: Protein of unknown function, DUF618
  misc_feature (434)..(434): n is a, c, t, g, unknown, or other
  misc_feature (445)..(445): n is a, c, t, g, unknown, or other
  misc_feature (574)..(574): n is a, c, t, g, unknown, or other
  misc_feature (575)..(575): n is a, c, t, g, unknown, or other
tggagctccccgcggtggcggccgctctagaatagtggatcccccgggctgcaggaattcgtctcacccctagaaaaaaaaccctctctgcctcgtcctccctcctgcttcgtgcttccccttccccgtctcgtctgcggcgccaagctcgagctcatcgccaccgagcctatccgcgaggaaggtaaattagttggagacttcgtgatggctgctgcgaagtcgggcgtagacgtggaaacgagggacggcggcggcggctccttcagcgaggagaggtttgttgataagctcaacaagctcaacaacacaacagcgagcattcagacactttcacattggtgcatttttcaccgcaagacggccagaaggatagtggacacatgggaaaagcattttagtactgcaacaaatgataagaaaatatcattccntgtttctatcnaatgatatcttgcaaaacagtaagcgcaaggggagagattatgtgcatgagttctggagggttcttacccagatatttgaaacatttctacaaaaatggggggagagaaggcaaagaaactgggtggcnnaggactattagaatttggggatggaccccaaagttttttggaaccccgtttggaaagtctgaaagaacgggaattttttggggaaaaccctccctattttcaatcccacggggggaataaaaataaattcaaaatcccagccccttaccccccttaaaatccccaaggtgggaaggggaaagattcccggtaccagactaaaaaaacccggcccgggggggggggttcccccaaaaaaaatttgggaccgcccaccccatcccgggtgtgtgaatacacacttttttaagaaaaacacccgccttttaaaaaaaggtataaaaaaaccctttgtgtggtttccggggaaacctctcttaaaaaaatttgtggggggtctccccccccaaggggggtgccccgcggcccccaa

SEQ ID NO: 92847 - DNA, 918 bp, Zea mays
  misc_feature: Ceres CLONE 1581828
  misc_feature: Encodes the peptide sequence at SEQ ID NO. 92848
ggagctccccgcggtggcggccgctctagaactagtggatcccccgggctgcaggaattcgtctcacccctagaaaaaatccacactgagctgcccaaatccacattcccatcggcgcagacggccgggaggaggatgtccatgccggagacgttcaccctgaaggtgggggaggcgacgccggccgccgccggcaggccgtcggccgggcccgtgtaccggagcatctacgccaaggacggcctcatggacctcccacaggacatccagtccccttgggacttgttcagtggggcagtcaagaagtaccccacgaacaggatggtcgggcagcgtcaggttacagatggcaaggccggtgagtatgtgtggcaaacgtacgaggaagtgtgccagaaggtcatgaggattggatcagcgatcagaagcctgggcgtagagccgggagctcactgtggcatatatggatccaactgcccggaatgggttatggccatgcaggcatgtaacagtcaagggatatgttatgtgccactgtatgacaccctcggagctaaagctgttgaattcatcatgtaccatgctgagatatccattgcctttgtccaggagagcaagatcaaatcaatactagcagttctccctaagtgcacagcgcaccttagagccattgttagtttcggagattttgcagcgagatgaaagcggaagctgagagattgggcgtctcctgctttttctgggaagaattttcttcatgggaaaacagactaccaccttcccataaacgtaagggagaattctgtccatcctggtttccaggggaacaacgggagatcccaagggtgggattatcccaacaaggctttcgttgcgggtgttttgaccccgaaaccctccccaaggaaccgttaagtg

SEQ ID NO: 92848 - protein, 186 aa, Zea mays
  misc_feature: Ceres CLONE 1581828
  misc_feature: SWISSPROT Homolog: EC 6.2.1.3 Long-chain-fatty-acid--CoA ligase
MPETFTLKVGEATPAAAGRPSAGPVYRSIYAKDGLMDLPQDIQSPWDLFSGAVKKYPTNRMVGQRQVTDGKAGEYVWQTYEEVCQKVMRIGSAIRSLGVEPGAHCGIYGSNCPEWVMAMQACNSQGICYVPLYDTLGAKAVEFIMYHAEISIAFVQESKIKSILAVLPKCTAHLRAIVSFGDFAAR

SEQ ID NO: 92849 - DNA, 1091 bp, Zea mays
  misc_feature: Ceres CLONE 1581831
ctccccgcggtggcggccgctctagaactagtggatcccccgggctgcaggaattcgtctcacccctagaaaaaaaagctcagcttgataggcttttctcaataacgcgccgtcgacgtttcttccccctttttctttgagaatactcgcccgcgagatcgttagtttcgcaccccgagtggattagttcgctgctcagagctaggcggggcgccgatcgcggcggactacatcttcaatccactcccctcggtggcctggaaaatatgctcttgctatgtcccccctccaactcctagatttgttctcacaccttagtcctgatctctcgcgagcgcttcttgctgatagaaagggacgaattcctcccttctggacccatagatagcccacccctttccgggctaggttatcctgcggacgaaaaacaaggccgtgaattcggggaccgagaaaaaatcccactttctttgttcccctggcttggccttggcatttggcttaaaaggaaaaggggtggttttccatgggggttttcccacaacaaagaataaaagaattgccggttctttggaatttgacccccaggggaatgtctattcccccttgggtggggccggggctcttcccaccctcgccaaaatgactgactttccccgcctcaagagaaaatgagggccgtaaggagaacctttaattcaaaggtggtcgccccgccccctttaacctccccgagagttttgctatgtcgcccccatagcggccaatgggagcggtgtgcggtgtaaccgggggtattcccgggtgttaacccatccccgttgtgtatattatgagcacctcttcccttgtaatcccgcgcccccgtggcgagaggccaatctcccacccggggtatataaaaaatctccccgctaatcaccccccctcgtctctggggggggggccccggggtaacttctatgaggggacccagatttcggggcaaaggtgttcgggacacaatacggggggttccccttttcccaaaaacagaaaaggggccggggggcctcatgtgttcactcctccccccacaggtggctcggctc

SEQ ID NO: 92850 - DNA, 1333 bp, Zea mays
  misc_feature: Ceres CLONE 1581836
  misc_feature: Encodes the peptide sequence at SEQ ID NO. 92851
tccttcgttgattccccgaaggacgctcacattataaaacaaccctctctctctgcgtttatatttggactccccgcggtggcggccgctctagactagtggatcccccgggctgcttgaattcgtctcacccctagaaaaactcgaactttgaacaccaaagaagaattgctgccttgctggtctgggaagcactttctttcactccttccctccccatttcctactgacggtcgagggggggcacattctttggcttttgtcccggttttgccctccggctcctgccgagctcagcagggggaggcgctgcgcttcgcttcacgctagaccatacctctgcggccaccagtttgcctacatgtccggccacttcctcccctcgtccttgccgttgtcgtcctcttccgccctggggattgcgtccgtggacaagttccccaagctaagctttctataacccccttatgcctttatccttcatagccgtgcatcaagggcctcttagcggtcctccatgaccaacatcacccccctagtacgccgccttaattgctcgaaacctttaatccgtttttgacaagaaccaccttttactgcaatcaatatgttataccaattatactcctgtcagaggagtactatttttcagaccttaggtctccgcgggcagtcacctcttttaaatttttaaaaatactgacgggataagggattttggcggggaatcatagctatacgtgtcctggcccatctataagctttcttctagaccctgaaaccttctgtaagaacactttgtgcagctagcccttgggttatgtcctttggcacatcgtgaatatgtgtcttcgtatgcctgattatgttgatccacgctgtccgattctctcatgagttcacacagagccctccatgatatatgttggcgcgaataaagcgctgtgtatcatggtcagaacgatattctgcatacatgttattccacgccatgggttatgcccgagtggagttctgtggtatccacgtccgccactgcctataatggcgaacctattgtcgctcatttattacccactccgaccatctctgtataagtgtcactataacaaatctcgtctttaaaagacgccggaggagtaattacatacaacgcctgtataatatatttaccgaatatacaccactgtctcatccaattgttttatttgtactgcaacatcatgtcagctcgtctactgcgcctacgctgagtaataaactagccactagtctgtaatatgatgttacgtataccacgctacctattatttcctctataaacatcggagct

SEQ ID NO: 92851 - protein, 32 aa, Zea mays
  misc_feature: Ceres CLONE 1581836
MSGHFLPSSLPLSSSSALGIASVDKFPKLSFL

SEQ ID NO: 92852 - DNA, 1062 bp, Zea mays
  misc_feature: Ceres CLONE 1581837
  misc_feature: Encodes the peptide sequence at SEQ ID NO. 92853
gcggtggcggccgctctagaactagtggatcccccgggctgcaggaattcgtctcacccctagaaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccatgaagagagcaccctccaccttgttctccgcctcatgggaagcaaccccatcttcgtcaagaccctcactggaaagaacttcaccctccgaggtggagtcttctgaaaaccatccaacaacgtcaagggccaagatccaggaacaagggaggggctccctccgggaccaacagcgggtttcttttttgctgggcaaggcagctccagggaaggggggccacccctgggccgaattaaaaaacatttcgaaaagggaaagcacccccctccccctttgggggtttcgggttcccccgggggggcggataggaagaaactccgcggggaaaaaaccctgagggggggaaaaaaatatttcccccccttggagggggccaaggttctctttgtaaaacccctcttacaaatgtttgcagggggcaataatcccgcggaatagggggggggctcccccccccggaaacacaaaagggggttttttttttttgccggggacaaacttttctggagagagggggccactcttgtcaaataatatatttttgtgagaggagggcccccccccccttggtggggcgccctcgggggggggggagacacatttcttggaaaaaaccctgggggggagagaacacccccgtgtgggtggcgccccgccaccctcattttgttggggccattccggaagagggggtttccccccccaccatgggtcttttgttgtg

SEQ ID NO: 92853 - protein, 96 aa, Zea mays
  misc_feature: Ceres CLONE 1581837
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIHEESTLHLVLRLMGSNPIFVKTLTGKNFTLRGGVF

SEQ ID NO: 92854 - DNA, 955 bp, Zea mays
  misc_feature: Ceres CLONE 1581838
  misc_feature: Encodes the peptide sequence at SEQ ID NO. 92855
ccgcggtggcggccgctctagaactagtggatcccccgggctgcaggaattcgtctcacccctagaaaaacccagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcattccaaatcatgaagaaaggccgacttaaaggacagaacatcggttgtccttcatgtacgatgaacatcccgcatagccccggaaaatcccaaggccggggggtcatcataaatcatcccccagggggggcaaacttccatggcctgggggggcaaaaggattaacccgggggcaaaatgtccaacgtccaaacaattttcttcgcttggttctggtttgggaaacaaaaacggcacctcccaggggggggggaaaccgccaaagggtttttggaaaagggggcccccaagaaagaaaataatatttggtttttcccacccgggaaccctgggggggggcccggggggccccctggaagaggcccacccgtgtccaattttctcttaggggggaaagaccccccaataattttctccgaaaaaaaaaaaaatgtcgcccgcggacctgcaaaagaacccggggtttttttccccggaaaacagggggaattttggggacaactctttagagggcccccgccccaaaaagaaaaaaatggttttgtgccacacccccctcttaatttgaaggagaaga

SEQ ID NO: 92855 - protein, 126 aa, Zea mays
  misc_feature: Ceres CLONE 1581838
  misc_feature: SWISSPROT Homolog: EC 3.4.22.34 Legumain
MVADRLRLALLLSACLCSAWARPRLEPTIRLPSERAAADETDDDAVGTRWAVLIAGSNGYYNYRHQADICHAFQIMKKGRLKGQNIGCPSCTMNIPHSPGKSQGRGVIINHPPGGANFHGLGGQKD

SEQ ID NO: 92856 - DNA, 1024 bp, Zea mays
  misc_feature: Ceres CLONE 1581839
  misc_feature: Encodes the peptide sequence at SEQ ID NO. 92857
  misc_feature (879)..(879): n is a, c, t, g, unknown, or other
ctccccgcggtggcggccgctctagaactagtggatcccccgggctgcaggaattcgtctcacccctagaaaaagggttcggacccgaccgcacgcggttcaactggtttctggtttctctccttctagcaccactgccgagtgccgaggcaaaaccctagctcacctccatggatagccacggccacgtctctggcggcaagcgcaagggcaagcgcgcccgcaagccggagccgccggtactcgcctctcccgacaacagccacgaccacaagcaccacgacaccgcaccatcctcctcgcccctctccaccgccgccgtcgcggcgtcagactccccggaccccgagccggcgtcatcctccccagctccccgccgccggggccgcaagtcccgccgcatccgcaacgggacccactccgaggtcgatgccgccccctcaccctcgcctccgccgcgtcggggcgggcctaagggggcgccgaacggtgcggtggacgttgcggagccgtctcggcgggagctggcggttaagatggtggaagttcccgcggcggtggagcccctgcgttgggaccaggtggtgaaggtggtgccctcgatggacgccgtggtgaaggtgttctgcgtccacacggagcccaacttctccctgccgtggcagcggaagaagcagtacagctcgagcagcagcggggtcatccttggggggccgaagggtgctcactaaacccccacttcggttgagcattacccccaggtcaagctcaaaaagctttggctcgggaaacaagatactttggcgacttgtccttgccattatggaccgaagggggacattgcaatggtttaccgtgtgaagaaagatgaaattcggnaaaagggtttccccccgtaaaagtttgtggcccctccacaacacttttgggattcgcgcccccggtttgtggggttcccaacatgggggggggataacttttcccgcgggaaaaagaggggggatttttcctaagaaaaaaaaat

SEQ ID NO: 92857 - protein, 186 aa, Zea mays
  misc_feature: Ceres CLONE 1581839
MDSHGHVSGGKRKGKRARKPEPPVLASPDNSHDHKHHDTAPSSSPLSTAAVAASDSPDPEPASSSPAPRRRGRKSRRIRNGTHSEVDAAPSPSPPPRRGGPKGAPNGAVDVAEPSRRELAVKMVEVPAAVEPLRWDQVVKVVPSMDAVVKVFCVHTEPNFSLPWQRKKQYSSSSSGVILGGPKGAH

SEQ ID NO: 92858 - DNA, 859 bp, Zea mays
  misc_feature: Ceres CLONE 1581841
  misc_feature (766)..(766): n is a, c, t, g, unknown, or other
ctcccgcggtggcggccgctctaactagtggatcccccgggctgcggaattcgtctcacccctagaaaaacccctctttctcggcttccactctcccgcctccactggacctcccccaactgcgagggagtgagagagatctgcatcagctcgggggcctggcagggcagctgcattgcgctgcggcaggcggcggccatggccgatttctacggggactgcttagggccatccctcttgagccgggagccttaacctgtagccgttccctgtgcccccgccttaatcccgcccttgagatggggggatttttttccccccccccccccgggttccccattcccctttccgggggtccaattcttcccccccccctctgggtaaaaaaaaacttcggttttttttccgggggggaaaacaccccatcccctgggggggatatattgcttccctctagggctggttttttattcatatgggggcgtctctctctttccccccttttttttcttttcaaaaacacacttctcccttggtttgggttgtaattcaattaaaaatagagggtgcgcgttttttgttttccatgaggggtatggtctttttctttttctgccctaggagattatatttttgttgttcctatcccatactccttttttgttttctgttgggccaatatacccgctttcatttattttcatcttccactttgtattatatttgtcccccccccccccttcttttttcttgttgatattaacantaatctcctttccccccttttccttgttttgccccgcttaattatttttttttctcctcccacacggggccccacgtcttctcgtctctctca

SEQ ID NO: 92859 - DNA, 1046 bp, Zea mays
  misc_feature: Ceres CLONE 1581842
  misc_feature (352)..(352): n is a, c, t, g, unknown, or other
  misc_feature (398)..(398): n is a, c, t, g, unknown, or other
  misc_feature (974)..(974): n is a, c, t, g, unknown, or other
  misc_feature (975)..(975): n is a, c, t, g, unknown, or other
ctccccgcggtggcggccgctctagaactagtggatcccccgggctgcaggaattcgtctcacccctagaaaaagcatcccttcttcagccgcacgcttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctangggtggcaaaagtctagcagtagtcgttccatgatgtatgaagctnccttgggctacagcattgaggacgttcgacctgcccggaggcctgaaaaattccaagtcggctggtttatccaacgtgccgaagaaaccccccgggaaccccctttggggtccccaatttaaagagtttgagatttttttttccgaaccttttttttggagaaatttcttgtgggggtggggttttcttaaattaaaaaattcccccatttggttctttgtggcccccccccccccccctccccaactttgtgttttgtttcccccccccaagggggggttttttctcggggggggaaccccccccgcccccccattggggggggggggggataaaaacaacctttaatttttctcttttcggcacttctttttttacaacacaggggggtggggtgcccccccccccaaatatattttttgtgggggggggggggtccccccaaaaataaaaaacccccccgcggtgtttttttttttaaagaagaaggggacgccccccccccccccaacaaaaatataataatttttttgtggtggggggcgcgccccccccccccccccctccccaaaaagnnggggggggtgggttggggggcgcgccccccccccccccgcccttccttttttttttttttttttttttttt

SEQ ID NO: 92860 - DNA, 955 bp, Zea mays
  misc_feature: Ceres CLONE 1581844
  misc_feature: SWISSPROT Homolog: EC 5.3.1.5 Xylose isomerase
ctccccgcggtggcggccgctctagaactagtggatcccccgggctgcaggaattcgtctcacccctagaaaaagagttcagcagaactctcctccgccctcttccatgtccagcatagatagggggcgcgtgggcatcggaaattgcctcgggagcacgtttcctggtcaactaatgccggaatgaagggctgctcagagcgcttgctgtttctgctgctgctgctggcatcatctgcgctactgacccactgtgattgccgcacaacatacttgacccgccgacctcgacagccaatgctacggctggcgcgtctgatgatgatagggagggggagttctacccctgcgtccctaatatcaagtatgatgggccaacaatcaagaacactcttacttataagtggtataactaggaggaagtgatctcatctcaacaagatgatggattggatgcctttcagggtcgcgtcctggcacacggtacccgcggtactggcgctgatcctttcggagctcctacagagacttagacatgctacgatggcacatattcgatggccatggctaagagatgaatgacagctcactttgagttcacggagaagtcgtgaatctacaaaaggtgctggcatgacacgcatattgccacggatgggaagacacttgaagcaacaaatactaacttggatgagatagtgcacctggcgaaccacctgcaggatgagaccaatttaatacctttgtagggtacccgcccagcttgttttgcttccaccttacagcatggtgcctcctacacagccagatgtttaactactgctgtatgcagctgcaaaactaaagaagctttatatggacctcactaccttgtgggacaaactatgtgtttcgggttggaagaaaggttaccaaaccttctgatacggtatgcagaaggattcgcatctgccta

SEQ ID NO: 92861 - DNA, 898 bp, Zea mays
  misc_feature: Ceres CLONE 1581846
  misc_feature: Encodes the peptide sequence at SEQ ID NO. 92862
  misc_feature (898)..(898): n is a, c, t, g, unknown, or other
ctccccgcggtggcggccgctctagaactagtggatcccccgggctgcaggaattcgtctcacccctagaaaaagacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggaactacgaggcttgagcaagtgagcttggatgcccttgccgctccttgggaacagaagtttgtttgagtattatctggtggccctgggtgaaaaagcataatttagcgctctgtgttgttccccagatttaatctggctgaaattaagggggaattggtttgagttttcggccttctggcccggttttctaattttcccggggttgggaaaccggcccatgggacctgtaataaaacatgtgcgggccaagtttgggttaaaaaan

SEQ ID NO: 92862 - protein, 149 aa, Zea mays
  misc_feature: Ceres CLONE 1581846
  misc_feature (2)..(135): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWNYEA

SEQ ID NO: 92863 - DNA, 934 bp, Zea mays
  misc_feature: Ceres CLONE 1581847
  misc_feature: Encodes the peptide sequence at SEQ ID NO. 92864
  misc_feature (389)..(389): n is a, c, t, g, unknown, or other
  misc_feature (934)..(934): n is a, c, t, g, unknown, or other
ggagctccccgcggtggcggccgctctagaactagtggatcccccgggctgcaggaattcgtctcacccctagaaaaaacgccatccgttccatttcttatcccctctcctccggtcctcccccctcccctcgatggcgtccctcacgctcccagcactcgctctcgccctctctaaccccggcgccgtccgcctacgcgccgcggccttccgctgctgggcgctccggcggcgcggctgggcggcggcgggcgccctggcctcgcccaactccgtgcttagcgagcatgccttcaagcggctccagctcgggagcgacgacgaggacggggaagggccgtacgggagcgacgccgacgaggggttcgaggcgggggagggggacaacnacgagctcgccattgccaggctcggcctgcccgacgagctcgtcgccacgctcgagaagcgcgggattacgcacctgtttcccatccagagggctgttgtgattcccgcccctcgagggccgtggacctgattggcagagcaaagactggaactgggaaagaactggcctttgggcttacccatggaacaaagcaattttatcgaggcaagaccaaggggcggaattacaaggagagggccgtacccccctcggggttccgggtcttagccccctccccgaaaggtgagccaaaacagggccagaaaggaaaaaaaaggatttcggccccccaggctccggccaagtggtgggtttttgggggggggtctcacaataaatggaccaaaaaaatggcacccccccccgggggggccaaagttagttttttgtgaaacacccggggcgcccaaatacgaattttgaaaaagggcgggaaaccccctccagtggggggaaaaaaatcatatattttggcccgcgggaaaggaggggtaaaaaagaggn

SEQ ID NO: 92864 - protein, 128 aa, Zea mays
  misc_feature: Ceres CLONE 1581847
  misc_feature (86)..(86): Xaa is any aa, unknown, or other
MASLTLPALALALSNPGAVRLRAAAFRCWALRRRGWAAAGALASPNSVLSEHAFKRLQLGSDDEDGEGPYGSDADEGFEAGEGDNXELAIARLGLPDELVATLEKRGITHLFPIQRAVVIPAPRGPWT

SEQ ID NO: 92865 - DNA, 950 bp, Zea mays
  misc_feature: Ceres CLONE 1581851
  misc_feature (497)..(497): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (722)..(722): n is a, c, t, g, unknown, or other
  misc_feature (723)..(723): n is a, c, t, g, unknown, or other
  misc_feature (796)..(796): n is a, c, t, g, unknown, or other
  misc_feature (810)..(810): n is a, c, t, g, unknown, or other
  misc_feature (921)..(921): n is a, c, t, g, unknown, or other
ctggagctccccgcggtggcggccgctctagaactagtggatcccccgggctgcaggaattcgtctcacccctagaaaaaaggccagccacacacctcgccacggcaccaccctcttccacctccatgccagaatccatgctttcagagctaaattaaccacgcttcgctcatcgctcctcacacctccaaaataatccagtctcagcccccacactgcccgcaaatccaacctttttgggctcaatcaacctccaaatctacctttttcgtcactccatcctgtcctaaatcccctccctcccccccaaagtcatacctttcccactgcgccccccctgcagaaatccatagattcttcgccacttcgattgtccgctgcatgaatccgactccgcgcgcccaattccctgcaaagccccagtctctggcgatttttttcttggaagatttcttcattctttagtggcgcccaattctgctgggagggggttcttngggagggagatccaccatttcgtttcggcttgagcagccggggagctgagcagcgcggcgcccatgtcggactccgagctgtccagggcacgctagtgttcggcctccacctctgggagctcgtcggcatcggtgtcggtgccgcattcgtgctcctcctcgtcctcctctccctgctctggctcnnntcgctccgcgccgccgacgccgccgtgctggccccgnntctcactcccccgcgtcgtgcctatggccagcccagcaccccgccagccccccaggacatccaagagtgcccntccgcggacgcggncccgccgcccggccaagcgcgctcgcctagtgctgcaggcgcgccgccggactcatcagatcgagacgggaagagcacgtatcagtcccggacaacgcgccccgcacccancggaacgggggccgtcttcgggcgcaagg

SEQ ID NO: 92866 - DNA, 887 bp, Zea mays
  misc_feature: Ceres CLONE 1581852
  misc_feature: Translation starting site: 189
  misc_feature: SWISSPROT Homolog: EC 1.4.1.2 Glutamate dehydrogenase
ccgcggtggcggccgctctagaactagtggatcccccgggctgcaggaattcgtctcacccctagaaaaagtccacccattcctcgttcttccttaattcctcatttcctccacgtacgcgtgcatactctgcgagtccaggaggtattttcccccttcttcacgatactctcgacgagagcgtctccatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcatgggcgaggagaaacagttctcggccgaggagatcagctccatgatcctgaacaagatgaaggagacggccgaggcttacctcggcaccaccatcaagaacgctgtcgtcaccgtcccggcctacttcaacgactcccagcgccatggcaccaaggaacgcggcgtcatctccggcctcaacgtcatgcgcattcttcaacgagcccaccgccgcggccatcgcatacgggctcgacaagagtcgagcagcgaccgcggagaagacgtcctcatcttcacctcggcggcggtacctttgacgtttcgccctcacatccaaggagggatctttgaaggcaggccccggcgcggaattccacttggg

SEQ ID NO: 92867 - DNA, 883 bp, Zea mays
  misc_feature: Ceres CLONE 1581853
  misc_feature: Encodes the peptide sequence at SEQ ID NO. 92868
ctccccgcggtggcggccgctctagaactagtggatcccccgggctgcaggaattcgtctcacccctagaaaaaagcggctgtctcggcgacccaaccccagcctgacccctcctcccgccgccgccgccgccgccgccgcgccttcgtcgtcaggagaagggtcccggtggctgcgtctctctcccctgcccccctgctccacactcggttcacgcgtcggctcgctaccgcaggccctcgactcgtacgcccgtccccggcggcgatccggccggcaccgtaaccctaggactccgacggagcaggaatgatgagtcatgaacaacaaattgtccctcctagtaagggttctgtgaatgggttcccccatagaaaactggataaggagggcagtggaacgcaaagtagaataaatttggtgaggtcatccctctggtggttttactaattcagaaaatggcatcaaactagggcatggtaagcatttcaggggaccggctaatctatgttctaacaccacttatttgggcatcatgtgggacgtgcatgtgaataacggctcctatatctccgggattttccatgccacataccttgacaagaacttggcggcgtcctaaaaatgctcaagtcataaaaggatgggtcggccggaagaaaagatatcctgctgttcttgtaagaaaactgagactttgatataccggcagggagcttggtcaagtttttgccaggaattagaacttggggcaaaccggcaaaagtcctgcaatgaaaaaggaaggacttgcgatgattccgcttttaccccttcttttcccaaaaagggactggacccggcacccaagggggattccaaggtgttgacggaaaattgacgt

SEQ ID NO: 92868 - protein, 46 aa, Zea mays
  misc_feature: Ceres CLONE 1581853
MMSHEQQIVPPSKGSVNGFPHRKLDKEGSGTQSRINLVRSSLWWFY

SEQ ID NO: 92869 - DNA, 1118 bp, Zea mays
  misc_feature: Ceres CLONE 1581854
  misc_feature (803)..(803): n is a, c, t, g, unknown, or other
  misc_feature (815)..(815): n is a, c, t, g, unknown, or other
  misc_feature (820)..(820): n is a, c, t, g, unknown, or other
cggtggcggccgctctgaatagtggatcccccgggctgcaggaattcgtctccccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgaccactaccgtcagcaccaagcagctgatggcggccaccgtattcttcctgcctgagtcttcgccccaccgtggcaccaccgggccggcgggttccccagtttgtgtggcctttggacaaataccctttaaccgccgccgttggttcttccggctttttttttgtttttgcttgggggacaaagaccggacccccccccccccccccctttaaattattatggaaactggaaccctaccctctttataggggcgggggcctatatatgggggaagttcttcccccctttgggggcgcgttgttcttcggggtccttatattgtgggatggtttttctgggaaccctacgtttgggggtgtccctctttcgagagagcattccccttttaaggagtgagaggtttttttaccccctttttaacaaagatcttttttataacttaaatttgtctttcccccccgctgggggtgttgcgcgcccattatttgccggagataatttttttttttgaaaaaatgggttttgctgatgggacctgtgaaaaatagaagccctttttcccttattcgctcacctttgttatttgtccgntccccccatttnttttnataacacgcgtgtcccgttcgcaatatatgtttttggcgttctcctcttttctctccctgatatttgcgtttcctcactttaacttttataggcgacttgtgtttttgtgtggtccgctcctttatatttcgtggcgtctcccactctgtcctagttttgtgggggtttgattattaaacttcttcctccatcctttttggtgtggattgtggctctctcccccctctttgtgttggttggctgagggtcttttttgctacaattgtattccaccccctctcctttctttcttgttat

SEQ ID NO: 92870 - DNA, 1333 bp, Zea mays
  misc_feature: Ceres CLONE 1581855
  misc_feature (48)..(48): n is a, c, t, g, unknown, or other
  misc_feature (54)..(54): n is a, c, t, g, unknown, or other
  misc_feature (55)..(55): n is a, c, t, g, unknown, or other
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
ttttcccctcccctgacgcgctcccccagctatcctgttcctccaccnccctcnnggggntnntttaaatctggagctccccgcggtggcggccgctctagaatagtggatcccccgggctgcaggaagtcgtctcacccctagaaaaaacctctccgaggagagagagaccgatacagagagagagaccaagaggacacgggtagagaggacgttcatttccgcgtcgtctccgcccgcagccggcagccccaccacccaccaaatggcctccatgcctggtgggggcccacggctcccgcgcccctgaccctatgcaggtgggacgtcccgcttccccctgccgcctctggtaaaagaaaagttcccccccccaaacccaaatctggcggggttcctatgaattgaaagggagttacccggtcccccgtccatttatttccccataacctttgggggggtaaaattgggtaagcctcccccgtgtgtggttgcccccccccccccaaaaatttgttggttaccctgcctccttttacgaaatttcctttcccctcttccctagttcggcggcgtttgtttaataaatcccctctcttgtgttgtcttttccgtatcctccgccccctctttggatttgggagccttatttttcactctacatttgtcctgtggggagtattcccggataatatcttccgttctgcccttcttttttttgcttttccgccctattttatcccccttattttaccatcggtgttgtgtgccactccatttcttgttgtgctctttcatgtgttcttttcttccctattggcagctcctgtttgttttatcacggcgagtgattgttctctttctttcccccaccccccacgttttggtaaaattgcagcctgttgctctccccctgttagaactcttatatcagcgtggctgtactgttatcgcttatcgggacttatctccacctaattggcgtgtttagcttactcccgccgccgctcttttttccattacattcccgaacagccctattcgcagttttctcactcttctcttccacactatttactgccattccacgtgttattgctgagaatcctcgcgccgttttattatgtttttccaccccctgctatttattgcccctccttctcacctgtttgttcactccttgttctgttatatatactgtcacccactgacccgctcccgacaatcgtgttatcactgttgtttcttactctccgccttgtattatatacgtttgcgaggcggcttttattatcccacttttatccacccgcctcctaatgtgtttcggagt

SEQ ID NO: 92871 - DNA, 967 bp, Zea mays
  misc_feature: Ceres CLONE 1581856
  misc_feature: Translation starting site: 236
  misc_feature (489)..(489): n is a, c, t, g, unknown, or other
ctccccgcggtggcggccgctctagaactagtggatcccccgggctgctggaattcgtctcacccctagaaaaaccggccacgctacccttccgtcgctcctccggtcctccccacccacgacccctgccggaagggcaaaaggggctcgaaatcggtcccctgatccaggagccaatcttctagttctcccaaatccttttccggatccgaactgcaagtcctccttcgcgaccatggatccacgcgccaggtatccttcgggcatgggcaacggccgcggtgggacccctaactactacggccgcggcccaccgccgcaacagccgcatcagcaccaccaccagcagcagcagcagacatcgggggcgcatcaccaccagcagtacgcccagaggcagcagcaacagcaccgccacagccacaaccaccagcagcaacagcagcagcaccagagtcagcagcagcagcagcagtggctgcggcggtntcagattgcccgcgaggccccgggcgcagcccgtgacagcgagccgaaggccctgggcgcatccacgggcggccgacggcgtccatttcgagttcgccagattggaagacccaattgaagcttcccgcctcctgatacacgctacaggaaagtaggatgttacagccaccaaggggaaatgagtttggaagactattttcccaagcgtggaactcctaatggggtatttacgaaaaagggatttggaaagaccctctcctatttccagaagaaaagccattcctattgccttaacctggtagggaaattccttggcagagcgaaaaatggaactggccaagaacgccgccattttgttttttccggccccggaaaaaattggtccaaaaaaaaaatgccttttcaaggtgtttaaattgggttcccacaagggatatgggtcctcacaaaattacaaatttgttaagaaacctgggaa

SEQ ID NO: 92872 - DNA, 1014 bp, Zea mays
  misc_feature: Ceres CLONE 1581860
  misc_feature: Encodes the peptide sequence at SEQ ID NO. 92873
  misc_feature (329)..(329): n is a, c, t, g, unknown, or other
  misc_feature (330)..(330): n is a, c, t, g, unknown, or other
  misc_feature (410)..(410): n is a, c, t, g, unknown, or other
  misc_feature (481)..(481): n is a, c, t, g, unknown, or other
  misc_feature (761)..(761): n is a, c, t, g, unknown, or other
  misc_feature (989)..(989): n is a, c, t, g, unknown, or other
ctccccgcggtggcggccgctctagaactagtggatcccccgggctgcaggaattcgtctcacccctagaaaaattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttnncacattgcacgggctcttggagaagaaagaccaggaaggagctgattccctttttcttagtgaaaacaacgatgatgaangacgaagtgctttcttgcatggctgagggaattgggtgtgttcattcccgtatggttgggtggtgtagaancatgctcatgtttttgctccccacctttggaagacatttgtgtacagtgggaaggaaactctgtgtcccgtgataaagcaagttgatcctctgtggcccgtattgggtgcccaaaatgaagggaaactgacatttgtccactggttccattcccagtagtaaagaagctagccagcttgggagagtggtttacagcctcgcgttatccgttcctgtgggtctttttccaaataagcctaatcccaagtggcgtcggaaccatttggaaaacagaattggnaggactatcctatgggccagcctttgtccaggtatggacttgcccttatggtcagaaagagccagcagcatcccaattcctgggtaggttttgcaagctaccgtttgaacggaatcatttggaagaacagaaattatggccaattttttgatgaatctaccccaggatgaatcaaaaattcactgcccttctgtttggcctgttaaaggctgtgccccccccctgggntaattgtgtggagaccccaaaatgg

SEQ ID NO: 92873 - protein, 48 aa, Zea mays
  misc_feature: Ceres CLONE 1581860
  misc_feature (34)..(34): Xaa is any aa, unknown, or other
MAMIDEPLYPIAVLIDELKNEDIQLRLNSIRRLXHIARALGEERPGRS

SEQ ID NO: 92874 - DNA, 1083 bp, Zea mays
  misc_feature: Ceres CLONE 1581861
  misc_feature: Encodes the peptide sequence at SEQ ID NO. 92875
  misc_feature (1083)..(1083): n is a, c, t, g, unknown, or other
ctccccgcggtggcggccgctctagaactagtggatcccccgggctgcaggaattcgtctcacccctagaaaaactacgaagtgcgaactcaaagctgaagacaacaaaccatggggagcacaagcacgagcgccacctcgtcttcctcctcctctgctaccagcggccccgggggcggcggcggcgcacacgtgctgctcctgccgtaccctggcgcgcatggccacacgaacccgctgctccagtttggccgccgcctcgccttacacggcttccgcccccacgctcgtcacctcccggtacgtactctccaccacgccgcccccagggggagccttcaggttggcagccatttccgaacgcttctacaggggcggcgcgggcccccggccccgaaatcgctgaatactatcgccagctccaaggccttgggtttcgaaaaaccttgcggaaccttaacccgaacggaaggccgcccaaaggccggccccttgcccccttggtggtttaacaaacccccccccttccctgggggcccccctggggtgggcccaagagcgcgccggggtttccccgcgggggggcgttttctttggaccaaaccgggggcccccctttgaaaaacccttctcaaccagaaaaattttttggggggggggggccttttccccccccctccccccttgtggtggacacagagaaaaaaaaaatctttttctcccccccccggggtcttttcttggggtgtttaaaaacacctgggcgcccaacaaaataagcgccccccttttttcgcgcggatataaaaaaaagtatggggcccccccttgttcttttgtggaggaggaagaggggggggtttttttggggggtgggggaaagaccccaaaatatggtggtttttattctctttccggggaaagaaaacccaggagggagaaataattttttccccacatagggggggagaaaaaaaaagaaccaccaatgttccccctctttttctcttaagaaaacccctctcttttaatagaaggggagaataatttcttctttcgaaaactattttttctttcgtttgn

SEQ ID NO: 92875 - protein, 169 aa, Zea mays
  misc_feature: Ceres CLONE 1581861
  misc_feature (27)..(55): SWISSPROT Homolog: EC 2.4.1.210 Limonoid glucosyltransferase
  misc_feature (27)..(54): SWISSPROT Homolog: EC 2.4.1.121 Indole-3-acetate beta-glucosyltransferase
MGSTSTSATSSSSSSATSGPGGGGGAHVLLLPYPGAHGHTNPLLQFGRRLALHGFRPHARHLPVRTLHHAAPRGSLQVGSHFRTLLQGRRGPPAPKSLNTIASSKALGFEKPCGTLTRTEGRPKAGPLPPWWFNKPPPFPGGPPGVGPRARRGFPAGGRFLWTKPGAPL

SEQ ID NO: 92876 - DNA, 1290 bp, Zea mays
  misc_feature: Ceres CLONE 1581862
  misc_feature: Encodes the peptide sequence at SEQ ID NO. 92877
  misc_feature (52)..(52): n is a, c, t, g, unknown, or other
  misc_feature (1150)..(1150): n is a, c, t, g, unknown, or other
ttccttttttccgagggccgctctctctttttcttatacgcccgggtcctcntccctctccccttcctctttttcgaggcccccccggtggcggccgctctagaatagtggatcccccgggctgcaggaattcgtctcacccctagaaaacccctctcacctcgacgcgcctccaaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtggacgggcccgtaacatatgcccatctgtctcatcttatgaaaggagatttcgccacaagggaactaccttgaccagaagccttttgggccctttcaatgtctggtaggggggggcgtaaaggtccccggtgatgggtgaccccccccccgtggctatggttccggctgaccaaaggagggcaaaaaactttcaggaatcaatctcctggaggggcggggtttttcagccggggggtttcaaaaaaatggttgctactctcccattcaggggtggggaaggcccgctttttttttgtaacccaaagggggaaacaatttgaggttggggggtggtcctttccacaaagccgggttaccggggtttttgtggtgaaactgttctcaaaaaggtgccccttttaggggggagaggggggggtttcccttcccactttggtggcgggggggtaaatacctcgtacgcaaaagtttttatccgtctgttcccgcccccctcccccgggtgttatgaaaatctttgtttacctttatgccgagatattccttccagagaggtagaggttttttccacctcgctccctgaaaaagttatacgtacgcgtttgtctttttgacacaggcggtaagtttggggcgctagctagggtttgccctccatggatgaggtgggacgtgtgaggttgataggctccccattatgtgttgtatttggaagatgacgccgccggtcgtcaattccactcactcacaacaaccgcggccagctctgaattggacaagagccagctctctgatgttgcgatgtatcggcaacgagancctatcttgattttattctgcctaatggtgtgtcgcctccccgaccctaatgtttattgtggatggcgtgacccgtgtttgttggggcggaggagagtgctctactccacgtgcgttcgtgatatagttttaattgctat

SEQ ID NO: 92877 - protein, 62 aa, Zea mays
  misc_feature: Ceres CLONE 1581862
MADQANQPTVLHKLGGQFHLRSIISEGGRARNICPSVSSYERRFRHKGTTLTRSLLGPFNVW

SEQ ID NO: 92878 - DNA, 1303 bp, Zea mays
  misc_feature: Ceres CLONE 1581863
  misc_feature (67)..(67): n is a, c, t, g, unknown, or other
  misc_feature (77)..(77): n is a, c, t, g, unknown, or other
gggcggcctgcgttctcctcacgggggtgagggaaagggaatctcccccttctcctgcctccccttnctctttttanctccccggggtggcggccgctctagactagtggatcccccgggctgcaggaattcgtctcacccctagaaaaatccacttcgcccgcccgcccgctgcctgactgccattattgcctcccggtcttcgctgtccatccgaccgtccgtggcttctccctccggtccccgctacccgccccgccccgccgagaagcttcgggctagctagcaagctagctagccacctacccgtgctttggttcggttggttggcgccataccctttgcctaggagcgagggagcagcctggcgggcagtccagaggccgtgaataagcatgctgggagcgagcccccgggggcaggaagggggtcgcgccccccgcgaagctggggtcggcgaaagaagcccccccccccggtggacctggaagatgggagcggccgcatagtgctggcagtataagtggtggggagtgcggcccctccgggatggctggggcagaaaaggggcaggcggcgactaccaatccctccgcccaacgtgtaaacccgtgccccaccatcccgggttaaaggttcaaatatcgcccggctttcacgctgcgaagatttaccatttgatttcaacagatcctcccctccgcgtgttgtcttaaaaaattctttgggtgcccctcccaccaatgcgggtttggataaccctccacaccactattagaaggtgggtgcgctccacggggacttaggcgacgctctgtcacactccacaacggtgcttttgctgttgtgaacctccggggtctgtgtctttccacgggcaaacggtcctctctcaatgggatgcgcttagttggatatatggtgatgtactctttcttacgaccgcaccacttatgacctcgcccgactccgtttagtactcgcggtgtacatactttgtcgtctaggggcaactcttctttcgccctgtggcgccctgttatgtggactttcgctgcccactggttgtgttcgtttgtctaggcgggtactacagtatcttgcgtgtctcgcctctatgccatatacctcgaggtgtgtcatcgaccctatatagaaatacccacctccatctatgacaagcgagtcggacatacattagttcttctgtatcaccatcgagttcttgcttgattgtactctcgtacgttacgtcgcgctctactccgtcactgttctttctacgttatcctcatagtcgtcc

SEQ ID NO: 92879 - DNA, 1274 bp, Zea mays
  misc_feature: Ceres CLONE 1581864
  misc_feature: Encodes the peptide sequence at SEQ ID NO. 92880
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
  misc_feature (795)..(795): n is a, c, t, g, unknown, or other
tgtttggctcgctttccctccttccgccccttcctcctctgcttatcataatctnnnntntttaaacttggactccccgcggtggcggccgctctagaactagtggatcccccgggctgctgtgaattcgtctcacccctagaaaaaacacacctcacggcgtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacgctcccctgctgctgtcgcgttagatgttgccgctgttgccgaagacacgtagctcgctagggttcgtgatttctcgcggagtggttcgggaactggtaagctatggatctctcgcgggcgggatcgacagaccactcgctccgggtgtactttcatggacggctcccacgcttaaggtggtgtgtgggagccctcgtctgctgacccccgttcaaaagacccgaaaccgggaacctcttcaggtgccggggaagccaaacgccggaaaagggattaacgggggaacctgtgggcgaaccgagaaagtgtctccctgccgctgggaaagtttcccctctggtgtttcaagacgggtctcagtccctgtggccgtgttctacccccactcgttgttgggttgtcacggaatcgcactataaaaacttctctttcctctgagtcatgcccgccactcgatgnatctctagcccgctgtgtgagtactaacagtttgcacaggagctagttcccagagtgcagttaagcataacaacgtctcacccatggtctgtgtgttatgacacacggaactcctcttgtcgcgatgacgacgtttagagttaggagatacgggtccgcagctccgccgtattgcgtgacgttagtgtgataggtgtggaaagcacgcatatttctctatgtatagaagccgtatgtgtattatataaacgagactccgtcgcgagctttgcgtgatggacgtccgcgacgtgcctgagtagtacgcacctggtcgttgctgcaagacttaccccgacgcattttatcactttcatgttcggcacggctcgcgctttgttgcatgtgcgcgtgtagcacttattgtgaaggagtcgacctcgagccctgtgtatgtgtggggatgaaatcccctattacgctctacagagtgtttcttg

SEQ ID NO: 92880 - protein, 131 aa, Zea mays
  misc_feature: Ceres CLONE 1581864
MLPLLPKTRSSLGFVISRGVVRELVSYGSLAGGIDRPLAPGVLSWTAPTLKVVCGSPRLLTPVQKTRNREPLQVPGKPNAGKGINGGTCGRTEKVSPCRWESFPSGVSRRVSVPVAVFYPHSLLGCHGIAL

SEQ ID NO: 92881 - DNA, 1333 bp, Zea mays
  misc_feature: Ceres CLONE 1581867
  misc_feature: Encodes the peptide sequence at SEQ ID NO. 92882
  misc_feature (1035)..(1035): n is a, c, t, g, unknown, or other
  misc_feature (1036)..(1036): n is a, c, t, g, unknown, or other
  misc_feature (1041)..(1041): n is a, c, t, g, unknown, or other
  misc_feature (1044)..(1044): n is a, c, t, g, unknown, or other
tcttttcttttctttcccctttaaacctcccgctttcccgtatctatttaattattttgttttttaagctggaactcaccgcggtggcggccgctctagaactagtggatcccccgggctgcaggaattcgtctcacccctagaaaaaaggatgacaaaatttcccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctcccgtgaggtgccggacgagccggtggtgtcgaataagtcggggcttctcttcgagcggcggctcatcgagcgctacattgaggaccatggcaagttgccccatcaccaaagatgagcccaccatggatgatatcgtgccgggcaatacccacaatgtcgggtaagcccaggccttttgcacgctgcaagcattccaggactccttggcgatttctcagaaccagtgggaatgctccccatgcctcttctaattgttgctttcgaatcagccgccctcaacccaaccgaaaaaaagaaacttaaagtcttgcaactctaaacaacactagaagacctgagcctgcccgtggttgaaccctctgtgttcggataggagcgggatacgtgccatccaaggctttttaatgctcccctctttgtggcctctcacactcttgaaataaatacaaagaatcttcccacaaccaactccgaagtttgtctaagacggaaatttttggtattccaacacggacaagatggggtgagagaggttgctctctccataaatgtgtgcatcaacatacgctaatcgcctcttgctgttcaaagtaataggtataatttttgggggctccccccgaacacctggtataaatgaataaatattatctcgcaccccgtgggcagatgattcccacccccctttgnnccccngtnacttgttatcggaaaaaactgtcgcatttaggtgcgcgtatatataacttgtgtgctctctttgtatgaacaaagagttgtactaatgatataatgaaaaagaggggtgcgctcctctactaccctttgggggcactacgcttatatacccccctcccctgtttgataattataatgtctcaaacagccctcgcatagatgatacacaccctttctatatgtatataaaaaaaattccccacccccccttgttgttcaccagagatagatttcctcctctcacaagggt

SEQ ID NO: 92882 - protein, 43 aa, Zea mays
  misc_feature: Ceres CLONE 1581867
MICAISREVPDEPVVSNKSGLLFERRLIERYIEDHGKLPHHQR

SEQ ID NO: 92883 - DNA, 949 bp, Zea mays
  misc_feature: Ceres CLONE 1581868
  misc_feature (485)..(485): n is a, c, t, g, unknown, or other
  misc_feature (486)..(486): n is a, c, t, g, unknown, or other
  misc_feature (901)..(901): n is a, c, t, g, unknown, or other
ctccccgcggtggcggccgctctagaactagtggatcccccgggctgcaggaattcgtctcacccctagaaaaacatacttctacggacaatccggtaccagttaaatcgatcatattttttttatctctcgcctaacaacaacatgacacgtgctcatgtcgcgacctcactgaaacttccacgtatacgtcctagctccttttgtagctcgtacgtgaaatcgaatcagaatatatgcagcattatttgtgctgtacttttgcttttggaacgtactgttcagttcatattccgtccctgaccctagctacatacgacaagaatcagaatcgcacggtgcagattgagagtttactatattttcacatgttttctactgtatatggatgtagtaatttttaatcgtaacccatggtccttccagtcattctttataagcattttcttctcgagatccattctttatacgtcttcctggcaggnntcagttcgggagatcgacggcaagatcatcgggctctacttcgcgggcaactggtatccgaaatgcgaggctttaccccggtgctgggcggcggcctacaagcagctcaagaaacgcggcgccggctttaaaggtctggcttgtggcctggcaacaaagaccaggccgtctttcaaacgggttccacgaaaacttggcgggggccaagggggggccttttgggaaaccccattggaaaaaacccccacacaaagggtcccaggggaaaggccccccccccctgggggggttttcccccgaaaggggggggggggggaacacgaagacccccaaactcttggcacccttaagggaaaagggggccccccttctcccccccccggggggggcgatttgtgggagagaaaaaaccccnaatcccccccccaaaaaggagaaaaatccccctccccagagaaaaaaa

SEQ ID NO: 92884 - DNA, 901 bp, Zea mays
  misc_feature: Ceres CLONE 1581870
  misc_feature: Encodes the peptide sequence at SEQ ID NO. 92885
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (580)..(580): n is a, c, t, g, unknown, or other
ctccccgcggtggcggccgctctagaactagtggatcccccgggctgcaggaattcgtctcacccctagaaaaaaaaacccttccgccccgagccgaccggaaccctacccatcctgcagcgccgccgcccgcccgccccgccccttcagtccttcaccccctaccccttcaccccctaccccttcttgcgccgtcatcccgatcccctacgctcgctgaggcattatgggtaaatcaagcaagaagtccagtgttaaggctgcacctgctgctgtctcagttccagaggggaaatctgcaaagaaggggaagagaaatgcagaagatgagattgagaaggccgtgagtgcaaagaagcaaaagaccgtacctgaaaaagctgtgccggttaagaagcagccccctccaaagaaagttgagagcagcagctctgaggaggattcttcagattccgaagtggaggttaaggtcccagccgagaaggttattcaccgaagaaaagtacacaacctgctaaacaggagtccagtgatgacagcagctctgagagctcctcagacgatgaaccntnncaaaaanccagtgccggttcaaaaaagcctcctgccagtagtagcagcagggatgatagcagtgacagtgatgatagcagctctgatgaggaaccagcaagagcccacggtccttcaaagaagccactgtctttcaaagaggcaactgtctttcaaaaaacctgtccagcagtcagaatgggtcaaacaagttaaactgatgcagcagcctgacgtagctcaaatgagatgaaaactgcgctagcaaaagaagctgttgttgcccgggcaaagagacccaaatctgaacctctgacgggatctgatgagatgatccaaaatgaattca

SEQ ID NO: 92885 - protein, 192 aa, Zea mays
  misc_feature: Ceres CLONE 1581870
  misc_feature (115)..(115): Xaa is any aa, unknown, or other
  misc_feature (116)..(116): Xaa is any aa, unknown, or other
  misc_feature (118)..(118): Xaa is any aa, unknown, or other
MGKSSKKSSVKAAPAAVSVPEGKSAKKGKRNAEDEIEKAVSAKKQKTVPEKAVPVKKQPPPKKVESSSSEEDSSDSEVEVKVPAEKVIHRRKVHNLLNRSPVMTAALRAPQTMNXXKXPVPVQKSLLPVVAAGMIAVTVMIAALMRNQQEPTVLQRSHCLSKRQLSFKKPVQQSEWVKQVKLMQQPDVAQMR

SEQ ID NO: 92886 - DNA, 970 bp, Zea mays
  misc_feature: Ceres CLONE 1581872
  misc_feature: Encodes the peptide sequence at SEQ ID NO. 92887
  misc_feature (297)..(297): n is a, c, t, g, unknown, or other
acccgcggtggcggccgctctagaactagtggatcccccgggctgcaggaattcgtctcacccctagaaaaaaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctgggngggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaaagaggggtatcgttttaggggcctctccatttccagaatggcaaaaagtgctgccaacagcagtttaaggcggtgaaccttttgctggaaggtctcccttgggcttcctttgaaggggaaaggtccaaccaaaaaagcagtttgagccccttccaagggaattgcttgccccccaaacgggttcagctttaggcttataaaaaaaaaggccctcccaagtaatggcactcctttgaaccgttttccccaggagaaagggccctcccgggtggaagggaattttaaaaggttttaacaagggttggccaaaacaaaatttgggggcccccctttagaaagggggtaatttgtggtgcgggccccccagggggtttttttgtttcccggaaattttcggggggggaaaaaaagcgccatttttttgtgggggggagaattctcccccgggtggttgtaaacaaa

SEQ ID NO: 92887 - protein, 69 aa, Zea mays
  misc_feature: Ceres CLONE 1581872
  misc_feature: SWISSPROT Homolog: EC 2.3.3.1 Citrate (Si)-synthase
MQSASDLDLKSQLQELIPEQQDRLKKLKSEHGKTQLGNITVDMVLGGMRGMTGMLWETSLLDPERGVSF

SEQ ID NO: 92888 - DNA, 1096 bp, Zea mays
  misc_feature: Ceres CLONE 1581873
  misc_feature: Encodes the peptide sequence at SEQ ID NO. 92889
  misc_feature (1096)..(1096): n is a, c, t, g, unknown, or other
ctccccgcggtggcggccgctctagaactagtggatcccccgggctgcaggaattcgtctcacccctagaaaaaaggacgacgaccggtctctttcctcccgccccaaattgtcacgactctagaggctccgcctccttcctcgtctgcgtgaacacgggagccttcgtccccagcccgggttcatttctccgttcctcggcgcggtggtagccgatccctgcggccatgtctttctatcgaggactcacagcaatcgggagactgcgatcacgcagggcgggcgaggccaccactctgggaggtgtgaagtggcggcaaatccaaagggcgaccgaaatcaatcttgaattatcattgaggggatggcttgcccttataatttgccccccccccaagcgtaagtgctagcccgttaaaaaccccttccgggaaacctaaatggtggatttggcccatttggggaaatggtgggggacaaccggaaataattttttggaaaaatcccaaattttaacaaaaaggggggggatttcttttttaaggggcccccccccttttcgggtaagtcgcaaaaaagacccgccttccccgcatgttatgggggggggggattccttttttcctgaggggcgcaacaaaggtgttttcttttttgcagggggtggaggggccccgcccaataaaagctcggtctttgagaccctttttttaaggaagattcttcttctgcccccacaaaaatgttgggctagtttttgtttctcccagagataagaaaatagatctctctcctgtttcgcgcgtttgactttataaaaatcatggtgctagaccgatggtgtgagagttctcttttgtcgctcttttatgtggcctttgtacaagatgcccgtaggaggggtttgccctcgcgcgccatagtttgctagtgtgcccgattggttatattcgccttttattattttttgcgcagcaatgtcttcgcctcttttccgcgctcactcgctgttaactgctcctcttaccatcttttcgttccccgtgtttttgtgttgggagtctttttttctttgcagttgtctttgttgtgtgtn

SEQ ID NO: 92889 - protein, 60 aa, Zea mays
  misc_feature: Ceres CLONE 1581873
MSFYRGLTAIGRLRSRRAGEATTLGGVKWRQIQRATEINLELSLRGWLALIICPPPKRKC

SEQ ID NO: 92890 - DNA, 902 bp, Zea mays
  misc_feature: Ceres CLONE 1581874
  misc_feature: Encodes the peptide sequence at SEQ ID NO. 92891
ctccccgcggtggcggccgctctagaactagtggatcccccgggctgcaggaattcgtctcacccctagaaaaaattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcttggagctgctgtccaccacgatggacgaagctcgcgccagcaccgccgacctggcgtcccccgccggcaggggtccgcgtccgggggcgtgtcccaagagcgccaggcccccgacaatggaacacgtgaatgacgggcttttcgggggcatcaccaacaataaaactgcctcgagggttttccggaacaaaagggggggggcggtggggggttaattgaagcaacctttaccaattgtccccaagggggaaaaccccgggccctgtgaaaaaaagtgccggggcgggggccccaaggggcccaagcccccccgggaaccttttccgggttaggggaaaaaggagaagggtc

SEQ ID NO: 92891 - protein, 181 aa, Zea mays
  misc_feature: Ceres CLONE 1581874
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSLSARDRLAINDCLELLSTTMDEARASTADLASPAGRGPRPGACPKSARPPTMEHVNDGLFGGITNNKTASRVFRNKRGGAVGG

SEQ ID NO: 92892 - DNA, 1060 bp, Zea mays
  misc_feature: Ceres CLONE 1581880
  misc_feature: Encodes the peptide sequence at SEQ ID NO. 92893
  misc_feature (1060)..(1060): n is a, c, t, g, unknown, or other
ctccccgcggtggcggccgctctagaactagtggatcccccgggctgcaggaattcgtctcacccctagaaaaaaaaatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaagggccccctcggcctcgagaatgtcgtgcttcgcggcgctcgcaactgctgtgccgagatttttcttttgggagggcaggtaccctcctggaagaatgaccacgggggaaaacttgcttttcccccacggcaaggcttttttcaaacccccaaaagctttttcgggggggggatacccaatcttgctttcccccatttttgaattcccctggaaaaatcttgaaacacactgggtattccccccggggaccccggttttttgggaacttttgtgaaaaataattcccccccctcctttttaccctttttaaaaccccgcggctatattaaagacctcttttgtggttggaacctctggtacccccagaagacacccccttctgtggagagggaggtatttcttaaagagagtttgcgggcgcccccccccacgagttttgttagaaatttcttcccttttgacaaaatatcccgcccctttcgagaacctctcgctgggggaaagttttggggggctccctccctcccccggagttttggggacacacacccccccccatggggggagaaccctcctcccccctataacatttcgcgggtaacaacaccaacctcttttctttgtttttccaacaataatgcgcccgcggtgctttttcccccttattgtaatttatttttcttaaaagccgggtggtctccctgtagcgctccgtctggtgggggtgagcataaaagaatttttttttcgcggggtcttttctctcn

SEQ ID NO: 92893 - protein, 97 aa, Zea mays
  misc_feature: Ceres CLONE 1581880
MAAPAPSGAASAAASPSPLMQLPSPFAELVKGPLGLENVVLRGARNCCAEIFLLGGQVPSWKNDHGGKLAFPPRQGFFQTPKSFFGGGIPNLAFPHF

SEQ ID NO: 92894 - DNA, 925 bp, Zea mays
  misc_feature: Ceres CLONE 1581882
  misc_feature: Encodes the peptide sequence at SEQ ID NO. 92895
  misc_feature (555)..(555): n is a, c, t, g, unknown, or other
  misc_feature (570)..(570): n is a, c, t, g, unknown, or other
  misc_feature (601)..(601): n is a, c, t, g, unknown, or other
  misc_feature (615)..(615): n is a, c, t, g, unknown, or other
  misc_feature (647)..(647): n is a, c, t, g, unknown, or other
tggagctccccgcggtggcggccgctctagaactagtggatcccccgggctgcaggaattcgtctcacccctagaaaaagaagcccagcaagaaaaccacatgccccacctcgccgccactccccccacttcctccgccgccgccgtccccgccgcgggccgcatcgcgttccggcgcccgtggaacacgccacagccggaagcgctgcgcctgcgcctccgcctgcgcgcgcggggcgtccggcgtgaggacggcggcggcgtgcgcacggaggagcaggagcagacagcaccgcggacgttctacgacctgctcgggatctcagcggatgggagccccgatgatgttcgggcgtcctacaggcggctggcgctaaagtaccacccagacgtgtcccctccgggcgccgcggccgagaacacgcgccgcttcatcgaggtgcaggaggcctacgagacgctctccgacccaagccgccgctccagctacgaccgtgcactcggcccgcggcgtctgccgcctcgccttctccggggcgccgttcccaatcccancacgcctactaccancacccaggtttggatcactgctctcctcacnttgttactgggtanctgggtgctttttcatggcgctggcgcttggntgcaattgcgttgtggtttggttcaatccgatttgtagaggtggcatcttctagtcaagattacgattggttgttgggttcatgctgtgaatctttacttctattggttaagatggccaatgaaaaacatgtgctaaattcttcctattaaacgtgaaagggatttgctgaactagtctcccagtcgggaatttgttgtaattcaatggaagaagaggcatttgcaaacttcaatcttggatttgtacgaagggatccacattctttcaggctgtcaa

SEQ ID NO: 92895 - protein, 194 aa, Zea mays
  misc_feature: Ceres CLONE 1581882
  misc_feature (67)..(131): Pfam Name: DnaJ Pfam Description: DnaJ domain
  misc_feature (152)..(152): Xaa is any aa, unknown, or other
  misc_feature (157)..(157): Xaa is any aa, unknown, or other
  misc_feature (172)..(172): Xaa is any aa, unknown, or other
  misc_feature (183)..(183): Xaa is any aa, unknown, or other
MPHLAATPPTSSAAAVPAAGRIAFRRPWNTPQPEALRLRLRLRARGVRREDGGGVRTEEQEQTAPRTFYDLLGISADGSPDDVRASYRRLALKYHPDVSPPGAAAENTRRFIEVQEAYETLSDPSRRSSYDRALGPRRLPPRLLRGAVPNPXTPTTXTQVWITALLTLLLGXWVLFHGAGAWXQLRCGLVQSDL

SEQ ID NO: 92896 - DNA, 928 bp, Zea mays
  misc_feature: Ceres CLONE 1581885
ctccccgcggtggcggccgctctagaactagtggatcccccgggctgcaggaattcgtctcacccctagaaaaatttcatgaccataggcttagcagtttagaagttatgattttcccaagtccagtttcagaatctgtccagattctgttctgatttcgaaaattgttttgtttgactaaattaaacttataataagcccttagtaattatagaagaattgtagtacttttcttaaggtttccaacaaattttggatcaccctttttggtgatctataagttaagttacagctgtttgaagtgcgatatctgaatctgtccaaatttggacagcagagcctttctcatattttctgaccttgatatatattgaattaacctgggatgtttataaattaattgtagacaatttttattagctttctaaagagtctaggatcacctgatttggatgcctgaaactctaattatggattttttgaagtaaggagtccaatttctgtccaaatctgggcagaatttaatgtttagttctgtttgacccttccaaaggtcgaatcagggttgggggggatatataaaagttttagaggacttttttaacctttccaaaaagcctgggtttacctattttgggagaaaatcccgggggagttttgaaaaaaaaaaacggatgtgcggtactggtgtcccaaaatccggcaagggattaaaaagaaatgcccggggattttcctttttcttgggaaaatggggacccctttgaaattaaaagggattttttataaaaaaaattttccccccgcccttaaaaaaggtgatcccgatatattttttgttttttaaaaggggattggggaaatgggtcttttaattaaaaaaaaaggggggggaggttccctttttgttgggggcgggccttaacct

SEQ ID NO: 92897 - DNA, 1001 bp, Zea mays
  misc_feature: Ceres CLONE 1581887
  misc_feature: Encodes the peptide sequence at SEQ ID NO. 92898
  misc_feature (655)..(655): n is a, c, t, g, unknown, or other
  misc_feature (881)..(881): n is a, c, t, g, unknown, or other
  misc_feature (882)..(882): n is a, c, t, g, unknown, or other
ctccccgcggtggcggccgctctagaactagtggatcccccgggctgcaggaattcgtctcacccctagaaaaaacgatcacacaccactccacagcagtagcaagagggatagagtaaggccacacacacacacacaccactaggctaggttagccttttaatcgtcgtcgagaagcaagaagggcgcgcacgcaagcaggcaagcaagaagagagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaccttcccgcccttcgaccccctcggcggcggcgcgtccccggcgttcggcggcctccccggcgggagcattcctggcagcagcattcccgggttcagcatgcccgggagcggcagcagcctaccccgggttcagcttgccccggcaacggcagcatgccccttcttttgggcggcggctcccccggagcttcaaacggcctttcggcgggaatgcccctgggtcggcccaccgcccggcttccttcccccgagacacgacaaaacaagcccctgtaaagnccaacaaaacgggggtaatagtagaaggggggcctacctgtttacctggagaatacgtctgcggtccttacatgaattgggtggggttccgttggtttcccccctacttccaataacaaaaaataattttgggccctttccaaggtacccgtaaagtctaggcgtagccaatatataaagggtgctggttccacgggcgtttttgtattaaatacccgacctggcnntggaaagagtggaatggttttcatcgcgggggggtttgttcttcacaaaggacaccaccctcttgggaaaatcggggtttattttttttgatcgccatataggctgatactacagggaa

SEQ ID NO: 92898 - protein, 188 aa, Zea mays
  misc_feature: Ceres CLONE 1581887
  misc_feature (138)..(138): Xaa is any aa, unknown, or other
MARSSKMMVAAALLALALAVSTAEARNIKTTTTEKKDDAVVQPQTFPPFDPLGGGASPAFGGLPGGSIPGSSIPGFSMPGSGSSLPRVQLAPATAACPFFWAAAPPELQTAFRRECPWVGPPPGFLPPRHDKTSPCKXQQNGGNSRRGAYLFTWRIRLRSLHELGGVPLVSPLLPITKNNFGPFPRYP

SEQ ID NO: 92899 - DNA, 916 bp, Zea mays
  misc_feature: Ceres CLONE 1581888
  misc_feature: Translation starting site: 164
  misc_feature: SWISSPROT Homolog: EC 3.4.22.34 Legumain
  misc_feature (864)..(864): n is a, c, t, g, unknown, or other
  misc_feature (890)..(890): n is a, c, t, g, unknown, or other
ctccccgcggtggcggccgctctagaactagtggatcccccgggctgcaggaattcgtctcacccctagaaaaaagtcgtgtcgtccccccggccccgacccccctccgtttgccaacgactccgggctccactgtcgctctcgctcccttccctcccacgcaatggtggccgatcgcctccgcctcgcgctgctgctctccgcgtgcctctgctccgcgtgggcgcgcccacgcctcgagccgaccatccgcctgccgtccgagcgcgcggcggccgacgaaacggacgacgacgccgtcgggacccggtgggccgtgctcatcgccggctccaacggctactacaactaccgccaccaggcggacatctgccatgcataccagatcatgaagaagggcggacttaaggacgagaacatcgttgtcttcatgtacgatgacatcgcgcatagcccggaaaatccgaggcctggtgtcatcataaatcatccccagggtggcgacgtctatgctggggtgccaaaggattacactgggcgagatgtcaacgtcgacaatttcttcgctgttctgcttggcaaccaaactgctctcaggggtgggagcggcaaggttgtggacagtggccccaatgatcatatatttgttttctacagtgaccatgtggggtcctggcgtccttggaatgcctacgtatccatatctctatggtgatgaactcgtagatgtcctgaagatgaagcatgctgccgggtactacaaaagcctggtcttttaccttgaagcatgcgaatctgggagcattctttgaggccctcctgccgaatgacataatgtgtatgcggacaccgcgtccattgcanaagaaagtagctgggggacgtactgncctgggcgagttccgagaccctcacc

SEQ ID NO: 92900 - DNA, 1333 bp, Zea mays
  misc_feature: Ceres CLONE 1581890
  misc_feature: Encodes the peptide sequence at SEQ ID NO. 92901
  misc_feature (1)..(1): n is a, c, t, g, unknown, or other
ncttttgttttttttcccttttttcatacattatgagctcttcttttatctattttatattttttattgggaatccccgcggtggcggccgctctatactagtggacccccgggctgcaggagtcgtctcacccctagaaaacctagaaaaaagggacaaaattcaaccttcatttgttaaggaaagacgagcaatgatgagagagtatgaagaattcaaaataagaatcaatgcccttgttgccaaagcacagaaagtgcctgaagaggggtggaccatggctgatggaactgcttggcctgggaataaccccaaggtacatcctggcatgattcaagtagttcttagggcaaaatggtggggccttgaacctcgacgaaatcgaaatcacacggtcttgtcttgttcctctcgttgataaaaagaccagtgttttcggtgtcccaaagaaggctggggcaaccccagtcccctttttccgcgatatttattggtgccggaaatagttgttgctttattccaccccactttgcaatttgtcaccattattcttattaggcatacaaattcccttttcaaaaaatatacattgctttttcacgtacagcacctgtttcccgtggtatatttaaaactcgtttttacaccaaaacatctttccataacaattcgtcgattgtgatccgccttcatatttgatttacaattgggtttcattgttttctaccctgcgtgttctccatcccatatatatccccatgttgctgcgttttctttgccctttgtttttttcgttgtcacccactccctctgtcgctcgcggaaagtctgtatttgtttgtgcccgctattcgttatataatctccaccctctttttttaatgattaacatctcaggctccttcgttcgttgtgcatttataataccgctctctggtttatctttcaagtattcatatatctcgagtattgcccatgcgcctctgtttcttttctatgatacctaactaccaccgctgtgctggcgcataaacgaagatatcaaatcgtccctcttgttcctcattataggtataaaggaagactttgttttgcaactcacgctgttatattccatttctatgattcctacatactggtggatgcatatatcaaccagtgtcgcctggtaaatatgatatgccagagccgcgtatttttcccttttttatgtatcttacgccgctctactttatacctttttccgcctacttgctcttatatatgttatgggttccgcccaatgttctgtacttttagttactctacgtgtgcctttacgcaaaatctact

SEQ ID NO: 92901 - protein, 138 aa, Zea mays
  misc_feature: Ceres CLONE 1581890
  misc_feature: SWISSPROT Homolog: EC 2.4.1.12 Cellulose synthase (UDP-forming)
FCFFSLFSYIMSSSFIYFIFFIGNPRGGGRSILVDPRAAGVVSPLENLEKRDKIQPSFVKERRAMMREYEEFKIRINALVAKAQKVPEEGWTMADGTAWPGNNPKVHPGMIQVVLRAKWWGLEPRRNRNHTVLSCSSR

SEQ ID NO: 92902 - DNA, 1038 bp, Zea mays
  misc_feature: Ceres CLONE 1581891
  misc_feature: Encodes the peptide sequence at SEQ ID NO. 92903
  misc_feature (487)..(487): n is a, c, t, g, unknown, or other
ctccccgcggtggcggccgctctagaactagtggatcccccgggctgcaggaattcgtctcacccctagaaaaaactggtcctcactcccacaccaaccaaccaacctcctctgcctgccgcttctcctgctgcgggcggtcacggctgcaagtactagaggaggacatccgcttccattactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgctgcgcaggacagatgggatgcacaggctgttgccaggtgtccttcagaggttcagcactgcagcagcagtagatgagccccatcacgccgtcagtccatgtgtactacacaaagctcctcattaatgggcacttttgttgattccngcatcgggaaagacttcccaactctgggacctcgtacagggggaagggaattgctcatgtggctgaagggggaaccaaaggaactttaacctggcattaactgcgggtccccaagggtttttgataaaagggcctggccccaaaaaaaacccgcctttaaaagggccccgattcccccacggggggtttgtcgatattttataaaaaaacacaaattgcaaaaacttgccctcttttgaaaaatggggaaccccgggagaccccttttgccacgccccccctattaaaaaacccccggggggccccccctttagaggaaaaatgggggggggggggagaaaaaacccgggggcctttggggggcgggggggccccccccctttttaattttttgtgcacccctgtggtgtggggggagaaaaaccccggggtttctcctttcctttgtttttttaaaaaagacccccccccttttggggaaaaaaaaccccggggagggaagaaaaaaaaccaccccttttttttttttatttattgtgtggggggggggg

SEQ ID NO: 92903 - protein, 70 aa, Zea mays
  misc_feature: Ceres CLONE 1581891
MARRAASSLVSRCLLARAPAGAPPAAPSALRRTDGMHRLLPGVLQRFSTAAAVDEPHHAVSPCVLHKAPH

SEQ ID NO: 92904 - DNA, 940 bp, Zea mays
  misc_feature: Ceres CLONE 1581894
acccgcggtggcggccgctctagaactagtggatcccccgggctgcaggaattcgtctcacccctagaaaaaccgcatttcccttcccccaatcctctcctccacgaacacgccctcccttttgcccgttcccagcctcgaacggcaaatcaaaaggcagatatttgagcttttggtcatcgtctccacgccccattggtagccgcctctgaaattcctataaaaaaagatatatgggtggagacatcacccacgccgccaagatcctgtcttcttgcgcggccagctcgtagctccacgccggatagatagaagaggccaacctttcctccccgcttgctccccttttctttcggcaggatggcacatcttcccccacgtgacacctgagaaagtgagagcacagatttcttcttccccttgctgctgccgtttctcgttttcggtcctctctggtcgtgggtttctcataaataaactcgcataaagcttcgttccctcgggtctttggtccaaatcagaagggctccctccgctttaccggccaaatttctcccccccccctgtttttttggcccccaccccccgggaaacccttggggaagtgccggaattttgtaggggaaaaggtccccttccccgttgggaaggccgtcttagggtctttgatccgggggaaaaaccccggggggggcccaattgtcccggaccccgggggggaaacccattctaaagggaaaaccccctttttttgttccgggccccccttggggggcccccgggttcctgtttttctttaaaaaagagaaaaggggggacctattcctccccaaaaaaaagggggggggggggtgtccccccccacaccctttgggggggggggggcggctatatacgggtttttttctcccaaaatgttgttggggagaaaaaaaaaaaa

SEQ ID NO: 92905 - DNA, 1010 bp, Zea mays
  misc_feature: Ceres CLONE 1581895
  misc_feature: SWISSPROT Homolog: EC 3.6.3.14 H(+)-transporting two-sector ATPase
  misc_feature (433)..(433): n is a, c, t, g, unknown, or other
ctccccgcggtggcggccgctctagaactagtggatcccccgggctgcaggaattcgtctcacccctagaaaaagtcgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggctagatcaccgacgagttcaccggcgctggcgccatcggcccagtgtgccaggtgatcggcgccgtcgttgacgtgcgcttcgatgagggncctcccgccatcttcacggcgctccgagtgctcgacaacaacttcgccttcgtgctcgaagtggcccaccaccctggccaagaactgggggggcaccatcccctatggaccccacgaagggggctcttcccgggcaaggcgttccctaaaaattgggcccccccaaacacggggccggtttgggggggcccccttggggcccctaaaaatgttttttgggaaacccctttttggaaaaggggggaaaaaaaaaaaaaaaccctctcccccccttataacaggaaaacccccctctttttttttgagggcgcccagaaccaaaaaatttttttttggagaaaaaggggggggttttttttccccccccccgggggggggagaaatctcccccccctcggggggggggggggaaaaaacccccccccgggtaaaaacaaaatgtgcgcccgcggtgtttttttttttttttggggggaaccaccccccagtatatttctcaggaaaaaaatgtggtgtttttataataaaaaaaaaaaaattttttttttttaaaaaaaaccccccgccgtgtttttgt

SEQ ID NO: 92906 - DNA, 901 bp, Zea mays
  misc_feature: Ceres CLONE 1581899
  misc_feature: Encodes the peptide sequence at SEQ ID NO. 92907
  misc_feature (826)..(826): n is a, c, t, g, unknown, or other
ctggagctcaccgcggtggcggccgctctagaactagtggatcccccgggctgcaggaattcgtctcacccctagaaaaaacgaccgcttggcgcttcatcactcgtttcctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggcgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggcggcgaagggagaggccgccgcgcagggcgcgccatcgacgccgagggcgcaccagcagcaccgccaccccgccgcccccgccatcgccgtcagcgacagctccctcaagttcactcatgtgctcaacaacctctcgcctgctgagctgtacgagcaggccatcaagtacgaagaaggggtcgttcatcacgtccaccggcgcgctggcgacgctgtctggtgccagaccgggcggtctcccagggactagcgcgtcgtcaaggacgaggtcacgcgcaagacctgtggtgggggcagggctcgcccacatcgagagggacgaagagacgtcctgatcnacagggagagggcgtcgactactcactccctggaaaaggtggtcggtgacgacagtacctcactgggacccgaga

SEQ ID NO: 92907 - protein, 189 aa, Zea mays
  misc_feature: Ceres CLONE 1581899
  misc_feature: SWISSPROT Homolog: EC 4.1.1.49 Phosphoenolpyruvate carboxykinase (ATP)
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAKGEAAAQGAPSTPRAHQQHRHPAAPAIAVSDSSLKFTHVLNNLSPAELYEQAIKYEEGVVHHVHRRAGDAVWCQTGRSPRD

SEQ ID NO: 92908 - DNA, 919 bp, Zea mays
  misc_feature: Ceres CLONE 1581900
  misc_feature: Encodes the peptide sequence at SEQ ID NO. 92909
  misc_feature (789)..(789): n is a, c, t, g, unknown, or other
  misc_feature (799)..(799): n is a, c, t, g, unknown, or other
  misc_feature (849)..(849): n is a, c, t, g, unknown, or other
acccgcggtggcggccgctctagaactagtggatcccccgggctgcaggaattcgtctcacccctagaaaaagagtccaccttccctgaattcctgttcgctaccttcgcttccgctccaaaaaccaaataaaaaacgcacctttccttcccttctcctccccttcgctttcccccgtcctcccttccctcgatcccctcgccggaaaagatcccattccatccacctccacgtcccggcgcaatcagagtttccggcggcaaagcaggaaggcggaagcgaaaggaatgttgcacctttaagtagcgcggcgacctggtgtttcttcctggccggcgatgggctgcttcccgtgcttcgactccccggcagatgagcagcttaaccccaaattcggtggcgccggtgggtacggcggcacgtcctctgccgccgcggcgtacggaaacggcacaggcgccggcgtcagcatcggccggcacggggacagggggtacccggacctgcagcaggcgcccatggcggctccgcgcgtcgagaagctctcagcagcggctgagaaagcaagagtaaagagcaatgggctcaccaaagaggctttggtgccaaaggatgccaatggcaatgccatctcagcgcaaactttcaccttccgtgagcttgctaccgccaccaggaacttcaggcccgagtgcttcctgggagagggaggttttggacgtgtttacaagggcccgcctgagagcacagggccaggtgttgctataaagcagcttaacagggatgggnctcagggaancagagaattctaggagaagtctcatgctcagcttactcatcatcaaaccngggttaatttgatgggtatggggctgagggagaccaagacttctgtttatgaataatggcttctggaata

SEQ ID NO: 92909 - protein, 157 aa, Zea mays
  misc_feature: Ceres CLONE 1581900
  misc_feature: SWISSPROT Homolog: EC 2.7.11.1 Non-specific serine/threonine protein kinase
  misc_feature (151)..(151): Xaa is any aa, unknown, or other
  misc_feature (154)..(154): Xaa is any aa, unknown, or other
MGCFPCFDSPADEQLNPKFGGAGGYGGTSSAAAAYGNGTGAGVSIGRHGDRGYPDLQQAPMAAPRVEKLSAAAEKARVKSNGLTKEALVPKDANGNAISAQTFTFRELATATRNFRPECFLGEGGFGRVYKGPPESTGPGVAIKQLNRDGXQGXREF

SEQ ID NO: 92910 - DNA, 1087 bp, Zea mays
  misc_feature: Ceres CLONE 1581901
  misc_feature (1087)..(1087): n is a, c, t, g, unknown, or other
ctccccgcggtggcggccgctctagaactagtggatcccccgggctgcaggaattcgtctcacccctagaaaaaacgacggcttgatcctctgtgttgtgctcatgaaatcataaatgctgtcctcttgcacctgtgtcacttgtgaagggtggtaagcctgtcccaattaatcgggggcatgagtttggtgtctgttcctatgtgccgtgaatgctcctccgacgacttcatgtcctccctctccatttaatagcatgcggtcggcacgagcagctggcctctgctgtcctgccaccgacgcgaagctgaagatgccttcattgggtctggctctgtctgcgccaactctatagcggtatcgcacggttcgctgccatccctcttgcctcgacttcataatcttaaaggacactccatcttccaagaaagcttaccacctgctcatttacgattgcactctcagaatctttatatgccgactggttagccatttgttaaaatctccatctccagtcgaccgaaaagttgatgaaggtcctgaagtaacgtgaactgcaacaaactggcaaagaagggcaagttcgttcatcaaccctcaaaaaaagatgtttccgggccctaattccaatggaaaaatatagttgaagagggtaaaaaaattaaaattcggggggctaaattaaaccctgccccccttattagattcccaaagccaatagtgaaaaacctcccggcaaaataaaattttgttttgggggttaattcccctcacctagttttcaattcccccaacataaccccgcttcataaaccaaacgaatgtcttgggtctcccccaaaatggcattttgggaacttaatgaataagtgttccacccccataaagataggccctttcttgaaggtgttctttttcacaacacatggattccttaacatgcgacaaaatatagggtttcttgataaaattttcaccgaaaaaaatatcactaaacccgcccctgtggcgtccttcaaatggggtgtgacttatataccttacacaacaagtgcttattataagggttttctcttatacaaaatan

SEQ ID NO: 92911 - DNA, 1029 bp, Zea mays
  misc_feature: Ceres CLONE 1581902
  misc_feature: Encodes the peptide sequence at SEQ ID NO. 92912
  misc_feature (513)..(513): n is a, c, t, g, unknown, or other
ccgctcttaactagtggatcccccgggctgcaggaattcgtctcacccctagaaaaagccgtcttatcccttcgtcctcgctccctgcagccgccgcccaaaccctagcaacccgtcctccgccatggccgacgaccactactcctctaagaggaagttcgacgacccctcgccgccgccgcggcgcacggggttctcttcgggcccgccgcctgacctggcgtttcgcgggcggggccccgtcgtataattgcgtggcctccgcccccccatgaagttccagcctcgggaaacaatcgcccccccggaaaacgcgggggcggtatttttttatcccccttaagggcaaggggtccttgggggctgccatggggaaaaatgaacaccggggggtttttgggtgtagcctgggatatttgagtggtggcgtcttcccccccccgcgggggggaggaaacaagattttttccccccctttcccgggggggggggtacgggggtttttttcccccnacattttttttttttcttataaaaaccccccccccttttccccctgtttttgggggggttattttccgggtggttcgcccccaattattttactttctccctctcttgggagggggggggggtggtcccccttttttttaaaaacgcccgggggaaaataccgggtgggtgttttgatccccctttttgtggggggggcggtagcatttttccctttcccctctttaaattccgtgtgttgttgttaccccccgggggcctttacattaggccgagtgtgtgttttttttctgcgcgcgccccccgatgtcttatcccgatttcttcttccccctctactacaaaatatcccccgcctagattccacccctttctcgggtttcctcggttttgtgtttttatgtggggtgtcctcctaatttttttattccctttttttgctcgcggcgtcttgataatccctccaccattatattattgtcttttgtgggggcggggtggcctagtagtcaagga

SEQ ID NO: 92912 - protein, 41 aa, Zea mays
  misc_feature: Ceres CLONE 1581902
MADDHYSSKRKFDDPSPPPRRTGFSSGPPPDLAFRGRGPVV

SEQ ID NO: 92913 - DNA, 1063 bp, Zea mays
  misc_feature: Ceres CLONE 1581903
ggatcccccgggctgcaggaagtcgtctcacccctagaaaaaatctccttccagccgagctctggcgctaggtttctctcccagtgtgcgcgctgcccttcttctccaggccgccgactcctgctcgtcgaatcccctctactcaccagggcgcttggcttcctccttccctgccgcaccgtgctcctctgctcctccctgctgccagctcggccgtgccctggccatgctccctgcgctcgccagccgtgcgcatctccctctaagcacgcgcgcctgcttcctgcgccgcgaaccccgccgtggagcttgcctcgagctccccccatggcgcccggccaaaccccttccctgtcgtggccccccccttggcgtccaatttttcttacaccgcgtggggtttcccctccccgaaaattgtcctaatccccctttggtttcccccctggggccggggaaatttttttccaatccaggctcggctcttttcctccaatgggttcccggcacacccccactattttttggtgagactcccaaggtgggggccccctcgtctttttttctttcccccaaatcctcggctcttttagggtttttggggtgactctctatttctcgtgctccccctgccgcgtgtgtggagaaattttttcccctgctccaagttattagtgccccccccacttttttttcttcccccttcattttggtttatacccccccccctagaggcggttaccttcttttttggcaatgtccccttgttggtgccgccgcgacacttttgctttctccccctcacctatccccgttttcacctttctcgcctccttgttcccattcgccgttattgctgtttgcccgctctctcaatatgttctcccacctcttttattcgccgcgcctctcgctttttatccgggtttgctacgcaaacatatagcgataaataggccgctctttgtattccaatatttccttctcccgcatcctgtatatctcttccgccaatcgcgtttgttcctctgttgtccaccaccctctctgtttgatctagtat

SEQ ID NO: 92914 - DNA, 1033 bp, Zea mays
  misc_feature: Ceres CLONE 1581905
  misc_feature: Encodes the peptide sequence at SEQ ID NO. 92915
  misc_feature (934)..(934): n is a, c, t, g, unknown, or other
  misc_feature (960)..(960): n is a, c, t, g, unknown, or other
  misc_feature (1002)..(1002): n is a, c, t, g, unknown, or other
  misc_feature (1033)..(1033): n is a, c, t, g, unknown, or other
cggccgctctagaactagtggatcccccgggctgcaggaattcgtctcacccctagaaaaaaacgctcaacttgaaagtcacaggacagcacacaccccacccacaactaccaaccttctccggaaggccaaatccctccgggccaagggaaacgagggagagagaccctccgcccctctcctctccctctccttccggtgaggcggtgagctatggagtcggcagcggccgtgaagacggtggagcggctggcgcagcgcctggtgccgccggcggagctcatccccatctgccccccaccgcctgtcgtggctggaaccggaaccgacgcagatggcgctcatctgagtcggtgcttgggtttaaggccgatccggggcccccacggggctcagccccgggcgaaaccatcgaggagggaacctcccacggggcggtagggcaactactaaccgactgtgccggctcgcctcgcgcgttgtcgaacaggtccgagggggcgcgccaccgcccggcggccggacgttaagggccgccccgggttgatccgcaggcccaccagaccgcgtgctcgcccaggccgcgacgcccgtccctactgacttgtagcccaccgcgcataactacccgtagggagcatacccagcgtccccggatcacgccgccgtcgtgaagggccccccgcccccgcaacgcgcggaggcagcccgccgtcgttccttggcttccgtcccagcggtgattgggcggtcgcacgccgcgcggatcgcgtgctgcgcagcggcagcagcattgtcgcgatgtctctacgcctgttgcgcgtgcggatactggcttttacggccacggcctaaaaattatccccccgcctgttgtggccccggcctccgattctccggtgttgtgaatatgctttgctattgtggcggcgcnattcagtgggctcgtcgaccgtcccnccccaaaaatccatatgaggtgaatgttgtgtttggcgacgntgtcgccccaacgctcatcttgtgcgcttan

SEQ ID NO: 92915 - protein, 75 aa, Zea mays
  misc_feature: Ceres CLONE 1581905
MESAAAVKTVERLAQRLVPPAELIPICPPPPVVAGTGTDADGAHLSRCLGLRPIRGPHGAQPRAKPSRREPPTGR

SEQ ID NO: 92916 - DNA, 914 bp, Zea mays
  misc_feature: Ceres CLONE 1581906
  misc_feature: Encodes the peptide sequence at SEQ ID NO. 92917
  misc_feature (875)..(875): n is a, c, t, g, unknown, or other
ctcctcggtggcggccgctctagaactagtggatcccccgggctgcaggaattcgtctcacccctagaaaaagccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccccagccagcgtgctcgtcggcgaccactagaagaaggccgtcgtcaaggagctcggcgacgcgctgcccgacgtcggcatggggggatagggagaccgacttcgacttcatgtccatctgcaagggagcctacctggtgacgtcaaggaaatacagcccggtgcccaggaaccagctgcttgagccgctgatcgtgcacgacggcgcctcgtgaagcgcccgacgcgntcgtcggctcgtcaccttcctctggatgcgttcggctcc

SEQ ID NO: 92917 - protein, 174 aa, Zea mays
  misc_feature: Ceres CLONE 1581906
  misc_feature: SWISSPROT Homolog: EC 2.3.1.15 Glycerol-3-phosphate O-acyltransferase
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMAPASVLVGDH

SEQ ID NO: 92918 - DNA, 1071 bp, Zea mays
  misc_feature: Ceres CLONE 1581908
  misc_feature: Encodes the peptide sequence at SEQ ID NO. 92919
  misc_feature (262)..(262): n is a, c, t, g, unknown, or other
tccccgcggtggcggccgctctagaactagtggatcccccgggctgcaggaattcgtctcacccctagaaaaattccattccattccattccagtactcgctcatcttgctccgccttctgcttctgcgcatcctccaaggatcgtgatggccatggccacgcaagcctccgcggccacgcgccacctggtggccgccgccgcttccgcctgggcgccgtcggctaagccgcggcagctaagctcacagctcgcgctgccgncgtcgtcctcccacgcgccagccccgctccgctcgaccgccggggaagcggtgaccgaggaggcgcccaaggggttcgtggccccgcagctggacccagcacgccgtccccgatcttcggcacccccacgggcagggctgctccgcaaaggcgcaggggggaggaagtctacctcaccacgtggggtggtcccccccaaggaaacaggttgttctaaaatccccacccgggtggcgcccgccaatcatgcggggaagggggccccaaaccccctggaaacctggcccccaaaggaaacattggccttcgcccttcggcaaccagggctgggggcccccaagttaaataaatccaccttaaccgttttcttacccggggtcttttccccagaagggtgaaagggtgtaatataccctccccccccccaagtgaacgggggttcttaccccgggaaataaaggtcacacccccccgtcaagggaagaggctttccttgccacaaacattttcccccaacacctccggtaaagaaattgtcaaatccccatttggaacgtctcaattttacccccgagaaaaacaccccttccgaaaaataaaaaaattttaaggccggccacgctcggcacgggcgcgggaagcccaataacaaaaagacatccgcctctcccccttggtataaagataaaaagctaccccgccggggggcgcccctatatttctcgctattacctacgcgctgtcttattattactctgcccctattgtgaataacgttggcccgtgactcttacgtcccccgcccccgt

SEQ ID NO: 92919 - protein, 32 aa, Zea mays
  misc_feature: Ceres CLONE 1581908
MRGRGPQTPWKPGPQRKHWPSPFGNQGWGPPS

SEQ ID NO: 92920 - DNA, 954 bp, Zea mays
  misc_feature: Ceres CLONE 1581912
  misc_feature: Encodes the peptide sequence at SEQ ID NO. 92921
ctggagctccccgcggtggcggccgctctagaactagtggatcccccgggctgcaggaattcgtctcacccctagaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaatgagggcatccctccagaccagcaacggctcatctttgctgggaagcagctttgaggacaggcgcacgcttgccgactacaacatccagaaggagagcaccctccacttggtgctgcgcctcatgtgaggcatgcagatcttcgtgaagaccctgaccggcaaaactatcacccctccagggggagccttcagaccccatcgacaacgtcaatgccaagatcaaggaaagggagggcatttccccagaccagcaacgggctcatttttgctggaaaagcaccttgaaggacgggcgcacccctggccggacaaaaacatccagaaggagaaggacccttccatttgtgtgcttgcccccccagggggaaggcatgccgaatctttcctgtgaaaacccctgactgggaataactattcacccccctcaagggggggagttctttccaaaaaaccatctctacaagtgtggg

SEQ ID NO: 92921 - protein, 126 aa, Zea mays
  misc_feature: Ceres CLONE 1581912
  misc_feature (6)..(74): Pfam Name: ubiquitin Pfam Description: Ubiquitin family
  misc_feature (82)..(127): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDNEGIPPDQQRLIFAGKQL

SEQ ID NO: 92922 - DNA, 980 bp, Zea mays
  misc_feature: Ceres CLONE 1581915
ctccccgcggtggcggccgctctagaactagtggatcccccgggctgcaggaattcgtctcacccctagaaaaagtcgccacacggccacaccaacccaacacctcttcttcctccgctctcagcttaccccaccacaggcgagggaggcgactccttcctcgcggctacccgctccggccccgatcgcatctcctttgcacgccacggcccgcgcgcagtgtccaccggcacggccgtcctccgtgtgtgggggcgcatctggtgctagcttgccgggctagggtttggcttggcctcgtctaccgccccgtctcgtctgataggcacaggttccgtgcacgcgatcgtcgtctctccatccgttgtgactgctttgcgtcccccgcttgctttcgtctgctacgggaggcccactgctgccatcgcgtccaccgacgaatttccccacagagcattagagcaattattctggaaattgcagatctgtacctgaagattcaatttgaaatcctgaaagctccggcggttgagtaaaaaaaaaaatttctttgcctttttaaggaaaaccgcccagcccccaaaagggaaaactgggttcctttctctggccaaccccggaaaggggaaaaaaacccgccccctcccctttttttaacctaaaaggccccccggggccaaaacccccgggaggggaccccccacccggggttaagggggccctaaaccttttttggtattccaggggaaattgggccccccgccctggttttcccgggggggggggggagaaaaccgaaaatccttcctggggggagggcttcaaaaaaaattttattcccgggtgtgggacaaaaaaaaaaggggggctttcttaggggggttttcgcggaaggaaaaaaaaaaaattttgtgggggcacacaacccatttggggggggggggaaaaaaagatggttcttccccccacgggggcggcgc

SEQ ID NO: 92923 - DNA, 1175 bp, Zea mays
  misc_feature: Ceres CLONE 1581918
  misc_feature: Encodes the peptide sequence at SEQ ID NO. 92924
  misc_feature (55)..(55): n is a, c, t, g, unknown, or other
  misc_feature (57)..(57): n is a, c, t, g, unknown, or other
ttttttgctttttttctcccccccacactccacttttttcctgatattatttatnanattttttttattactggagctccccgcggtggcggccgctctagaactagtggatcccccgggctgcaggaattcgtctcacccctagaaaaggtaggggagcgttccgccttagagggaagcaaacgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgataggcgtagtcgatggacaacatgtcaatattcctgtactaccccttgttggtaccgagggaccgaggaggcttggttagccgaaagatggttataggtttaaagacacaaggcgaccccgctttttccgggttagaaagggggaagagaaaatgccctcgagccgaggtccgaggtccaagccgctggagcgcctgaagtttgtagcccccgtggaactagccattggcttcctcccagagggttctctaccaggggcgcttatgggggcttgaaagtaatgttaaacccattgtccctatcccccccaggaaaaaagccccggaaacgaacctttgtaaaaaaaaaaggggttatccgcggtttccccgaaaaacccgaaaaaaccaaggttggtgtttttgtggttatataaaaaaatatacccctaaaggaggttgcccgcaaagaaaacaacacccctccctcccttcaaatggaaaaaccccgcggctattaataatagtgcccgcgccggtaaccatccttccgggataagataagaggggtggggccctccccttctcttaaaataaggggggggtcgtttttcattgtgacatcccggtacgccggggggccatacttggttttacaccattaaaacacaaggtgtattccctccagatgtttttgtaaaataccctcctttaggtgggggttgtgatttcccgctccctactgttctggaaaaggtctcatggaaacttggtttaaactttgttcagaggtgagtccggtcgaacgcattccctcccggaaagggtgtccttgattataaggcgtgtatacagaccaaattttccg

SEQ ID NO: 92924 - protein, 101 aa, Zea mays
  misc_feature: Ceres CLONE 1581918
  misc_feature (19)..(19): Xaa is any aa, unknown, or other
FFAFFLPPTLHFFPDIIYXIFFITGAPRGGGRSRTSGSPGLQEFVSPLEKVGERSALEGSKRESGGRRSGSENVGLSNENIGENPMPRKPKVSSARFVHGG

SEQ ID NO: 92925 - DNA, 983 bp, Zea mays
  misc_feature: Ceres CLONE 1581919
  misc_feature: Translation starting site: 324
  misc_feature (870)..(870): n is a, c, t, g, unknown, or other
  misc_feature (871)..(871): n is a, c, t, g, unknown, or other
  misc_feature (907)..(907): n is a, c, t, g, unknown, or other
  misc_feature (967)..(967): n is a, c, t, g, unknown, or other
  misc_feature (968)..(968): n is a, c, t, g, unknown, or other
  misc_feature (969)..(969): n is a, c, t, g, unknown, or other
  misc_feature (970)..(970): n is a, c, t, g, unknown, or other
  misc_feature (971)..(971): n is a, c, t, g, unknown, or other
  misc_feature (972)..(972): n is a, c, t, g, unknown, or other
  misc_feature (973)..(973): n is a, c, t, g, unknown, or other
  misc_feature (974)..(974): n is a, c, t, g, unknown, or other
  misc_feature (975)..(975): n is a, c, t, g, unknown, or other
  misc_feature (976)..(976): n is a, c, t, g, unknown, or other
  misc_feature (977)..(977): n is a, c, t, g, unknown, or other
  misc_feature (978)..(978): n is a, c, t, g, unknown, or other
  misc_feature (979)..(979): n is a, c, t, g, unknown, or other
  misc_feature (980)..(980): n is a, c, t, g, unknown, or other
  misc_feature (981)..(981): n is a, c, t, g, unknown, or other
  misc_feature (982)..(982): n is a, c, t, g, unknown, or other
tggagctccccgcggtggcggccgctctagaactagtggatcccccgggctgcaggaattcgtctcacccctagaaaaaaagctgaactcatacgaacctcgatttcttccgtccggcgtttttttttctctcagtttctgaggtatttctccccctttctttcttccctccctcccagtagattcttcactgctcggggatttggaacaaaggccgtggttcgaagctggtgtgttcgttcaattgtgcggaaagaaaggccagtgttatgtgtgaagctgaagcagtgaaggctagcaggtaggctggctctcgccgagcgatggatctcgagttcggaaggggcctgaggtccccaaagagagactcgtggaagaccaccttgctgctggcgtaccagagcctgggggtggtctacggcgacctcagcatctctccgctgtacgtgtacaagagcaccttcgccgaggacatccagcactcggagacgaacgaggagatcttcggcgtgctctccttcgtcttctggacgctcaccctcatccctctcgtcaagaggaacgtttgccctctactctctgatttgcaggcacgccaatgtgagcctcctcccgaaccggcagatcgccgatgaggagctttccacctacaagctgtaatgccctcctgtaatcaccgactagtcccgcatcaaggtgtggcttgagcggcacaggtagctgcgcgtcgctctgctggtcatggttatgatcgggacatgcatggttatcggggtacgtgttctcacgccagctatatccgtgttctcggcagtttcaggcctcgagttctcgctgtccaaggatcaacgtgaatatgctgtcatcccnnataacctgtgtcatattagcattcctatttgccctncagccctatgatctaccaagctctaaatccggcttacatgttcaagttctaaagccgtcnnnnnnnnnnnnnnnnt

SEQ ID NO: 92926 - DNA, 1156 bp, Zea mays
  misc_feature: Ceres CLONE 1581920
  misc_feature: Encodes the peptide sequence at SEQ ID NO. 92927
  misc_feature (53)..(53): n is a, c, t, g, unknown, or other
  misc_feature (54)..(54): n is a, c, t, g, unknown, or other
  misc_feature (1156)..(1156): n is a, c, t, g, unknown, or other
ttttttttctttatttcctctcgattgtcgcctttttcttcgttttttttttnnttattttttaaaactggagctccccgcggtggcggccgctctagaatagtggatcccccgggctgcaggaattcgtctcacccctagaaaaatcgccctgcatagcacagacacaaaccacgagcgcgaggcacgacctacatcgaatcggccacgaaccaccatggcggcctcacgcgcgctcctccccagcccgcaggtgagccctgcgagcgcgcgggtccgcctggccgcggccgtgccgtcgtcgctcacgctctcggcgcgctgcggggccggggccggtgcgcgtctccgcgtggggtgcgcgatcttgtgggcgcctgcgcccgtggcgcccaccgagtagaggccggtgcgccggattttgttgtcgcgctggaatgctcgctgcggtccatgccggccgtgctggtcttcttaatatagaacaaggaccggatggccttgccgctcctatttcacaaaacttgtacccccccctttgtaatgtaccccttagaaacacctcgctaagtgctggccctgttcccacccccttcattcttgctctatcagcgccttgagcgactacaggaagatgatttggaagagtcggaacaggcaccgacctatgggatgggggtggcccctagccggggcgttgggggaaaatcaaatatgttccgtaccgcagccagtgagagcgcaccgcgtggctcacggtgtgcgcttccttttttttgaacacgagctctcatacacacagaaagaagcgcttgtgtgccacgcgagcccgtataacaggggagactctagctctgttactgcacatccgaggtggatactacaactaccctcataattgcagacgcctcgcatcgaccaaaatgcattggataaagcggccgttagaagacaaagcccgatggcgggggtttattgcgtggtaggggtaacattttgcgcacgtgaaagtcatcaccccagaaatttgtatcaaaccattattatgctacgtgtacccacactctcccatgacatgtgtgcgttctacgattgtgcgccccaacccttattaattacaaaaacaacactgttccaacacacttattgttacagn

SEQ ID NO: 92927 - protein, 61 aa, Zea mays
  misc_feature: Ceres CLONE 1581920
MAASRALLPSPQVSPASARVRLAAAVPSSLTLSARCGAGAGARLRVGCAILWAPAPVAPTE

SEQ ID NO: 92928 - DNA, 915 bp, Zea mays
  misc_feature: Ceres CLONE 1581921
  misc_feature: Encodes the peptide sequence at SEQ ID NO. 92929
  misc_feature (744)..(744): n is a, c, t, g, unknown, or other
  misc_feature (768)..(768): n is a, c, t, g, unknown, or other
ctccccgcggtggcggccgctctagaactagtggatcccccgggctgcaggaattcgtctcaccccctagaaaaaccctccacccgcgccgtcgcctcgcctatccgatctgccacctcctcccgtctcgcacgttccttcccaactccgcagcgtagcctctccgcggcgcgatccagatccaggtttttcagcatgggcctggtgaaggaaggcatcgacatggaggagggaacccttgagatcggcatggagtacaggactgtatctggtgttgctgggcctctggtcatattggataaagtaaagggcccaaaagtacccaagaaattgtaaaacatccgacttgggagatgggcaccaatcggccgttgggtcaaagtccctggggaaaagtttaatgggcgaaaaaaaaccggtttgggggcagggccttttttaaaaagaaaaccttctgggggaaaaaaaaaaaaaaaaatatattccccacccccgggggggggttttttttaagggggggggggttttttataaaaaaacccccccccccccccccctatatatatattggggggggggggggccctttttttttatagaggggggggggggggggggagaaaaaaaaaaacacttttttttattgtggggggggggccccccccccccccccctattattttttttgtgcgcgggggcaaaaggagagcgtcgagggggaggggttgtatcaaggtcccccgngggtgggggggggggaaaatgttnaataaataatttaacccatccccccccaccccccctcggtgggcggggtgagaaatttgtatcctccttacccctttctcctcttttctgcgttttggggggaggagagattataagaattgttggtcgttcggcgttcatgggggg

SEQ ID NO: 92929 - protein, 46 aa, Zea mays
  misc_feature: Ceres CLONE 1581921
  misc_feature: SWISSPROT Homolog: EC 3.6.3.14 H(+)-transporting two-sector ATPase
MGLVKEGIDMEEGTLEIGMEYRTVSGVAGPLVILDKVKGPKVPKKL

SEQ ID NO: 92930 - DNA, 1014 bp, Zea mays
  misc_feature: Ceres CLONE 1581922
  misc_feature (391)..(391): n is a, c, t, g, unknown, or other
  misc_feature (420)..(420): n is a, c, t, g, unknown, or other
tggagctccccgcggtggcggccgctctagaactagtggatcccccgggctgcaggaattcgtctcacccctagaaaaaaaatcccaccacgcaggcagtcaggcacccgcattgtttcaaaaatctcgaatcggcccctggttctggcagcgcagccgccgccggcggacggagggccctctttccgggtgaggcaagtcgaggcctgctttgcctcgctgtaagctcgccggaagagggaaccggggaggggaaaagacgcgcggcagtggtggagtggaggtgccaggctgagggatgcgcgccgccgcccatgtacgcccgcgcgtgggtcgtgtgcctgctcgtgacgtcatctgcttgtcgtgcgcccgcgccgctacgccgccnttgagtccccgggcgggaagctgcacccncacctcaaaggggtcaaaagccggccgtgaaaaatttccaaaggccaaacggggaactgataaaatgggggacattccaaaccccccggggtttggtttcccccttcccccaaaaaacccccgttccaaatgagggcggaattccccccccgaaggggggttaaagaaaaacaagcgcccccccccactgtgggaaaaggcctttggggcccctctggggaacaaaaaagagaggggcccccacaaagagggccccccccccagaaaaaaagaaaaaaaaacccctctggggggggaccccttttccttctcccaaggaagaagaaggcccccccccaacaaaaattgtttgttctccccccccttaaaagggggggggggcctctctcttctatatttcggcgggggaaaaaatcccccgcgggcgaattttttttgttgggggggcgaaaaaaaaaaaaaacaaaaatatttcctcccctctgtggtgtgggggggggcgggagagaaaacacaaaagagggggtgggtgcgccccccccccaaagaaaaaaaaatcttttttttttttttttattacggggcgagtttttc

SEQ ID NO: 92931 - DNA, 950 bp, Zea mays
  misc_feature: Ceres CLONE 1581923
  misc_feature: Translation starting site: 167
  misc_feature: SWISSPROT Homolog: EC 6.2.1.3 Long-chain-fatty-acid--CoA ligase
  misc_feature (642)..(642): n is a, c, t, g, unknown, or other
  misc_feature (644)..(644): n is a, c, t, g, unknown, or other
  misc_feature (646)..(646): n is a, c, t, g, unknown, or other
  misc_feature (687)..(687): n is a, c, t, g, unknown, or other
  misc_feature (697)..(697): n is a, c, t, g, unknown, or other
  misc_feature (724)..(724): n is a, c, t, g, unknown, or other
  misc_feature (730)..(730): n is a, c, t, g, unknown, or other
gcggtggcggccgctctagaactagtggatcccccgggctgcaggaattcgtctcacccctagaaaaagccagggcgtcggatcggagcgagctcattctcaactcgactcaagagctctgcctcctccatctccccttctctggcctccggagccacgctgagagatggaggcgaatcccaagaacaccttcacgatcaaagtggaggacgggaagcccgggaaggacggccggctggcggtcggaccggtgttccggagcgttctggccaaggatgggttcccgcagcttgagcctgacatgaagacatcatgggacgtgttcagggtagcagcagtcaagtatgccgacaaccggatgctcggatggcgtccgttcaaagatggagtgccagggccctacttgtggaaatcatacaaggagatctacgacgaggtgctgcaagcaggctctgcgttgcagaagctgggagtgcagccaggttcccggggtggggatctacggagcgaactgtcctcagtggatagtggcaatgcaggcttgcaatggctatagtctagtctgtgtcccactgtacgatactttaggtgcgggagctgtcgactacatcatcgatcatgccgagatcgatgttgtcttcntncngggacagaaataaaagagatactgtccccaaactgcaagtnctgcaagagnactgaaagcatggtggcgttcacttcngcgacnactgaacagaacaaagaagcggatcaatttgggatcaaaagtatgcctgggacgatttctggaaagtggggaagataattctcgtcaaccttgcccctcgcagcaagtgaatctgcctgtcatgtaccgagtgggacagcggacgcccaaagtgtgatgctgacaatgaagcacgcctgtttgggaagggtggactcctctggaccattgatgaaaatga

SEQ ID NO: 92932 - DNA, 985 bp, Zea mays
  misc_feature: Ceres CLONE 1581925
  misc_feature: Encodes the peptide sequence at SEQ ID NO. 92933
ctccccgcggtggcggccgctctagaactagtggatcccccgggctgcaggaattcgtctcacccctagaaaaaacacacacactcccattcgctcccatccgccaggacactcttctccccggcgcagtcaggacactcttctccccggcgcagtcaggacactcttcttctcaccgccgccagcactgctctgggcgcgcgccgcctaccctcccctcttccctccctcacctctcgtcctcgaagcaagggtttccctgccccaggctgcctctcgtccgttctccttctctaccgccgccacaactcgcccgccgccccgccctcaccgccggcaacgtgacacgacaagcccacccctttattcctgcagctatactccgatggccctcgtgaagtccgacgctgaggaggagtggtccgactctgacttcgatgatgcctccgactccgaggtcgccgaagctctggactggctcgacgccgtggagggccctgacggctcagctcgcccccacgtcgccctctcggcctccggaagcggggctgcggcccgttaggcctacgcacacgggggcgtgctgtctcggccgctccagccggtgtctaaccggacccagaagcggggctcgcacattagggctactccccttggaggagtgggaaaggtagatgaacacttgcgaagtcaaattcccgccccaacggccatcggggattagacaaagggacacacctttttggggaaaaaaaggaaccacgaaaaaggtgatcggcgctcaagggaaaagggcttttggccccagaaaacgccggggttttattcaagaagagtaaacccggggggcctttaaaaaaataaaagggcggccctttcctctggagaaagaggcaaagtcttttcagttatacaaagcgcaggcgcaagaacttggatataaaggctcaaaaaacccgttccctgtgttttaggaaaaaaacca

SEQ ID NO: 92933 - protein, 58 aa, Zea mays
  misc_feature: Ceres CLONE 1581925
MALVKSDAEEEWSDSDFDDASDSEVAEALDWLDAVEGPDGSARPHVALSASGSGAAAR

SEQ ID NO: 92934 - DNA, 1208 bp, Zea mays
  misc_feature: Ceres CLONE 1581927
  misc_feature (1)..(1): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (53)..(53): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
  misc_feature (952)..(952): n is a, c, t, g, unknown, or other
  misc_feature (953)..(953): n is a, c, t, g, unknown, or other
  misc_feature (954)..(954): n is a, c, t, g, unknown, or other
  misc_feature (955)..(955): n is a, c, t, g, unknown, or other
  misc_feature (956)..(956): n is a, c, t, g, unknown, or other
  misc_feature (957)..(957): n is a, c, t, g, unknown, or other
  misc_feature (958)..(958): n is a, c, t, g, unknown, or other
nttttgttgcgcggcggcccaaccaaccaaaacaaataacacccttcnnananaannnaannnnnnattctggactccccgcggtggcggccgctctagaacagtggatcccccgggctgcaggaattcgtctcacccctagaaaaagccatacaattctcacacgcgcgcgcccaacacactagcctgcaggatcgtcgagcgcgaggcggctgccccgccggccggttcgttcgctctatagcttgagaccgatcctagctaggccaagactatatcggcggcgatgatgatggacgcggcgaggatcggagagtacttcaagggcaaaggcatcctcttcaccggctcaacaggggtttctgggaaagatccttgtggagaaaaaactggggggtgccgcctggaccggcgccagaatttacccggcttgtatgctcggtttcaccaatcctttttctaaagcgtcccccctctacaacgtggtgtattgtaaatatgcgccttccttgcccccaaaaaaaaaaaaatgggtcaggggccttcccacaatttcctaaaagggccaagggtcctctatttttggccggaagaaaaccctttaccaaccggcctcggggcctggaagcgcacccttggtttgaaacccgccgggggaaaagggcctctcaaactttttttttcatccccttttttttccaacttttaaaaccctttctataaaataacattttttttctcccctgggaaaatccaatttcccccgcgttttttatcccactccttttcttgtttttcccgcaaaaatttgtgtcgcacgggcgcgtccgggaagtttccctttcgccgtgtctccaccatgctatatttctattcgcgggctctctggtggaaggcggcccacccctgttgaaatagacacccccaagctcgcgcggatacctcggnnnnnnnnnnnttttgtcctttcccctttgttgcttcaacctcccttcataattaataattgtccactcatctttgatgcaccctccccattccctcttgtttccccgtttgagcctatttctcttgctgcgttatctctacgcttctgttttggtatcccgtttttacttctccgcacaccgctttttttggtttccggtctcatactctcttcgcccccttttttgtcacaccacacctgtcattattagccgttcttg

SEQ ID NO: 92935 - DNA, 1029 bp, Zea mays
  misc_feature: Ceres CLONE 1581928
  misc_feature: Encodes the peptide sequence at SEQ ID NO. 92936
  misc_feature (134)..(134): n is a, c, t, g, unknown, or other
  misc_feature (376)..(376): n is a, c, t, g, unknown, or other
ctccccgcggtggcggccgctctagaactagtggatcccccgggctgcatgaattcgtctcacccctagaaaaaagggccccacagtgcccgcgccaagagtgtccacttcaaccctagctccacctgcatctncccctcccctcccatcccctcccgcccgcctcccttcgtccactcggatccggaaaaccctaaccctagacgtcgcccggccgccgccatggaccccgacggcgacccggccttccaccgcaacgaggccatctccgcggtccaggatgtcgaccagtactatggcgacgacgacgacttcgacgacctctacaacgacgtcaacgtcgggggacggcttcctccacgcctcccaccagggngccgccgccgctggcgccgccacctccgactcagcatgcccccaccgccgcagaaagcaccagcttccctccgccggcccagcagctggccgccgccccaggaagaaccacctgcccaaagtccttccccgcaacgggccgcccaaagcccccaccgcccacaaaaaacagttaaaacacccccggggggggggcggtccccggcccccgggaaaaactctccgcccaaaaaaaactttccctccgcgcggcttaaacacaagggggggttttccggggcggcccggggcgcgttttggggcccccctatttttttggaaaaaaggggggaacaacccccccggggaggaaaaaaacccggggggggcccctcggggggggggaaaaaggggggccccctgggggggggggggggagaccctcggggggaaaaaacatttttgggggggggagaacccccgggggggaaaaaaagccgcgcgttgtgtaatttctcccccccaaaaaggggcgcccaaagagaattttttttcccaaaagaggggggggggaaaaaaaggggcccccccgcttgttttattcccccggggcgcccccgcggggggggaaagaacaccccctttcccctggggtggggtgtgtcggaccaaaaa

SEQ ID NO: 92936 - protein, 269 aa, Zea mays
  misc_feature: Ceres CLONE 1581928
  misc_feature (52)..(52): Xaa is any aa, unknown, or other
MDPDGDPAFHRNEAISAVQDVDQYYGDDDDFDDLYNDVNVGGRLPPRLPPGXRRRWRRHLRLSMPPPPQKAPASLRRPSSWPPPQEEPPAQSPSPQRAAQSPHRPQKTVKTPPGGGRSPAPGKNSPPKKNFPSARLKHKGGFSGAARGAFWGPPIFLEKRGEQPPRGGKKPGGGPSGGGKKGGPLGGGGGDPRGEKTFLGGGEPPGGKKSRALCNFSPPKRGAQREFFFPKEGGGKKRGPPACFIPPGRPRGGGKNTPFPLGWGVSDQK

SEQ ID NO: 92937 - DNA, 1230 bp, Zea mays
  misc_feature: Ceres CLONE 1581933
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (74)..(74): n is a, c, t, g, unknown, or other
  misc_feature (791)..(791): n is a, c, t, g, unknown, or other
  misc_feature (1229)..(1229): n is a, c, t, g, unknown, or other
ttcctttcttctgccgccctgcgccgcgccatctcgtaacaacgggctgggtctgcnnnntttacatttaatanatttctttactccccgcggtggcggccgctctagaactagtggatcccccgggctgcaggaattcgtctcacccctagaaaaaccccccttcccctctctcgcccctcctccctccgtctcgtctcccagggtctgggcaaaagctggagcaccgggaaaaatagccaggggggagattaaccgggaagagctaggtggattacttgggagaaaaaagtgcccccacaccccccccaggaggggggattcccaccagggtccaccttcaaggggaaaagaagcccatccgggcccggtgacccgccaaggggaattgcccagggggggggggggcttcgctttgagggcccccctttatcgggggggggggcccctaagaggggttcttgaaggctggggggggttccctggcctgtccaaaaattttctggcgccccccccttgtttgttgtaaacggggggaacaagaaccctgggggggttggcggtgtgccccccccccccctaaaatcctcctcccgggggtaccccctgtccctcttttttgggatagggggttttgtttcttgcgggggaccccccactctcccaaatactgttttctcctctgaaagccccgtgggaatagtccagaaacagtgcccttggagcgcccctcttgtttgaggcccatctttagtgtgccttgttgcgcccccccctccattgtgggcccnccccccccctcctttgtgatagcccttaacaccggggttctcctggggagcgctcgtccctctcgtaaattccgccgcgcgcacagagggttttttctcccgtgcccttctattatgtagggggtggggctgtttttccgcgcggcgcggtgatgtttctctatctccttaaggtggggtttgtttcatccagttgtggaggagcgcccggcggatagaaaatattcatgtccgcccgcgaggccgcctgtgaccatgccctccctccccgcaggtaaaaccgtcctccattaaagatttagtgagggcggcggttttgccactctattcagtacgcgtggctatatgcgttgtgctctacgttattcttttcttctcctatataaatgtgttgtctcctgttcggcgagagtgggcgttcctctccttacaagatcng

SEQ ID NO: 92938 - DNA, 953 bp, Zea mays
  misc_feature: Ceres CLONE 1581937
  misc_feature: Encodes the peptide sequence at SEQ ID NO. 92939
ctggagctccccgcggtggcggccgctctagaactagtggatcccccgggctgcaggaattcgtctcacccctagaaaaaagcgccagcgcggcagagagtcgagaccttctagctaggccgctgccacgtcaaaactagctcctccagacaaccaatcagctagccgaagccggtcgattagcatgcagcagcgctagtagacgtcgtctccgggtctccactctccacacagaaacccatacaaaatccgcatccagaatcaccggagatacgagtccgcgcgtacgttgcagttgaattgtgaagagaggctgtgcgcagtgctgctgctgcttcttcttcttcgacgcatgcacgcacatggatggtgctgctgagtgctgacctccggccgtacgtgatcttcgatctccacacggcggcaagcgatcgagaggcgtggttcccgtggcgtcaaccgacacctagcagctgctagctcatctgcttgatctctagctgagactccgagcaaaatgcagcagccaggaacaacaagctaggccccctcacgcagaccgcacgaccgagcgcgcggcattgaccgacccatcgccgccgccgccgcctcgatcgaccatgacgcctgcgagcacggacaatgtggtgctggtatgcatcgcgttcagcatcttctgggtgctgggcggtctcccctcggtgccgttcatgccgggtggtcggcacgcgggctcgctcctgggcgcatgctcatggtggctctccgcgtgatgaccccggtagatgcctacaagtcatcgaccctccgatcctggggctgtctctcggcaccaggggggtaagatcttcctggagcgcgccaaatgttcagtacctccgcagcccccttggctggcggaacgtggcacaaggacctgctgtcccggtctggcctctgttccccgtgggcag

SEQ ID NO: 92939 - protein, 50 aa, Zea mays
  misc_feature: Ceres CLONE 1581937
MTPASTDNVVLVCIAFSIFWVLGGLPSVPFMPGGRHAGSLLGACSWWLSA

SEQ ID NO: 92940 - DNA, 1273 bp, Zea mays
  misc_feature: Ceres CLONE 1581938
  misc_feature (63)..(63): n is a, c, t, g, unknown, or other
  misc_feature (943)..(943): n is a, c, t, g, unknown, or other
gcctttgcgtcttttctccgtcaatgttccccataaactctttctttttttttttttttcccnttttttggggctccccgcggtggcggccgctctagaactagtggatcccccgggctgcaggagttcgtctcacccctagaaaaagggagtgccaatgcctccagcccagcttgcctgccacctgcgtcttgaccctctcctggatatgaggagcagcagccaaagggacatcaaactgtgctgcctgcgtgtgtgccttctttcttgcctctcccttcttcaacctttgctagcttgccagggagggagagtccctgaattccaggagaagcctgcttctcatccgccctctttgctagctggtctccaaacttagagagcagtggtttccttctccttctctcccattccccttccccgcaccacaaggtccaatggataccctgaaaaccatgaatgcgccgaaaccccccttggggggtgcccactaaaaccggccgtgggcattgtggggaaaaagaaacagctttcagcggtctccataaaaccccttttaccctttaaaagggtgaaaaaagggtttttgcctcaagttctcctctctaaagaatgggcttctgggaaccatgacatttttacccgtgtgggtataccttcatataccaaaaacagagggcttctatcaaaaatgaaatttcccaataaccccctttataaaaaaaaacaaaacggtctgattgttgttttcctaccccatattattccttttataaaagaatacgatcaccattatctccccctttcttctataaactgcacctcttcctcttttggcgccaaataaatgatgattaacccatgtattttttttccaacgctttttaaaaaaaaaaataaataacctcctcccaagttgtgattgtccccctcctcacccttntttttcctccgcttgtttttcacaacctcctcgcccccttttgttgcgacgagcacctttctcataaattaccgcggcgcgacatcaagggttccttgtcaaaggagtggggtgagggccccgtatggtgtccactttctctatatatatacaatctctagttttcacacacgtggagtaacacaaaatcccctctccattatgtcctgtcttatcgacgcgcaccaaatatatatattacccgtagtgtgcctataattttatatcaactctttacgccgattatccctacctctgaattcaacgagtggtgcagcactctaaatattt

SEQ ID NO: 92941 - DNA, 1333 bp, Zea mays
  misc_feature: Ceres CLONE 1581939
  misc_feature (63)..(63): n is a, c, t, g, unknown, or other
  misc_feature (964)..(964): n is a, c, t, g, unknown, or other
  misc_feature (1092)..(1092): n is a, c, t, g, unknown, or other
  misc_feature (1159)..(1159): n is a, c, t, g, unknown, or other
  misc_feature (1171)..(1171): n is a, c, t, g, unknown, or other
  misc_feature (1191)..(1191): n is a, c, t, g, unknown, or other
tgtttctttttctttctccttcttccctccccttctgccttttttttttcttcttttttatcntttttaatagctggagctcaccgcggtggcggccgctctagaactagtggatcccccgggctgcaggaattcgtctcacccctagaaaaatctccatcccgcatcgcgcatcgcatccaccgccgagctttctttctttctttctttcttttttctgggagaagaggaagaagaggggaggcgcgacaaaaagggcgccgcgccacgcatcgcccccgacgccggcatctctccctcgctctcctttctccgatctgatccgaagcgcggcgtcgacgacgacgacctaagggcacgatgcatttgaaccaacctgctgctggaggaagccatccggaagggcctccattctgggagccatccaagaaccagtttcttcccgggggatgaccaaaaatgtttggccccccccgccccaaggtcgggctccgtggaaaaccttttcctcctgtgcttaaggggcgggaattttcggtcgccggcggttccaatttccccggggggggaaagcccccccccccccccccggggtaaacccctcgaaaacccctcaaggcttcgccctttcgatcccccccaaacaaaattcgtggcccgctgttttttgttctaaaccacagtttggggaccccgaaaacctcccatgggttggtccacaccataatggtgggaaaactcccccctttccttccctcttaagagagaaaaaaacggtgattttgttcttgttgcgctccatccccgccttactcgtggggaggccacataaaacacccccccccccttccctactctttggtgtgcgccgaccttattgtaataattcctcatgttagggggtgctccctcccacagaggagtgtttgtttttcgcacacccgcgcgggggagtaccacacancaatacttttgtgtggtggtgcgcaaaacatatttattttagtgtttcttatgggcgcgggggccgcgagaaatactataccactttacttagttgtctgtgagagagaagttatctctctcttcgcnctactactgagtagatgaatcagtgatgttgctcgttgtacactttcctcatattaagaaaacgaancccaccctcttnattcgcgggggggtggtacncctcttcccaccccccatattttttactgtctatctaactcactccccttatattttctttccgcccccttctctcttatgttattattataagactagcgagttgtgtttcaacacacttacgttgcgcgcgggtcttccg

SEQ ID NO: 92942 - DNA, 1333 bp, Zea mays
  misc_feature: Ceres CLONE 1581940
  misc_feature: Encodes the peptide sequence at SEQ ID NO. 92943
  misc_feature (60)..(60): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (851)..(851): n is a, c, t, g, unknown, or other
  misc_feature (899)..(899): n is a, c, t, g, unknown, or other
  misc_feature (1047)..(1047): n is a, c, t, g, unknown, or other
ccagtgagtcctccccccgtcctaccgcccctttggccatgttttttaatataaagaatntnnntaagctggagctccccgcggtggcggccgctctagaactagtggatcccccgggctgcaggaatgcgtctcacccctagaaaaaattccatccccaaccaaacaagtttagatataaaaatatagcatcgcccgcgctactggagagtctggatcctcctgaacctccaggcagcaagcgatgaaaggagggacgcaagcagttagcctgatggtgcaccttgctgtgccatggctctgcctatgcttcttgggtagctctgccaaccggtgctagcatctggaaatgtgggtggaagaagctcccaatccggataagcaaattaccctaaattggaacttcaggtaccctgtcgggcaactccccaacaagtccaggaattttgttggctttctatcgtgggcagcgtcgcccccccccatggggggtgggcaccgctggcgggtgatccctggtcctgggtttacaaaataacaacccctttctgagtgcccaaacgttttgtttaacccgcttcctttgggcggtatatacgcgagagtggggctgtcaccatcgttgtgaataagtggggtggtgtcccgaaagccccttaacacttctggcgcgttggtagtacaccacggggttatggtttcttatacccctcccactattgtaaaagattggcacgtttacaatctcctttgttagagggaggaaatgcggctatttcttcccgcagtgcgctcgtttgcggtgtgggacacaatcagtatatcgcgcccgcttgttgatgggaggttcnatggaccgcgtgtgggttgttattactccaccgtgttgttggtgatanttacggtccacgcgctcgggtgttcgtcccgtagttattatcgtcgcgctgtagctcacgatgtatatatcataaactgcgttcgtatgtgcgcgcatacgaagtactaggatataataattggatgtcggcagaaacatgtaagctngtcgcctttgctaacgacgcactgatgtgcctctgttgagcctgttgcggggagtgtgttacttcactccactgcacatatttgaggtgcgagatttgcgtgtgtgcgtgctgtatcctcccacgttcttacctaccactggtatggttgttatgtgccgctgctcacaatctatacgcattcttttttcccctccacgctaccattatgtgtaatctcggtcatcagagcttttatgttcttatctacaacccactgtgtgttattgacaacagtccgtttcggc

SEQ ID NO: 92943 - protein, 34 aa, Zea mays
  misc_feature: Ceres CLONE 1581940
  misc_feature (8)..(8): Xaa is any aa, unknown, or other
  misc_feature (9)..(9): Xaa is any aa, unknown, or other
MFFNIKNXXKLELPAVAAALELVDPPGCRNASHP

SEQ ID NO: 92944 - DNA, 1060 bp, Zea mays
  misc_feature: Ceres CLONE 1581941
  misc_feature (367)..(367): n is a, c, t, g, unknown, or other
  misc_feature (368)..(368): n is a, c, t, g, unknown, or other
  misc_feature (384)..(384): n is a, c, t, g, unknown, or other
  misc_feature (389)..(389): n is a, c, t, g, unknown, or other
  misc_feature (392)..(392): n is a, c, t, g, unknown, or other
  misc_feature (451)..(451): n is a, c, t, g, unknown, or other
  misc_feature (454)..(454): n is a, c, t, g, unknown, or other
  misc_feature (482)..(482): n is a, c, t, g, unknown, or other
ccccgcggtggcggccgctctagaactagtggatcccccgggctgcaggaattcgtctcacccctagaaaaaaaggtcgcgttccatcgattctccacgagcggatagcggcgtacagatcttttcgtgctcgtcttcgcgtcggtgtggctggccccccgtgagaagtcaaaatctcacagcatattgattgggctgattgattccgtgggcgggaatcggggatctggcattctcgcgcccaaaaggtcgcagctttctttcgtgtcgccagccggtgcgcggtcgacgacgcagagcgtggagggtgtcccgctagtagctcctcgacgacgacggtgacgggaggccgggggttgaccatggnntgcgcggcggacctgnaggcngcngaacgggtggtgggcgaactccccgaagcgtgccgcggcgcggctctaccaaggtggcngcngccaatggatgcggaaaatgcccgcccngactggcccaagaaagccggcaccaaaatcaagaataacggtttccttcgttggaaaaccccccccagggggaacgaaagaaggcgtctttcataccccttggaacttgggcagaacaaaaatttccggtgggtggccgtggtgcatttccccgggaaaagaacaaggcgtggggcccaaaccaaaaaccccaaggaaggggtccttccccccccccccccccggtgtgggggaaacccctcgggaaagtgtttgggggttttttatcccccccccccaaacaaaaataatctcccccccccggggggaaaaggggacgcgcggggaaaaaaaaaacgggggttttctttttttttctcccgccggggcaaaaatttttttgtgggggggccctcttaatgtaaaacaaggtttttttttccaaaacacctttgggggggaatttcccccccactccccccccgccgggaaaaaaagaggccccctccgtttggggggggaataataaagagggggcggggggggggggcgcgaaaaaaaaagaaaaccccctggttatatattttcctcccccccct

SEQ ID NO: 92945 - DNA, 1088 bp, Zea mays
  misc_feature: Ceres CLONE 1581943
  misc_feature: Encodes the peptide sequence at SEQ ID NO. 92946
  misc_feature (1075)..(1075): n is a, c, t, g, unknown, or other
  misc_feature (1088)..(1088): n is a, c, t, g, unknown, or other
ctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgacctgtggaaccgcaccacgccgtcctatgtcggcttcaccgacaccgagcggctcatcggcgacgctgccaagaaccaggtcgccatgaagcccacccacaccgtcttcgatgccaagcggttgatcggcaggaggttctctgatccgtcagtgcagagtgacatgaaacttatgtccgtttcaaggtcatcccaggggccctggtgaaaaagccccttgatttgtagtgaaacttccaagggccgaaggaaaaaccagttttggctgcctgaagggagatcctccctccaatgggtcctccattcaagaatgaaagggagaattggctggtataacccttaacctttggttttccacccctttccaagataacgcccatgggggtggaacaagtgggcccggggccctttcttttcaaaacgaaacctccgtcaaaaggggcggggatcccccccaaggggatccccccgtgggtgttcattggtgggggccccctcaaatgggtaaagcgggtatatagttcaacgggattccaccccggggtggggggctcttatggccccacaggggctctttaataagaaaaggccaacccagcgtcgcggggaagaaagaaaccgggccccaccctctcgaactctgggggggggggcgccttttagaagtggttccttcctccaccatcaattggagggggctttttcagagggaagagacccctgggggggtaaccccaccttgggtgggaggaatttttatctgccggtgtgggccaatgccncaaatagttaggn

SEQ ID NO: 92946 - protein, 102 aa, Zea mays
  misc_feature: Ceres CLONE 1581943
MAKSEGPAIGIDLGTTYSCVGVWQHDRVEIIANDLWNRTTPSYVGFTDTERLIGDAAKNQVAMKPTHTVFDAKRLIGRRFSDPSVQSDMKLMSVSRSSQGPW

SEQ ID NO: 92947 - DNA, 927 bp, Zea mays
  misc_feature: Ceres CLONE 1581944
ctccccgcggtggcggccgctctagaactagtggatcccccgggctgcaggaattcgtctcacccctagaaaaaacctgggccgtcagactcgccgcgcggcgcggcgcggtgcggccccggccacatcgccgattcctcggttcctccgcacgcgcacgcttcacccccgccgccccgcgcccagccgtcgccgtgatcgcccgagcgttactctgccgagccgttcggccggtccactcccgcgaagcttccagcagaggcgaccttcggatcgagtctcggccgccgaggagtcgaggccatggaaagtggtggcgtcggcgccggggtaagtgctcatcgcgggaggatacctcgtgctggagcgcccctacgcccgtctagtcctcagcaccaccgcccgcttctactgcgtcgtccgcccccctcgcgaacatgctcccggcgaacgcttggggctggggcgtggacggatgtcaaaagtgacttcccctccgctctcacggtaagccacatacaaggctgtccctaaacgaagtccgggctgccaattgaactcggggaagggatctacaaacccttttgggggagcgggccataaaatttccgggagcagctgcttaaggcgaccctttttggataagggaaggaaaggagtgttaaaaaaaaatggcgccccggaaagggcggaaaaattaaattcctgggaggccaggattttttttctttataaaaaacaaatttaaaaaccgggggctcccccttttccccaaaaggacgggtttttttgggcccccatttcctttaaaaccatttttaccccaaggggggcaatgggaaaaagggccgggggggaaatggtaaaccggagtggccccaaaggggggttggggtctcccccggccaggagaccactaattgtggt

SEQ ID NO: 92948 - DNA, 1042 bp, Zea mays
  misc_feature: Ceres CLONE 1581947
  misc_feature: Encodes the peptide sequence at SEQ ID NO. 92949
  misc_feature (395)..(395): n is a, c, t, g, unknown, or other
  misc_feature (838)..(838): n is a, c, t, g, unknown, or other
  misc_feature (847)..(847): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
tggagctccccgcggtggcggccgctctagaactagtggatcccccgggctgcaggaattcgtctcacccctagaaaaaacgctccgggttcgcgcccgactcccctacaaattcgctccaccggcggctccggctgcaaaccgcgactgactgctgaccccgagcggcaccagcgcgcccgccccgccatggctatccccaacgcctttgactcccccctcgcggccaggtccgccgtcggcgcggcgctggcggccgtcatcgccgtccgcgcggtccgccgccgctccctagacgcctcgggcggggtcgccggcttcgtcgtcatggcggtccacatctcatgcggctacaggtacgggggcgctgctgctgggccttcttcttctatccncccaagttaaccaagatcggggaagaacccaaggcgccccatccaagaaaaaattcaaggaagggcgggcaccccaacggggatcaaatttcaacaaaatacacaaattggccccggggacggggtggggaaatttggccccaaagggctggggggggaaaaacctgggcctgggcccccaaaaggttaaaaactttaaaacggggcctcaagaggggggatctttggccccccactttgtggccggaagagggaaaaaaatttgggccccctaaaaaaagggggtgcgtttttaataaaaaacaaaaaggggtttgttttcaccccccttaaccccgtggagaaagagagggaaaaaaagggggggcgcccccctctaaaaaaaatttttttttctccccacgaagagggagcgccccttttgtggggccccccccttcttntttggcggnagaaannnnnnnnnnaaaaaatattttttctcttataagggagggaaggagggaactcataaaaaaacccacccctttctttcaatggtgttgttttttgaaaaaaatattatgttttcgtgcggcggaagggcccgaaattattattttgtgtactggtcttcgcgagaggggagacggcacacaacccacgcc

SEQ ID NO: 92949 - protein, 71 aa, Zea mays
  misc_feature: Ceres CLONE 1581947
  misc_feature (69)..(69): Xaa is any aa, unknown, or other
MAIPNAFDSPLAARSAVGAALAAVIAVRAVRRRSLDASGGVAGFVVMAVHISCGYRYGGAAAGPSSSIXPS

SEQ ID NO: 92950 - DNA, 919 bp, Zea mays
  misc_feature: Ceres CLONE 1581948
  misc_feature: Translation starting site: 398
  misc_feature: SWISSPROT Homolog: EC 5.4.99.8 Cycloartenol synthase
  misc_feature (232)..(232): n is a, c, t, g, unknown, or other
  misc_feature (248)..(248): n is a, c, t, g, unknown, or other
  misc_feature (252)..(252): n is a, c, t, g, unknown, or other
  misc_feature (255)..(255): n is a, c, t, g, unknown, or other
ggatctccccgcggtggcggccgctctagaactagtggatcccccggtctgcaggaattcgtctcacccctagaaaaattgccatctaccttcggaacgttgaagcacagctgcacgggtatcatatcggtagtctagtaatataataaaccgctgaagcttggttgtgcagtaggtttcgttgcattgagcggcggtacgtggaggagcatgggaggttaaaggatcgganagggggggagggccgnggangcngacggggagcggcttccagggccgggcgggttgggagtacgacccggacgccggcaccgacgaggagcgcagcaagggggagcagcttcgccgggagttcacagagaaccgcttccgaaggagggaatcgcaggacctcctcatgcgtatgcaggtaactggacaaaaacatctgcatgcggacgaaatgggagcggccacccagatagaggatggcgaccaggcgacggaggagaggttgccggagccgctgaggcgagcgctggggggggatgtctgctctcccagctgaagatggccactggcccggggatttcagggggaatacgtacattatgccgttcctgattttcgcccgggcacatcccggatccaccgatggtggcccattcaaagaagctagacgtgagatctgccgccctttcttcacccttcaaaccagggacggagagggggcctcaccacttaaatgaaagcgccatgtttttccctgcctaaaactacccggcccggagacctccgggggagggccacaggaggaaaacgaggggccaccaaagggcggcatgggacctttccccgggaatggcactggggcccggggggggaaaaaacaaccccggggattgggggtaatgatgggggggcaaaatctgtgtgtcct

SEQ ID NO: 92951 - DNA, 966 bp, Zea mays
  misc_feature: Ceres CLONE 1581949
cccgcggtggcggccgctctagaactagtggatcccccgggctgcaggaattcgtctcacccctagaaaaagtcgccctcccctcgcgcaccgctcgcaaaacctctcctgctcctacgcccgccccaaaccctagccccgacagcgcgtgcagctcgtggctattggcacgctgtcagtccccgttctgtccggttgggggcggggtacgaatgagcccggcgaattccttttctcccggggtttggtggatcatatctcttttaaccgcggggttctttctctgttgccctccttggaagatttataagggggggttcggggggggctccttaaataccgggtcccccccggccggggctggataaatgtaaatgtgcttcccccaatttgggggccccccttttttgtttttgggaagggtgggcgcccccccccatgtccaatttggacattgttggtgttatcaccgaaaaataattgtgttttgagaaaacctcctccggggagcgtcttgtgtgtctttaattttttttgcaccctttttaccgcgggtcattaattgccttataaagaaatggggggggataccccccctcccgcgccggggggtacccgtactcccttgctgagtaggacaccctccttttgtgggatagggaataaattttgtgttactaaatagactctcccggttctgttcttgtactcacgatgtatgttgggctgcacccatacaactttaccattatccggcctttttgtcttttctctcttagagaaaaatttctcttccggcggaagctaaattccgcggatgggtgttttccaccccattttggtgtccgtttcactttgtctggttgtggcgttattcgtacaaagagtccaggtttttcagtatgtctctcccctctcttttctgtgccgagtgcttctccctattcccccctcttttttggggca

SEQ ID NO: 92952 - DNA, 952 bp, Zea mays
  misc_feature: Ceres CLONE 1581953
  misc_feature: Encodes the peptide sequence at SEQ ID NO. 92953
  misc_feature (745)..(745): n is a, c, t, g, unknown, or other
  misc_feature (792)..(792): n is a, c, t, g, unknown, or other
  misc_feature (794)..(794): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
  misc_feature (887)..(887): n is a, c, t, g, unknown, or other
  misc_feature (888)..(888): n is a, c, t, g, unknown, or other
  misc_feature (889)..(889): n is a, c, t, g, unknown, or other
  misc_feature (890)..(890): n is a, c, t, g, unknown, or other
  misc_feature (891)..(891): n is a, c, t, g, unknown, or other
  misc_feature (892)..(892): n is a, c, t, g, unknown, or other
  misc_feature (893)..(893): n is a, c, t, g, unknown, or other
  misc_feature (894)..(894): n is a, c, t, g, unknown, or other
  misc_feature (895)..(895): n is a, c, t, g, unknown, or other
  misc_feature (896)..(896): n is a, c, t, g, unknown, or other
  misc_feature (897)..(897): n is a, c, t, g, unknown, or other
  misc_feature (898)..(898): n is a, c, t, g, unknown, or other
  misc_feature (899)..(899): n is a, c, t, g, unknown, or other
  misc_feature (900)..(900): n is a, c, t, g, unknown, or other
  misc_feature (901)..(901): n is a, c, t, g, unknown, or other
  misc_feature (902)..(902): n is a, c, t, g, unknown, or other
  misc_feature (903)..(903): n is a, c, t, g, unknown, or other
  misc_feature (904)..(904): n is a, c, t, g, unknown, or other
  misc_feature (905)..(905): n is a, c, t, g, unknown, or other
  misc_feature (906)..(906): n is a, c, t, g, unknown, or other
  misc_feature (907)..(907): n is a, c, t, g, unknown, or other
  misc_feature (908)..(908): n is a, c, t, g, unknown, or other
  misc_feature (909)..(909): n is a, c, t, g, unknown, or other
  misc_feature (910)..(910): n is a, c, t, g, unknown, or other
  misc_feature (911)..(911): n is a, c, t, g, unknown, or other
  misc_feature (912)..(912): n is a, c, t, g, unknown, or other
  misc_feature (913)..(913): n is a, c, t, g, unknown, or other
  misc_feature (914)..(914): n is a, c, t, g, unknown, or other
  misc_feature (915)..(915): n is a, c, t, g, unknown, or other
  misc_feature (916)..(916): n is a, c, t, g, unknown, or other
  misc_feature (917)..(917): n is a, c, t, g, unknown, or other
  misc_feature (918)..(918): n is a, c, t, g, unknown, or other
  misc_feature (919)..(919): n is a, c, t, g, unknown, or other
  misc_feature (920)..(920): n is a, c, t, g, unknown, or other
  misc_feature (921)..(921): n is a, c, t, g, unknown, or other
  misc_feature (922)..(922): n is a, c, t, g, unknown, or other
  misc_feature (923)..(923): n is a, c, t, g, unknown, or other
  misc_feature (924)..(924): n is a, c, t, g, unknown, or other
  misc_feature (925)..(925): n is a, c, t, g, unknown, or other
  misc_feature (926)..(926): n is a, c, t, g, unknown, or other
  misc_feature (927)..(927): n is a, c, t, g, unknown, or other
  misc_feature (928)..(928): n is a, c, t, g, unknown, or other
  misc_feature (929)..(929): n is a, c, t, g, unknown, or other
  misc_feature (930)..(930): n is a, c, t, g, unknown, or other
  misc_feature (931)..(931): n is a, c, t, g, unknown, or other
  misc_feature (932)..(932): n is a, c, t, g, unknown, or other
  misc_feature (933)..(933): n is a, c, t, g, unknown, or other
  misc_feature (934)..(934): n is a, c, t, g, unknown, or other
  misc_feature (935)..(935): n is a, c, t, g, unknown, or other
  misc_feature (936)..(936): n is a, c, t, g, unknown, or other
  misc_feature (937)..(937): n is a, c, t, g, unknown, or other
  misc_feature (938)..(938): n is a, c, t, g, unknown, or other
  misc_feature (939)..(939): n is a, c, t, g, unknown, or other
  misc_feature (940)..(940): n is a, c, t, g, unknown, or other
  misc_feature (941)..(941): n is a, c, t, g, unknown, or other
  misc_feature (942)..(942): n is a, c, t, g, unknown, or other
  misc_feature (943)..(943): n is a, c, t, g, unknown, or other
  misc_feature (944)..(944): n is a, c, t, g, unknown, or other
  misc_feature (945)..(945): n is a, c, t, g, unknown, or other
  misc_feature (946)..(946): n is a, c, t, g, unknown, or other
  misc_feature (947)..(947): n is a, c, t, g, unknown, or other
  misc_feature (948)..(948): n is a, c, t, g, unknown, or other
  misc_feature (949)..(949): n is a, c, t, g, unknown, or other
  misc_feature (950)..(950): n is a, c, t, g, unknown, or other
  misc_feature (951)..(951): n is a, c, t, g, unknown, or other
acccgcggtggcggccgctctagaactagtggatcccccgggctgcaggaattcgtctcacccctagaaaaactccttccgccgccgcacttctcccctgaccctaggtcaaagtatcgccgacttcgccagccggatcatgtcgaccagcgccaacccgaaactgaagcggcggcgggggggcttgcggaagcagggtcctgggtaccccacggtggccaccacgggggcaatgtttgcccatgaggtgggcgccgaagggccacggagggacacgaggcaaggacccgcgttgcctagggtggttgccacctcgaccaggggaggaggtgccattgagcagggcgctgacggaatggaaggttcggcgtcgaaaactgataggagcgttcacgaggcagttggcgtcgatggcacgtacctcaccgagacacggtttgatcaatgtgccatttctccactgtcactgaaagccatcaaagatgctggatatgagaggatgactcgggtgcaggaggctactctgccaataattcttcaaggaaaggatgttcttgcaaaagcgaagacaggaacagggaaaacagttgcctttttggtactccttgcctaaagcccaactgatcaatttgactgtcgtagcagttttctcagcgatataactactggattaacccatgtgactgagttctaatttcttttagcttccagccatcgaagttctctctgcattaccctcgtcaanctctataaatttgctggtgatgtgccctaccagggatgctgcaaccnanttggctgctgaggcaggaagcttctcagtatctcgctcactggggtgtcaaggtgtataaggtgcacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 92953 - protein, 157 aa, Zea mays
  misc_feature: Ceres CLONE 1581953
MSTSANPKLKRRRGGLRKQGPGYPTVATTGAMFAHEVGAEGPRRDTRQGPALPRVVATSTRGGGAIEQGADGMEGSASKTDRSVHEAVGVDGTYLTETRFDQCAISPLSLKAIKDAGYERMTRVQEATLPIILQGKDVLAKAKTGTGKTVAFLVLLA

SEQ ID NO: 92954 - DNA, 903 bp, Zea mays
  misc_feature: Ceres CLONE 1581954
  misc_feature: SWISSPROT Homolog: EC 4.1.1.50 Adenosylmethionine decarboxylase
  misc_feature (564)..(564): n is a, c, t, g, unknown, or other
  misc_feature (609)..(609): n is a, c, t, g, unknown, or other
ccgcggtggcggccgctctagaactagtggatcccccgggctgcaggaattcgtctcacccctagaaaaacttcagccgcacgcttcttgttgccaaagaattccctcccctagccgccgccgccgctcgtctccctgagaggtgccgggaccgaggaactggccgagttctaggtagagaatcggttttgcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgncttctgataatcgaccagttccccagtcttgctccttgcactccntcctccctcatctccagcattgtgttctgattcactgctccaatggctgttctttctgctgctgatgcttccccggtctcagctatcgggttgagggctatgagaagcgcttgagatcacattctctgaggcacctgtcttttgtgaaccccatgggttgtggttggcgtgccctctccagggcccaaatgaccctgttcggaatcttgccgggggcacaacgtggcgacctcccacaaggtttcaaccattagtctttccgagcgagctggtttcctccccggagatggccct

SEQ ID NO: 92955 - DNA, 936 bp, Zea mays
  misc_feature: Ceres CLONE 1581957
  misc_feature: Encodes the peptide sequence at SEQ ID NO. 92956
  misc_feature (48)..(48): n is a, c, t, g, unknown, or other
ctggagctccccgcggtggcggccgctctagaactagtggatcccccngggctgcaggaattcgtctcacccctagaaaaagagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacatgaggccgcccctgtgacgatcgaggacgtggacctcagctctcatcaggccgcggccgacgacggggagctcgccgcgcggtgggcgggaagtccacgggcagcacaaccggggaaggtctgctggaccccatcgacgggcgtgcctcctcagggagctcatccggctacgggggagttcgccccaggccaacttacgaaaggcttcaaatagaacgctttcttcccctaagtgggggagcttgaagtaacccgggaaataactttttctcaaaaagtcggccttggggggatttgggttaaaaaggaaccccgttatcttttggcccctgggaaaaaaccctaatgccccaaattttgggattaaaaggggcccaaccccccaatatgtgagaggatccgggccttttctacgggggaagtggcctgttccccccaaaaaaaaaaagggcgggtctctcccccggaaaatacccggtgggggggcggggaacctcccccccccccgggggggggcgccatttaagccc

SEQ ID NO: 92956 - protein, 122 aa, Zea mays
  misc_feature: Ceres CLONE 1581957
MAATVSSCLSLVPTVHHRAGGFPSSVALTNTLQRRRRSRRYLVVASATRAEHEAAPVTIEDVDLSSHQAAADDGELAARWAGSPRAAQPGKVCWTPSTGVPPQGAHPATGEFAPGQLTKGFK

SEQ ID NO: 92957 - DNA, 1192 bp, Zea mays
  misc_feature: Ceres CLONE 1581959
  misc_feature: Encodes the peptide sequence at SEQ ID NO. 92958
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
accgcagtcgtctaccagcccccgggggctcctctaaggcgcgacggttctttcacctcacccgttacnnntttaactcgggggggaggctgccgccctcgaactagtggatcccccgggctgcttgtactcgtctcacccctagaaaaaacgcacgtccgcacgccgctcttcttcttctgcttgctctgggttcctccattcctctccagtctccatcacaggagcacgcgacgcgcgccacaggaaggaagggaaaaaacatggcggcggcgaacggggacgcgtgccgcagcgtcggcggggtgccgcgcccgacgaaccccatggtgacgccgctgctcaccgacctgtaccagttcaacatggtctacgcctactgaaaggccggcaagcacctcgaccgcgcagtctttgatctctacttccggaaaaatccatttggcggggagttcaccatcttcggtgggccccacgagaagtataaggttcattgctaacttcaagtccacggaggaggaaatcaaatctcttccatctggcatgcctgccagggaaggaggactcctttgaggaccctccggtcccattgactgctccacacctggaagggttattgccataaccaaaggggttatgcttgtggtccccctaaaaggcccaccggacgaagaaattgaaaggacctcgtgtgcatggtgcgcccacgcttttcttggaaaactcccattttccctagatcccctggcccaacccatatgccctccccccgcggtgtaaccacccgaaattgcccggacaccgcggccaccacaaactttgtgaaacctcgggggaaaggcgctaaagagacatctcacactggaaaattctgggacccgcccatagagggactccctagggggccttaaaaggggagggcacttagtgggcataccaagagtaattgcggtactatgggggaggcgcttgtgtatgaaccaaatttacaagttgttccaatgagaaaatatggtgcgggaaaaccgaattcagggggcaacttattccgcaggcactctataaaatctcccgcaatcggcgtttaacgaaaagttttggaacaaaacaatgcgattctcgcgtgtgtccatcaccgcggagacaatgtgcctcacgggtggccgaatgggggataacgagaagagtcgct

SEQ ID NO: 92958 - protein, 39 aa, Zea mays
  misc_feature: Ceres CLONE 1581959
MAAANGDACRSVGGVPRPTNPMVTPLLTDLYQFNMVYAY

SEQ ID NO: 92959 - DNA, 1333 bp, Zea mays
  misc_feature: Ceres CLONE 1581963
  misc_feature: Encodes the peptide sequence at SEQ ID NO. 92960
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (940)..(940): n is a, c, t, g, unknown, or other
  misc_feature (998)..(998): n is a, c, t, g, unknown, or other
  misc_feature (1164)..(1164): n is a, c, t, g, unknown, or other
  misc_feature (1175)..(1175): n is a, c, t, g, unknown, or other
  misc_feature (1177)..(1177): n is a, c, t, g, unknown, or other
  misc_feature (1264)..(1264): n is a, c, t, g, unknown, or other
gcgtgggcttttttcccccttctttccctccctggtatgtactatttttcttcttaaaannntttttggagctcaccgcggtggcggccgctctagaatagtggatcccccgggctgcaggaattcgtctcacccagtagaaaaatctccatcccgcatcgcgcatcgcatccaccgccgagctttctttctttctttctttcttttttgtgggagaagaggaagaagaggggaggcgcgacaaaaagggcgccgcgccacgcatcgcccccgacgccggcatctctccctcgctctccttctcccgatctgatccgaagcgcggcgtcgacgacgacgaccttagggcacgatgcattcgacccacctgctgctggaggagcccatccggatggcctccatcctggagcccatcaggaccagcttctttcccgggatgaaccaatattgtggggccggtcccccccaagtcgcggctcggtggaaccattctcctccggcctcaagggccggttttgtcctccccgcggtttcaattttcccggtggtaaaaccccccctttcccccggggggaggcctcggaaaacccttaggcctgccctctttaaagtcccccccaaaaaactcggggccccgtgtattgcttttaacactgtgttgggacccgagacccccccgggggggggccaacaataggtggaaaaacccccccccttttccctctccaaggataaaagaggagcgctgtttgttgtcccccccccctctcttatttgggggccaataaaaataaccctctcccccccatgggtgtttgcgcccctattatttttttattttgggtacccgccctccagaagtgtgtttttcaccactctatctggtgaaacacacatatctcttgttgtgtggggcgcccacaacctattgtttctaccncacggcggtgaagaggagacatatccccccacttcatttttttcttgcactcagatanttttctctctaattatggtgcgcggcgaggacacgggtcggtggtggtgttttgcttcataaaaaataccgcgctcgttctcttttggtgggggtgggttgcacttgctccgctcccgcaagggtgtatgctcgtttcttatttattgtgtattgatgtctccccnctccttattcntnattggtatattaatgattttactctttacactattttgggcggggtggtgtatcgacacaacaaaattgattttcgcgtctgggcgntattgtggtattagatgtaatatataccgctgttgcgcggtgtgtggtattacgcatgtctctccctac

SEQ ID NO: 92960 - protein, 114 aa, Zea mays
  misc_feature: Ceres CLONE 1581963
MHSTHLLLEEPIRMASILEPIRTSFFPGMNQYCGAGPPQVAARWNHSPPASRAGFVLPAVSIFPVVKPPLSPGGRPRKTLRPALFKVPPKKLGAPCIAFNTVLGPETPPGGGQQ

SEQ ID NO: 92961 - DNA, 966 bp, Zea mays
  misc_feature: Ceres CLONE 1581970
  misc_feature: Translation starting site: 152
  misc_feature (379)..(379): n is a, c, t, g, unknown, or other
  misc_feature (458)..(458): n is a, c, t, g, unknown, or other
  misc_feature (811)..(811): n is a, c, t, g, unknown, or other
  misc_feature (892)..(892): n is a, c, t, g, unknown, or other
ctccccgcggtggcggccgctctagaactagtggatcccccgggctgcaggaattcgtctcaccccctagaaaaatccagcaacagcagccgctacctccctttgtctagctgtctccctcacccggtccagtcctgcattgcattgcctcatgaggacccaaagaaacctccttcccctcctcctgctgctgtccgccgcgctgctcgccgtcgccgacgcgcaggagcgcaagaactacgtggttcatctcgagccgagggacgacgacggcggcggcgggtcggtggaggagtggcaccggtctttcttgccggaggccacgctggactcggcggcggatgacgggcccaggatcatccactcgtacagccacgtngctgacggggttcgccgccagcctcactgacgcggaggcgcagacgctgaggcgcaagggagggtgcttgcggctgtancccggaggagttcctgccgctggctaccaccactcgccgggcttcctcggcctccacatgggcaagcacagcttctggggccgatccgggtttcggccgcgcgtcgtgattgggctccctcgacaccggcatcctgcccaccccacccgtccttcggcgacgcggggatgccaccgccgcccaaagaagtggaagggcgcctgccagttcaggtccgtcgccccgcggcgggtgcagcaacaaagtcatcggcgcgcgcgccgttcgggagcgcggccatcaacgacacggcgcccgcccgtcgaacgacgcgggccacggcacgcaaactgccagcaccgcgggcgggaacntcgtgccagaacgcccggcgtgcggggcaacgcgcacgcaggggcgttccgggatggcgccgcacgcccccctgggccatntacatgtggtgcacgcggaagccggtgctccattcttgaaatcgtccccgggcctgaagcccgcgttcagggaa

SEQ ID NO: 92962 - DNA, 1059 bp, Zea mays
  misc_feature: Ceres CLONE 1581971
  misc_feature: Encodes the peptide sequence at SEQ ID NO. 92963
  misc_feature (844)..(844): n is a, c, t, g, unknown, or other
  misc_feature (1017)..(1017): n is a, c, t, g, unknown, or other
tccccgcggtggcggccgctctagaactagtggatcccccgggctgcatgaattcgtctcaccccctagaaaaatccagcaacagcagccgctacctccctttgtctatctgtctccctcacccggtgcagtcctgcattgcattgcctcatgaggacccaaagaaacctacttcccctcctcctgctgctgtccgccgcgctgctcgtcgtcgccgacgcgcaggagcgcaagaactacatggttcatctcgagccgagggacgacaaccgcggcagcaggtcggtggacgagtggcaccggtctttcttgccggacgccacgctggactcggcggcggatgacaggcccaggatcatccagtcgtacagccacgtgctgacggggttcacccccagacttactgactctgaggcgcagactctgaagcgcaaagaggggtgcttgcggctgtccccggaggacttcctgcctcctgctaccacccaatcgccgggcttcctcggcctccacatgggacagcaccgcttctggggcccgatccggggctccggccgctgcctcagtgatcgggactccttcaacaccggctatcctggcccccccgcccgggccttggggccaccacgggattgtcaccctcccgcccaagaactggtaaagggccgcctgcccagtttctgggtccgaccaggcaacagggcggggttgtaatcaaaatgggtcattccgcccccacctcatctttttgggaaagattgccctttttaacaaagggggttggacttcccagtggaaaaatacctgggtccaactggctcgcaaaactggggcgaaaccgtantgggggaggcgctttctgtgcagaaatatcccgcgggtgttgggggctataccctctcccgcctagggcctctatagaggaggggtcaccttcaactctcacctggggcatttccatagagttgggtcctccctataccccggtttctcccctctggaagaatttttcccggntcgagtcatccccctcccaagaaaaggtggatgaatactgtt

SEQ ID NO: 92963 - protein, 187 aa, Zea mays
  misc_feature: Ceres CLONE 1581971
  misc_feature (28)..(110): Pfam Name: Subtilisin_N Pfam Description: Subtilisin N-terminal Region
MRTQRNLLPLLLLLSAALLVVADAQERKNYMVHLEPRDDNRGSRSVDEWHRSFLPDATLDSAADDRPRIIQSYSHVLTGFTPRLTDSEAQTLKRKEGCLRLSPEDFLPPATTQSPGFLGLHMGQHRFWGPIRGSGRCLSDRDSFNTGYPGPPARALGPPRDCHPPAQELVKGRLPSFWVRPGNRAGL

SEQ ID NO: 92964 - DNA, 1065 bp, Zea mays
  misc_feature: Ceres CLONE 1581974
  misc_feature: Encodes the peptide sequence at SEQ ID NO. 92965
ggagctcaccgcggtggcggccgctctagaactagtggatcccccgggctgcaggaattcgtctcacccctagaaaaaggacaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgtgcatctccatgaatctggtgacgtaactcgtcggcgagctgcacctctccaactcctagtcccgccaccgtgttgacaaatttcttggggcacccttaaactggctcgcccttcgtggggcggtttcctccgccgaaccccaagctttgggcgctatcctaacaattggcaattcccggccaacaatcgcccccccaagggcggtgaagacttgcttaagcgggggaaaacaaaggtggcccaaaaaatagggttcccccccggggtgtgccttggaacccccccgtggtccccggcggccccaacaaatattttttcccgcgcccccggggggggaaaaatgggggccttttttttaaccacggccgtttaaaacaatgtggccgcggggggcgcccgggggctcaaagcgagaaaaaggtggcgggggtggggggggaaaaatattcaaagggggggccaaccctgggaaaaaaccccccgcgggttgtctttctaaaaaccttaatattctcgagaaaagggggagggccttttgatgccccccttgtggtgttttccagaataaaaagtgtggggggggtgggatgaaagttcctccccactttgggtagtcacacttcatgtggtgtgggagcccccaaataaatattccccaccgaggttgtctacttttgt

SEQ ID NO: 92965 - protein, 60 aa, Zea mays
  misc_feature: Ceres CLONE 1581974
MVSGAGHGGYGGGDDGQAVDFRGNPADKSRTGGWLGAGLILGTELAERVCVMCISMNLVT

SEQ ID NO: 92966 - DNA, 927 bp, Zea mays
  misc_feature: Ceres CLONE 1581978
  misc_feature: Translation starting site: 169
  misc_feature: Pfam Name: Mur_ligase_M Pfam Description: Mur ligase middle domain
  misc_feature: SWISSPROT Homolog: EC 6.3.2.17 Tetrahydrofolate synthase
  misc_feature (463)..(463): n is a, c, t, g, unknown, or other
  misc_feature (512)..(512): n is a, c, t, g, unknown, or other
  misc_feature (564)..(564): n is a, c, t, g, unknown, or other
ggagctccccgcggtggcggccgctctagaactagtggatcccccgggctgcaggaattcgtctcacccctagaaaaatctgtatcccgtggcaaggagcatctgcgcgtcacatccgcgatcgcgcgctctacgtcgcctcccgccgccgccgcacggccgcgacggatgctcggccaccgcttccctaccgccctccgcctcccacatggtctgctgctgaggaggagcatcatggcccgccgcggcctgaccatcatggccggtggcgaggcggagggtccgctcgcgggtttcttcgactacatggagcggctacgcaactacgagcgctcgggcgtgccgcgcggcgccggcaccgactccgacgacgggttcgacctcggacgcatgcgccggctcctccgccggctcggcgacccccacacccactttcccggctgtgcatatcgccggcaccaanggggaaaggttctactgctgcattcctgtccaatatcatgagggcccanggctacaatgtaggctgttattctagtccacatcttcctacaatacgtgaancggatttctgttggaaatgatggaggccccctgttcagtacgactggttgagtgatctttttgacgaggctaagaaagcccttgatgaaagcatagaatcggataatggatccctgacacaatttggagtttttactgctctctcatttcttctatctcccaacagaatgttgacattgcattcattgaaacaagtcttgggggagctagggatgcaacaaatgtattccgagtactgaattagcagcatctgtcataacaacggtagggagggaactctgggtgcattgggggctccctggaaagattccaatgccaaggctgaattctcaacagggcgaaccttgtggattgtggaccttt

SEQ ID NO: 92967 - DNA, 1042 bp, Zea mays
  misc_feature: Ceres CLONE 1581981
  misc_feature: Encodes the peptide sequence at SEQ ID NO. 92968
  misc_feature (921)..(921): n is a, c, t, g, unknown, or other
ctccccgcggtggcggccgctctagaactagtggatcccccgggctgcaggaattcgtctcacccctagaaaaggtcttccccatcccctcttccctttctagccttccacccttcatccacccgccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacagtacgaggacgaggcacacaaagcagttgaaagctcgatgggagattggtagacgggaagaaaatcctggtgcattttgccaagtccggccaaatggctgaacggtttataaggggggtatttggtagcccgtttccaaacccggggggggttcccgggagtcccctccaaaaagggggggcccggggtgttttttcgggagtgcccgtgttaaaattttttttagggggaatcccctccccggggtaaaataattaaacccccccttcacgggccgggggatagggtttttcccccctttgttccccggggcgcccccaaccccgccctgtggtatacaaaaacgggggggaaaaaaatttttctcccccaggaaaaaaaccccccccgtgtcccccccccctttgtattattaaaaaggggggggaaaaaaaacccccccccccagaaagaacccccctccccccccccccccaaagaaactcccttcttataaaatactcccggggagagaaaatattatacccccccgcgggccgcaccaaagaaaaantttttctaaatatattttggggaggagaagggtgggcccccctctagagggcgggggggggggggcgcccaccaaaggaggggggcctccttctccccacaaaaatatttgtgtgcggaat

SEQ ID NO: 92968 - protein, 98 aa, Zea mays
  misc_feature: Ceres CLONE 1581981
  misc_feature (19)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSRFGRSGPPPPIRDTYSLLVLNITFRTTADDLFPLFDKYGEIVDIYIPRDRRTGDSRGFAFVRYSTRTRHTKQLKARWEIGRREENPGAFCQVRPNG

SEQ ID NO: 92969 - DNA, 1333 bp, Zea mays
  misc_feature: Ceres CLONE 1581983
  misc_feature (69)..(69): n is a, c, t, g, unknown, or other
  misc_feature (1176)..(1176): n is a, c, t, g, unknown, or other
agcaacctgcttaacgcatccctgaaagagcaggttacaaaccgtctgagagacgacacatccacattnaactattgcaggggcgtccgtcttccaccagtggatcccccgggctgcttttttggtctcacccctagaaaaaacgagctcaaacacacatcaagaaagctttttagaaaagactgtagctagctagccaacgtgcgcgcgcacgattagtctagctagaatacactcgcgtccaaaacaaacacacagcgttcctgctgcgttgatctctgaccgcgtctacaactacctcaccacctagcagctgatgggggccacctttaccttcttgccttaacctcgtccccaccggggattcatctggccagcttatgatacctaacattagaggcacttgaccaatatcccttcctccgccttgttctttttccccgccaatattgacagccgccctctcggtaaaaaacccccgaaacgggaagcccccccccgtcttcataatatatggaaatttgacctccagctcttcaaccccagccctccgggcgaaaagaaggggggaatgcccctctctcatcagaaggactgggaggtccctctcgagaagctatctcaatttggacacgggtcgtgcgtttgacactccccttcctgtccgccattcctacctcttaagtaatatacctaacctcagaagtgggacaactctttacacccgtgtcccatcttcatgcaacatgcgcttgccaactggttaaaacggccaatgtatcccagctcatattcggcaccgctttctttttgcatagtgtacactccgcgaccggaaatgataactcttcttgtttgtacgccaagaggccgcagtgaattctctcatgcggcgcctcatatgcgagcgatgtagcgcttatgttgcgcacccgggcgccggtattccgttatagggccacacggcccgcctgacacatagacgtgccttctctcagtattttcgcctgcttggccctccggagttaatcgtataatcatacgtgtgttcttccccaactgacgtatataacacgcgccgtaaatcaattagcgcccatcacccaactacctattcgaatcgggaaacgaggtggttcgtgctatctcaccgccgctgtcatgaaagattcttanctcggactctttttctctccgacgtaacagttaccttacgtgtctatccttgtggcatacgactatttgtataattacccctccatacgtcgatagtgcgcgtgctgtacttgtgtttgtccctgacatcatttctaccctcatccgcgaaagtgcg

SEQ ID NO: 92970 - DNA, 1296 bp, Zea mays
  misc_feature: Ceres CLONE 1581985
  misc_feature: Encodes the peptide sequence at SEQ ID NO. 92971
  misc_feature (1128)..(1128): n is a, c, t, g, unknown, or other
tgttttttttttttccccctacctcctccccccgtccaaaccttcttttttctcttttttttttttattggaactccccgcggtggcggccgctctagaactagtggatcccccgggctgcatgaattcgtctcacccctagaaaaacactccagcgctgaaggcctgcagcgccagcgcagcgcctctctgctactgtgctggctgacgccggtggggtgtgagcgaactgcgagctgctgccacccctgctgccgcggtcgaccgccggccccggaccgagatggacgctcggtgggcggtgctgctcgcgctgctggtcgccagcggcggcgtccgtgtctgcgccgccgcttgggccaaaggcgccaactggctgggcgggctgagccccgcgtcgttccccatggggttcctgttcgggaacgccaactccgccgttaccatgtcaatggtttccccccccaccaaaggccgggggccccttccatctgggaacccttcgcccgcagttcccttgaaaatattttgcgggaaatcataatggttaaattttcattggaataaattcccccctctatacggaaaagaccctacctcctttaaaaaattcgaaacttttgagaggccaaaaggctttcccaatttcacaagtgacccactaattttttccccctcgaattgttctagagggaatattacaacttttccacaaatgcgttatgaccctaccttttacaacaccatttttgcaaaatattatcaccccactttctttttattacttttgaacacttaaccgtactctaccacccatacattctcacctccctgcaattccaccctatgtggataaatagttctcccccctttcttttgagaaccacgcctgctagacaaaaacactaccccttgtatctgtttgattcatctgttcgctcttctaatcgatatgtcgatgcgcttcttgttttcgcacactaccacatttggcttatcgactacctcctcctccgtcttatcgtaacccacttaacacattgtattatccgctatattaaatatagtcggcagtctatatttgtctctaaccaccttaccggatatagattacttattatctctacntcattccgagatattaccatagctcacgatagtccaattgacccaatcccattatatacctctcttatatactcccaccgtcttctccgtctataggctcctatatatatatttcagaataacacacattgtacctccctcatccgcgagagtactctttattttatt

SEQ ID NO: 92971 - protein, 86 aa, Zea mays
  misc_feature: Ceres CLONE 1581985
MDARWAVLLALLVASGGVRVCAAAWAKGANWLGGLSPASFPMGFLFGNANSAVTMSMVSPPTKGRGPLPSGNPSPAVPLKIFCGKS

SEQ ID NO: 92972 - DNA, 1070 bp, Zea mays
  misc_feature: Ceres CLONE 1581986
  misc_feature: Encodes the peptide sequence at SEQ ID NO. 92973
  misc_feature (1028)..(1028): n is a, c, t, g, unknown, or other
ctccccgcggtggcggccgctctagaactagtggatcccccgggctgcaggaattcgtctcacccctagaaaaacccgttggcttcggcggcgggcggccatcagcaaccagcatcgtacggaggagaagcgctgtttacacccgtctggcagggatgccgctggggcagcgttcgggggacaagagcgactcccgctactgcggggtggaggttctcgacttccccgccggggagggcctccctgccgtcctcaatcactccctcgcctccgccttcgacttcatcctcgcccctctggttgatccaactaccggccggcgcccggtcgcgttctgccagtgtcagcgtcggaactcgtcctcgggccgtcccagtggaccaacaccttcgtcgggaaaatcaccgatgggatggatttggaccccaaggaacaccgggtcccggttggactccaagctcccgctgaaacaaggaaatcgccttggggcctccacctttttcctgccggggatttgtttttcccccgccccccccgaaaaattttttttggcggatttttgtccaaaatggtgtgaaacaaaatttttggaagaggccggcccaaatttaaaatttttggggtttaagggtgccccctcgggagaatccccaaccccccgggtggggggggtctctcgccaaaacacaaaaaacaccacccccccccccctctctcgggttaaaatatcccacccccggggggaattttggggaacttctccacaaaggtggtagtggacacccttatgccaccattagggcggggggttttatattttgggggggacaccccgccataataactattgtttggttcctttttgtggagaacactaagatgttttctttttttaaaaacagatgtttttataataaaaaaaagaaaaatactctttttataaaagcctctacaattgtcccccaatttttttttttttcttcctccacgctttatttcgggagggaaaaatcaatatatcctcctcncccatgtgggcgcctctctcgagatgataaccatatattctt

SEQ ID NO: 92973 - protein, 206 aa, Zea mays
  misc_feature: Ceres CLONE 1581986
  misc_feature: SWISSPROT Homolog: EC 2.1.1.125 Histone-arginine N-methyltransferase
MPLGQRSGDKSDSRYCGVEVLDFPAGEGLPAVLNHSLASAFDFILAPLVDPTTGRRPVAFCQCQRRNSSSGRPSGPTPSSGKSPMGWIWTPRNTGSRLDSKLPLKQGNRLGASTFFLPGICFSPAPPEKFFLADFCPKWCETKFLEEAGPNLKFLGFKGAPSGESPTPRVGGVSRQNTKNTTPPPLSRVKISHPRGEFWGTSPQRW

SEQ ID NO: 92974 - DNA, 972 bp, Zea mays
  misc_feature: Ceres CLONE 1581989
  misc_feature: Encodes the peptide sequence at SEQ ID NO. 92975
  misc_feature (774)..(774): n is a, c, t, g, unknown, or other
ctccccgcggtggcggccgctctagaactagtggatcccccgggctgcaggaattcgtctcacccctagaaaaagcctcgtcgtcaaaaaatccccattcgttccccttctcgcctccacgagccttcacaaattgccctctcagatcttctcctaatcttactcaagccctagccaaatcccagacccatcccagccctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactccgcgctcgccaccgggaacctccagaagatgtccgagaccatggacaatttcgagcgccagttcgtcaacatggaggtccaggccgagttcatgggaggcgccatggccggctccaccctcctctccacgcccgagaccgaggtcaacagcctcatgcagcaggtcgcggacgactacgggctcgaggtctccgtcggtctgccgcagggcagcgcgcacgccatccctggcgcnaatggatagggagaagtcgacgaggatgacccttctcgccgcctcgcgagcttaaggcgccggctgagaggtggttcaggcttatcagatgcgatcatgcttatgctgttgagccgcaatgaccatgtgctgagaacgctacccagttgggaagatccgaaatacactgtttttgcttagagcgggggttgcaatgcc

SEQ ID NO: 92975 - protein, 184 aa, Zea mays
  misc_feature: Ceres CLONE 1581989
  misc_feature (9)..(179): Pfam Name: Snf7 Pfam Description: Snf7
MGNPEKLMNQIFDLKFTSKSLQRQARKCEKEEKEQKLKVKKAIEKGNMDGARIYAENAIRKRTEHMNYLRLASRLDAVVARLDTQAKMQVIGKSMQSIVKSLDSALATGNLQKMSETMDNFERQFVNMEVQAEFMGGAMAGSTLLSTPETEVNSLMQQVADDYGLEVSVGLPQGSAHAIPGANG

SEQ ID NO: 92976 - DNA, 1050 bp, Zea mays
  misc_feature: Ceres CLONE 1581991
  misc_feature: Encodes the peptide sequence at SEQ ID NO. 92977
ctccccgcggtggcggccgctctagaactagtggatcccccgggctgcaggaattcgtctcacccctagaaaaaatcctcccgccgcggcgacgccttcccctccctccttcctccgtcccatgctccgccgctgacacgttggcccgacttaaccttacgatggccgccgcctccgccatcaccgccgtctccggcgttgtgcttccccaaaccttcctatcccaccggtcgccgccgccgcaagtcctagccgtggcctcctcattccaccggctctccttgtgcgcttcccatcgccgaatcactcacataatcccccgcgctgatgcaagtgccgtagctggagtaacggagcctgtcactacttcagctgaatccaaaaaggagtggccgaggggtctgtccctgtggcggaggcggaagaaccgacgccgcccaacaaagccgaaggttaagttccggcgtataaattggggattctgaaataagcagttcccttgaagagggctgaaaaaagggaaaaaccggtacccgaaatcgaaggcccggggaaatatctttggaccttaagaaaggcaacggcccaacaaaaaggggaaatgggccccctttttaagggcataattcctcccaaaggcaaaaaaagggggggttcacacccacaaaccccggggacaaaaggatacattggcgggggggggaagagaatgaaaaattcccctccccgcgggtttcccccccccagaatataggaaaaaaacgggtgttttgggggaaaaaaaacaacctcgtgaacacaaagaggaattccttgtgaagaaaaccccgggtttttttaggggggcgccccgggggaaaaatttttttggggccccctcgtggggaaccccgccccaaataagaggcccctttggcccctttgtgtgtgttgtgggggcgggaggaaccctgccccaaaaaggggggaaaaaaaccccccctcccacccgcgttggttctcggccgggggcgccacaaaaaatgagggtgggtggggtaaaagtccccc

SEQ ID NO: 92977 - protein, 107 aa, Zea mays
  misc_feature: Ceres CLONE 1581991
MAAASAITAVSGVVLPQTFLSHRSPPPQVLAVASSFHRLSLCASHRRITHIIPRADASAVAGVTEPVTTSAESKKEWPRGLSLWRRRKNRRRPTKPKVKFRRINWGF

SEQ ID NO: 92978 - DNA, 947 bp, Zea mays
  misc_feature: Ceres CLONE 1581995
  misc_feature: Encodes the peptide sequence at SEQ ID NO. 92979
ctccccgcggtggcggccgctctagaactagtggatcccccgggctgcaggaattcgtctcacccctagaaaaaacttcctgttggtctcccgttgagcgcttctcctcctcctcctcacacccctcactttctgtcggcggcgactgggcggccggcgctgccgtcctacgccagctgcccaggtcttcctcgcgcccttcgccggaggcaaccacggccagggtaagccagccatcacccatggctttgaacgagagctccagcgacgaccggaccatgagcacgggatgcctgtgcatagtgattggcatgtgctgcttcttcacatcctcggggcgtggcacaagagcgggttcggcaagggggacagcatcgcgctgaaggtcaccaagcgcaccgactgcaccgtcatgccgaacctgagctacaacgaccaccattctaaagacaatggcaactctaacagccagggttctcagaccaacaagttcaagccgtacccagatctgctagccgactacagcccctgccaagaccaacacagggcgatgaacctaccaacggagaacatgcactacagagaacggcattgcccatgccataacgagaacctgcactgtttggttcacgcacaaacgctatgcgagctcgatgccagagacgaagagcgaggacatgtccctttacgcgattgcccatataggagctagacagtcgaaaatgcctccagaactggctcgatacgaagctaatgactgcagactccctggagcaggacgcatctcccgcgggagcatacaagtatatgataagaatgctcagacgttcgatgcaagtgaactgtcagacgcactgacactggatgcggtggtcagcggggagctactgttgacaaaatgcttggcatctcggtgcccttacatcccgagcacatgaaatagccgt

SEQ ID NO: 92979 - protein, 140 aa, Zea mays
  misc_feature: Ceres CLONE 1581995
MPVHSDWHVLLLHILGAWHKSGFGKGDSIALKVTKRTDCTVMPNLSYNDHHSKDNGNSNSQGSQTNKFKPYPDLLADYSPCQDQHRAMNLPTENMHYRERHCPCHNENLHCLVHAQTLCELDARDEERGHVPLRDCPYRS

SEQ ID NO: 92980 - DNA, 921 bp, Zea mays
  misc_feature: Ceres CLONE 1581996
  misc_feature: Encodes the peptide sequence at SEQ ID NO. 92981
  misc_feature (711)..(711): n is a, c, t, g, unknown, or other
  misc_feature (774)..(774): n is a, c, t, g, unknown, or other
  misc_feature (780)..(780): n is a, c, t, g, unknown, or other
  misc_feature (781)..(781): n is a, c, t, g, unknown, or other
gcggtggcggccgctctagaactagtggatcccccgggctgcaggaattcgtctcacccctagaaaaaaaggccacattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggaagctaaatcacaagaacattcgttgggctaccccaactcacaagcttcagatgcttcgcaattgatttctcaagcttcctttgatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgagaatgcatctttgctgaagcgactggctgatatgactcagaaatacagggacgcttccgttgacataaaaatnctacagttgatgttgagactatgaaggagaaaaggtcgttcgtcttgaatgcatcacagaccnttttcnntctttttttggtgtacgagaactcttactgcatccattttcgatcatacatttttacgggctctgtgtatctcacggtatcacgtttacatctctctgatgctgcaagggcatgaaagtatatgaatgttcatagtctat

SEQ ID NO: 92981 - protein, 192 aa, Zea mays
  misc_feature: Ceres CLONE 1581996
  misc_feature (121)..(181): Pfam Name: bZIP_1 Pfam Description: bZIP transcription factor
  misc_feature (185)..(185): Xaa is any aa, unknown, or other
MAGGGAGDDDVVVVSCGGRGGGDPGAYAAVLKRKLDLYCAAVAKSMEAKSQEHSLGYPNSQASDASQLISQASFDGDIDGASLVTNSNVIEDDDFQGKPTNSGTSKELSDDDGDLEENTDPANAKKMRRMVSNRESARRSRKRKQAHLTDLESQVSRLTSENASLLKRLADMTQKYRDASVDIKXLQLMLRL

SEQ ID NO: 92982 - DNA, 1131 bp, Zea mays
  misc_feature: Ceres CLONE 1581998
  misc_feature: Translation starting site: 177
  misc_feature: SWISSPROT Homolog: EC 3.6.3.14 H(+)-transporting two-sector ATPase
  misc_feature (201)..(201): n is a, c, t, g, unknown, or other
  misc_feature (475)..(475): n is a, c, t, g, unknown, or other
  misc_feature (477)..(477): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
  misc_feature (483)..(483): n is a, c, t, g, unknown, or other
  misc_feature (484)..(484): n is a, c, t, g, unknown, or other
  misc_feature (491)..(491): n is a, c, t, g, unknown, or other
  misc_feature (983)..(983): n is a, c, t, g, unknown, or other
  misc_feature (1053)..(1053): n is a, c, t, g, unknown, or other
acccgcggtggcggccgctctagaactagtggatcccccgggctgcaggaattcgtctcacccctagaaaagtcctcgcctcgcctatccgatctgccacctcgccgtctcgcacgttcctttccccaactccccagcgcctctccgcgccgcgatccagatccaggttgttcagcatgggtctggtgaaggaaggcgtcnacttggaggagggaaccctagagatcggcatggagtacaggactgtatctggtgtggccgggcctctggttatcttggataaagtaagggggcaaaggaccaagaaaaggttaacttccaattggaaaagggaccacccgccgtggtcaaggccttgaagtggatggagaaaaagttgtttccaacccctttaaaggaactttttgaaaacaaaaacacacacctgccattatagggaaggtggaaaaccccgtcccccaattgggcttgtggncnncnncnntggggtncccatacttggtctatcgttctaatcttcgcgaacgtgttccttgcgcatgttcctgtttgggaccgttgtacattcttttttttctcactccttttgttccgccttgttgacgtcgtctcttgttttatccattattctattcttttgttcttttttcccccatgttcccccccttttttgtacccttcttgctattttttgtttttctcgcagcgcttgttgtggttggttccgctaccagtgagacgtgttagtgtttcacaggtagcgcatattccattcttatcaaaaacagcgtaccgctctgttaccatgacctttctcctcttattgtgtattcttccggcccccttcattcacgttttgctcttactccctcctcagcttgtttcgcatatacccctgtttgacttgcttgcgccgagcgtttatgttgttgttgcccctccctatcttctttcctccacttgctcacatattttccagcgantactctgttatataatttgcacaatataaccgtccgtcgtttatgtgtgcacgtgtgttcatctgcagcnccacttagaaatgagcgtgcgtgaacttacttcttgtgcgctttgtgtgctccacactctgagggtgtgtgcatgtcg

SEQ ID NO: 92983 - DNA, 1044 bp, Zea mays
  misc_feature: Ceres CLONE 1581999
ccgcggtggcggccgctctagaactagtggatcccccgggctgcaggaattcgtctcacccctagaaaaagctactcaatttgatcaaccgccatccattctcctcctccgttgcagctgcggcatccatccagtagtcctaccaatccatgggttcagcgttcgggaccgcctcccactgccggattaaaaaagcccctgcctgcgtttagcttgcctgcgcccttgaaacacctttccctcgtctccccctcgcggggtttccctttccgcgccctaagaagcccccaagggaaatacactttccggggataagccctgctaaggaatttggttttttcccagggatgggttcggtttttcccggtaatgtgcaaaggggggcccccccacccccgggaaaatttttgttgggggttccccccgggaacaaaaggggggaaatgcgtggccccccaaaacaaaggatggggtccccccaaaaatgtgcatttcaacgggggtcctcttgggtgcaaagaaagttttacacttttgggccaccccccttgttaaaaaattttgggtcctaaaaacttcccccccctaaatttccctccgcaattaaatcccaataattcccccttgttgtttattgacaaaaaactctccttgctttttttcccgccgttcccacccattttttttctctcctcgcttttgtttaatagtctcgtcagtcttgccgtgcttttttacaatcggtggaaatataacccccgggggtgtttgttgtaacaatccccaaggcaccctgctgttaaggtgctccctttaaaatattctcgcctcattggcctttatcattactcctccccatttttatatatcactgttttcttttccggcggaaatttatttttcccgcgggttttacactccccccccctttataaatatgcgggtgtttgtgggacttccccccctcttattatcagagtgtctgcaaaatacaccctctttcccgtatataaaaaccttttttccccaattctttttcttctt

SEQ ID NO: 92984 - DNA, 1068 bp, Zea mays
  misc_feature: Ceres CLONE 1582000
  misc_feature (802)..(802): n is a, c, t, g, unknown, or other
ccgctctagaactagtggatcccccgggctgcaggaagtcgtctcacccctagaaaaaaactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaaatttctggtttctgggttggatctctcggagtccgagccagcgaggatgggcggccgcaacggtgaaacccccagcttgggggagccacctgctggggaaaaagcgaaaggcgtttccccctaagggccccggctgccgggggggaacgcctcaacgcggaacccggaggggggccttcccccccccaaggaccctcttcctcatccgggggccgtcccccttacctgggaaccctggccaatcccggcttttgtttcccccttcctggttttcctgggaaagagggattgtggcttttgtcttaaacaaaacccaaaaaactggggatttttttggctgggtttttggttgggcgcctctctatacatgtggggggggagggtggcgcccccctccacaccattgggggggaaatcccggggcggtaacaatgttcggcagaggaaaaacccgttttcttttttttgttcccccccttagttggagaaagaggttatcctccacaaatacagttgtttgggggagtgaagcccctaacattttttgcgcggggggcttttatcttccccccaagggcgttgcgttgaganaaaacgccgtgggcggtattcctcccggcgcccacctaaagggcgcttcctccctttgacttgtgtgccccgccaataaatataataacacccctctgtgtttcggcggcagttgcctttttctcacccatcgaggaagattatgtgttgcactattatgtgcccctggatgtttgcgggtttgccatctgccgcgcgggccgcgggaaataaatcctccagtgttgtctcctcttctacccccctccttcttgttgtggggttgg

SEQ ID NO: 92985 - DNA, 983 bp, Zea mays
  misc_feature: Ceres CLONE 1582007
  misc_feature: Encodes the peptide sequence at SEQ ID NO. 92986
  misc_feature (397)..(397): n is a, c, t, g, unknown, or other
  misc_feature (758)..(758): n is a, c, t, g, unknown, or other
  misc_feature (818)..(818): n is a, c, t, g, unknown, or other
ctccccgcggtggcggccgctctagaactagtggatcccccgggctgcaggaattcgtctcacccctagaaaaagcactcaaacccctcatccccatgagaccgcacgagttggagcaaggctcagtgcccgcctgcccccgcgtgccgtgcgatgccatggaggcgcgagtccctgggcgtcgtcacgtcctcactccttgtccgtctgcctgtcgccttgtctcgccttgcaggtcgtagacgacagacgagcagtagcagcagcagcagcacgaggcggccgggcccgggccacgccatgccggagaaggaggcgcaggccgccgcgttctgcggcgaggcggtgatcgccgagttcgagtccctcacgcgggacgccgccgccgtgcagcgcnacacgctgcgccggatcctggcagacaacgcctgcgccgagtacctccgctgccggggcctcgcgggccgcaccgacgccgccagcttccgcgcctgcgtgccgctcgccacgcacgccgacatcgagccctacattgcgcgcatcgccgacggcgacacgtcccccgtgctcacagccaagcccatcacctgcatctccctcagctcgggcacgacgcaggggaagcgcaagtacctgcccttcaaccaagagctcgtcaagtccacgatgcagatataccggacttcctacccctccaggaacggtgagtgagtgcacgcgcgcgcatatgcatgtcacactggcagatcatctttttnatggccttggcttggcctcaaaatggaccgggctttccctcgaaggacgtctcccctggnaggaacgaaaggcgcttcaatttatgttacggaggccggagtttcaccaccagggcgggctgaagcgaataagggcacccccaacttgttccgcaacggaaagatcattgcccactatgcgccccttccaatttcagggtgtcacccccgaaggggtgatcttcc

SEQ ID NO: 92986 - protein, 136 aa, Zea mays
  misc_feature: Ceres CLONE 1582007
  misc_feature (33)..(33): Xaa is any aa, unknown, or other
MPEKEAQAAAFCGEAVIAEFESLTRDAAAVQRXTLRRILADNACAEYLRCRGLAGRTDAASFRACVPLATHADIEPYIARIADGDTSPVLTAKPITCISLSSGTTQGKRKYLPFNQELVKSTMQIYRTSYPSRNGE

SEQ ID NO: 92987 - DNA, 1276 bp, Zea mays
  misc_feature: Ceres CLONE 1582010
  misc_feature: Encodes the peptide sequence at SEQ ID NO. 92988
ccttttattttcttttctcttgtagcgttccattctgatctcttttttttatttttgtttttaatatatgctggagctccccgcggtggcggccgctctagaactagtggatcccccgggctgcaggaattcgtctcacccctagaaaaaagtctgaaaccaccgcccagcgctcgcctgtttctgcggccgtctatggagctccacctcgccaccatcgcccaccgcccgcctttgccggtaccggcgcggggccaccacctcctccgccgcctccaccacctcccggctcctctctccttccaaaacacctactccccctccctttcctccccgcatcatcatcgcctttctgcgacccttcgccgccacctccgcctgcctcttctcgcctccctagcgcccaattctaacccggagcctgatcctgagcccgatccccctggtgcgaagctactgccccccctcatcttcatcgccatctgccttctccttgcggtttctcgcgcccgcggcccgttgaggttatcccggaagggttggcagctcctcccccatcttccctctccaaatacatgggggttggggcctgggaccctctcccctggcgggggcaaggggcctttcccccgggcctcaaaaagggcctgtttgcccattttttaaggctttccctgttataacctgccgggctttttccccccctcttttaccaaataaaaagggttttctatcggggctccctcctgtgctgaatctcaccttctctcattttcgtcccaagaaataggtgtgttattccttccacaaatataaaggtgggtcttcttggcggcaataattatatattcttatcgcatcccatctattttgttcttccgtaagattaggtgtcttcctccggaagaacacacaacactccccgtttagggggttgttctctctcacgcggggggtgtcttatcgccctcatgagaaggaggcgcccggctacctgtatccggtggcgataacacatatcccctatttaacccttttatcgacatattgccccacgatagagttgttttcccccccgcccctctcacacttttctttcctctctctctcgtgtcgggggttttacataaaggaggacataaaatgttccctatctccattatgaagattgggttggtctctccctttgtgggtcgaaacaacttaaccgtgtattgtcttgccacaccggtttttgtgttcttcttcctcgttggataaattacttaatggtggt

SEQ ID NO: 92988 - protein, 156 aa, Zea mays
  misc_feature: Ceres CLONE 1582010
MELHLATIAHRPPLPVPARGHHLLRRLHHLPAPLSFQNTYSPSLSSPHHHRLSATLRRHLRLPLLASLAPNSNPEPDPEPDPPGAKLLPPLIFIAICLLLAVSRARGPLRLSRKGWQLLPHLPSPNTWGLGPGTLSPGGGKGPFPRASKRACLPIF

SEQ ID NO: 92989 - DNA, 1192 bp, Zea mays
  misc_feature: Ceres CLONE 1582011
  misc_feature (59)..(59): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
tcgttgctgtttctccccctctcgcctgccccattccgctcgtctttcaccataatatntnnnttttactggggctccccgcggtggcggccgctctagaactagtggatcccccgggctgcaggaattcgtctcacccctagaaaaaactgttttttttttttgcatcgttggaagttgactggtggacgaactccgcgccgccgccgtcctggatgacgccgcacgcacgaggtgcaaacgaccgcgtccgagtccggatccgccaccaccgcgccctcgccacactacaggcacgtggagcccatcggcggtgagccggaggctggagcacgcgcggcggtggcggcagcggcagcgcttgcggcggaaggaagaaggaacggggtgggggattcgaatcgaaggagcagcggcgatctactgttcccttgtattatgcccgcaactttacttctcaacccaaagtatatgttgaagaatggcttggagctaacagactgacacccactttttggttatgatccgaagcgactggagtgcacgtaatgaatcctatttgtttgcaatttaaaggacccagtttccttcatttcaaatgggtttttcccctgttaccgaatttggtaggcccttgtaccaaagaggaaaataccccgcctaccagtaatggggggtcccggaaccattatggtcttcgggtatttaaggaatgctattattgggccagcaaagggttccttttcttgggttgaacacagagacaccccgggtgggcaccaaccaaaccccgcgggggtggccgaatagtggaaggccgtgtttcctgaatttgtaataggaggtcagtgtgttcacttgctcaaatatatttcccaccatccgcgaaagaagattgtgtccaatggccctataaaggtataagtgtttacctctcctcttgtgtgagaactcgcggaaaagcccccctggctttatcccggagcgccaccctcgtttattaaaccagaaccatttttataggagaatctggctttccatttgacacaattggccctgtctctgcagccattaatctttcttcccccaccctttatagtggtggtttccccgcgaaaccacagggaaagtctcggtgtaacatttggggacagggattacaatatatctcttcgtgggtgacagctgtctt

SEQ ID NO: 92990 - DNA, 958 bp, Zea mays
  misc_feature: Ceres CLONE 1582017
  misc_feature: Encodes the peptide sequence at SEQ ID NO. 92991
ctccccgcggtggcggccgctctagaactagtggatcccccgggctgcaggaattcgtctcacccctagaaaaaagccgggtcgagaggtggggagcagagggttcaagggaggggacaggtcgagcagctcacctttctctgctcgagaacgagaggagctctcgtcttttgctttgctgtgccgggcgctgctgaaggttcagctcagtccgatggcgttgagcggcagagctctgctcttgttcgagctgctgctgctgctggcgtgcctcctcttcctcttggagctgtcccaaggcaaggaagaagcattcagcctgaaggacctcccgcccttccacaaggccagcagctaccccgcgggggtgccgacgacgtacgactacatcatcgtcggcggcgggcacgcggggtgcccgctggcggcgacgctgtcgcacaaggacaaggtgctgctgctggaacccggaagctccccgtaacgggaccgcaacgtctcctaatggcggaacttcccaatcgggtgatgaaacttgggcccggaatcccccttccaaggcctttattttcccccgaaggggtttttaattcccgggaaaagggttttgggccgggggacccctatataatggggggttttataagcgggggccaccccaaatttttttcaagaaggcgcgggggggaaaaaaaacccggggaaaaaaacaacccccggggggaagagaaaaaatttgtccgggggccaaaaaacccccctttggggggggcgccccgggggggggcgccccaaagggggggcccccctctgtggggaccccaaaatatttttttaaaaaaagggggggggcccctttttaaaaggaggggggcccccccccgcgccgtctttttttggggggggagcacccaagagggcgcgcccccccgctggaaaaaaattgttgtgcccacca

SEQ ID NO: 92991 - protein, 89 aa, Zea mays
  misc_feature: Ceres CLONE 1582017
  misc_feature: SWISSPROT Homolog: EC 4.1.2.10 Mandelonitrile lyase
MALSGRALLLFELLLLLACLLFLLELSQGKEEAFSLKDLPPFHKASSYPAGVPTTYDYIIVGGGHAGCPLAATLSHKDKVLLLEPGSSP

SEQ ID NO: 92992 - DNA, 920 bp, Zea mays
  misc_feature: Ceres CLONE 1582019
  misc_feature: Encodes the peptide sequence at SEQ ID NO. 92993
  misc_feature (745)..(745): n is a, c, t, g, unknown, or other
  misc_feature (785)..(785): n is a, c, t, g, unknown, or other
  misc_feature (792)..(792): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (816)..(816): n is a, c, t, g, unknown, or other
  misc_feature (819)..(819): n is a, c, t, g, unknown, or other
ggagctccccgcggtggcggccgctctagaactagtggatcccccgggctgcaggaattcgtctcacccctagaaaaacctcccctgccgtgccgtgctctctcaacaagggagaaggggaaaccaccaccaccaccaccaccaccaccaccacacctgataagaagggggccttcccgctcccgccgctacgccatggacgcctgggaggccaccaaggcggtgttcgaccgggtgcgggcactggacccggacaacgcgtccaagatcatgggcctgctactcatccaggacaacagcgacaaggagctcatccgcctcgccttcggccccgaccacctcctccacgccttcgtctccgccgcgcgcgccgacctcgccgccaagcccgcgtccccgccgtcgcccgtgctgggcccgctccaccagacctggggagcgccgacgcacccgagccctaccgccggctccgaccacccacaccaggcccccttcgccgccgacctcgcgctcggctacgacttcgacggcgccggcgccggcgctgacgcgttcttccccgacgactacgactgctggtcaccggccggcgccgcccaccgccgcagcttctcgctcagtgacgccgaggccgccgccgccaccggaagcgtcgcgtggaggccatgcatgtacttcgcgcgcgggttctgcaagaacggctcctcctgccgcttccctcacagctttccggaggacgatgacnccgctgcggagcccgagatggtcgtcatgcgcgcaaaggnccttggncgcgnnncgcgcgcgcgccccagnagnagagcagctcatggcgtccgcgtttccctttctcgcgtcgccgcccaaaggcgtcaaactcactttctgcctcacagagaacaagccgcaagggcggcggg

SEQ ID NO: 92993 - protein, 241 aa, Zea mays
  misc_feature: Ceres CLONE 1582019
  misc_feature (184)..(184): Xaa is any aa, unknown, or other
  misc_feature (197)..(197): Xaa is any aa, unknown, or other
  misc_feature (201)..(201): Xaa is any aa, unknown, or other
  misc_feature (202)..(202): Xaa is any aa, unknown, or other
  misc_feature (207)..(207): Xaa is any aa, unknown, or other
  misc_feature (208)..(208): Xaa is any aa, unknown, or other
MDAWEATKAVFDRVRALDPDNASKIMGLLLIQDNSDKELIRLAFGPDHLLHAFVSAARADLAAKPASPPSPVLGPLHQTWGAPTHPSPTAGSDHPHQAPFAADLALGYDFDGAGAGADAFFPDDYDCWSPAGAAHRRSFSLSDAEAAAATGSVAWRPCMYFARGFCKNGSSCRFPHSFPEDDDXAAEPEMVVMRAKXLGRXXRARPXXRAAHGVRVSLSRVAAQRRQTHFLPHREQAARAA

SEQ ID NO: 92994 - DNA, 952 bp, Zea mays
  misc_feature: Ceres CLONE 1582024
  misc_feature: Encodes the peptide sequence at SEQ ID NO. 92995
  misc_feature (417)..(417): n is a, c, t, g, unknown, or other
ctccccgcggtggcggccgctctagaactagtggatcccccgggctgcaggaattcgtctcacccctagaaaaaacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgatacttcctaccatgtgatcagttgtagctgggtgattttgcaagactcaattctctcatctgagttcagaaacgttttgctggtctcctgcnttcccctgagtcttgccaaccataagtttctctcatctcctttctgggacttgaccaacatcccctttgggtcttggcaagtctcccaatactcccttcccaaagacttggcctaaagggtgggatggccctggcttctttgctggggcctgcaaacttgctagaaacctttaaattgccggcgattctggggcccaccccttttgaaaagcggcccctctcccgcccccggcggtggtggatttttggaaacaaaatttttctttggcgttggaacacagaatttttcttcttcgggggaaaaaagggaaccccccagaaaattttccccttttcccacaaaaaatcttctctttttttccaaaagaaaaaaagggttttttggggggggggggaaaaaaacccccccccgcggtttttttttcccccccacaaggggggggggcccttccccccctctttaaaaaaaaaaactgggaaaaaaaaattcgggggggtcttaaaaaagtgtggtttttatttctccccccgcgga

SEQ ID NO: 92995 - protein, 29 aa, Zea mays
  misc_feature: Ceres CLONE 1582024
MSAEVAGGHPYFLSCYFWFIYCIKFRDFT

SEQ ID NO: 92996 - DNA, 932 bp, Zea mays
  misc_feature: Ceres CLONE 1582025
  misc_feature: Encodes the peptide sequence at SEQ ID NO. 92997
  misc_feature (843)..(843): n is a, c, t, g, unknown, or other
ctccccgcggtggcggccgctctagaactagtggatcccccgggctgcaggaattcgtctcacccctagaaaaagtgctctaatcaaaaatcaaacaaaccagaagctcctcctcgcctcccatcacttcctacgccacccgcgaagcgcgcccgaggcggcaccccaccgtcgtagtagaagacacgggacgcacccccgcagcctcgctcgctcgctcccctcacttcctccccgcgcgatccacggcccccgccccccgcgctcctgtctgctctccctctccgcaatggcgacgccctcggccgtgggcgccgcgtgcctcctcctcgcgcgggccgcctggccggccgccgtcggcgaccgggcgcgcccgcggcggctccagcgcgtgctgcgccgccggtgcgtcgcggagctgagcagggagggccccgcgccgcgcccgctgccacccgcgctgctggcgcccccgctcgtgcccggcttcctcgcgccgccggccgagcccacgggtgagccggcatcgacgccgccgcccgtgcccgacgccggcctgggggtcctcggtctcgaacctgaagggattgctgaaggttccatcgataacacagtagttgtggcaagtgagcaagattccggagattgtggttggaaaggagcaagctcgagctaaagtaacacaaaacattgtcttttgaactggggaagcttctcccttagcaaagttttggggggctaaggataatgtttgggggtacattgccagttggccctgggtgctcgggggtaccctggggaagggttggaaaggcccaataattttaaccggggccccccganatagatatatggcaaaaggcgttgttacacaaaaaaaaacacttccgaatttctacgcttttgggccggggaaacagaaatattcctct

SEQ ID NO: 92997 - protein, 128 aa, Zea mays
  misc_feature: Ceres CLONE 1582025
  misc_feature: SWISSPROT Homolog: EC 2.4.1.21 Starch synthase
MATPSAVGAACLLLARAAWPAAVGDRARPRRLQRVLRRRCVAELSREGPAPRPLPPALLAPPLVPGFLAPPAEPTGEPASTPPPVPDAGLGVLGLEPEGIAEGSIDNTVVVASEQDSGDCGWKGASSS

SEQ ID NO: 92998 - DNA, 1038 bp, Zea mays
  misc_feature: Ceres CLONE 1582028
  misc_feature: Encodes the peptide sequence at SEQ ID NO. 92999
  misc_feature (309)..(309): n is a, c, t, g, unknown, or other
ggagctccccgcggtggcggccgctctagaacttgtggatcccccgggctgcaggaattcgtctcacccctagaaaaagcttcccaatctccaaacctctcacttgcacgggacgggagcacgtacacgcggagccaaagcgatcggcgctgcggcggcaagacgtcgtcgtcggcgacgatgacgtggcacgaggacctggccactcacgtggggaacacgggcgttcgcctccccggcgccggaggtcacgcgccggcggcggcgaatgttgctgcggcggggccgggtggtacggggaggatgaanagggtaggccgaatatgggccctttcccttctcttggttcctttgggctgtggggggtttcttcttgttttttttttcccccccaccttacgttcttggtgcttacttctcccccctatttgctttgtctgttcccctcttgcccttgtttctggcgcggtgctgttggctctcctttattgttgtttgagtccgttcctcccgcacgtttcgcgcgtgtcttagttgttccccccccgtgtcttttcctcccctctttgcttcgtgcgctgttctgtttatccttactggctaccgttgttttttccccccgtgtttcagcctccgttccttttttgttgcttccctccgttttgtctcgtttgccccgaggagattgcgcgtgcttattaatcggtgcatttttgtccctgccggtctgtgcacccggtgtgatggctcttacggtttaactttccgcagcgttgtgcccgccttttgctactctctcgtttacatgtgtcttattgtcacgctccttttatttgacccactcctgtgttcttcgtggagcacctcactctgtcggtcgtggtgcttcgacttccttcttgtatcgttgcctgattatttctctggtttgtttcctcatgtatatctctctcgcactgcttattttatactcacgctcttatctatctgcgccgtctatgcccagtccgtattgtatgcctattgctcaggtcattt

SEQ ID NO: 92999 - protein, 117 aa, Zea mays
  misc_feature: Ceres CLONE 1582028
  misc_feature (43)..(43): Xaa is any aa, unknown, or other
MTWHEDLATHVGNTGVRLPGAGGHAPAAANVAAAGPGGTGRMXRVGRIWALSLLLVPLGCGGFLLVFFFPPTLRSWCLLLPPICFVCSPLALVSGAVLLALLYCCLSPFLPHVSRVS

SEQ ID NO: 93000 - DNA, 924 bp, Zea mays
  misc_feature: Ceres CLONE 1582031
  misc_feature: Encodes the peptide sequence at SEQ ID NO. 93001
tggcggccgctctagaactagtggatcccccgggctgcaggaattcgtctcacccctagaaaaaatcccagcacgtctcgtctcccggccctcccacaaaaaaaaactgctcggttgctgctcctgctccgccgcgccggcatcatgtgtggcatcttagccgtgctcggttgctccgactggtctcaggcaaagagggctcgcatcctcgcctgctccagaaggttgaagcacaggggccccgactggtcgggcctttaccagcacgagggcaacttcctggcgcagcagcggctcgccgtcgtctccccgctgtccggcgaccagccgctgttcaacgaggaccgcaccgtcgtggtggtggccaatggagagatctacaaccacaagaacgtccggaagcagttcaccggcacacacaacttcagcacgggcagtgactgcgaggtcatcatgcccctgtacaaaaagtacggcaagaactttcgtggacatgctgggacggggtgtttccgtttctggctctaacaaaaccccgcaacagggacctactttggggggccgcgacgcccattggggttcaaccccctcctaaattgggctggggggaatgaacgggttcccttctgggatccctttccaaaaaagaagggggccgaaacaaggaaatgcgtggcgccttcaagattttccccgccgggggcaaccttttattcaaacccccgggggggggggtttcgggcggggggtaccccccccactggtttccaagaaaccgggggcccccgaaagccttaacacccgctcgtcctcaaaaaagccttccaaaagggggcatcaaaaggctttgaagaacttcccgttcggggtcctcctctccgggggcccaaatcccctgaagtcgccccgtacacaaggcccctt

SEQ ID NO: 93001 - protein, 127 aa, Zea mays
  misc_feature: Ceres CLONE 1582031
  misc_feature (2)..(128): Pfam Name: GATase_2 Pfam Description: Glutamine amidotransferases class-II
  misc_feature: SWISSPROT Homolog: EC 6.3.5.4 Asparagine synthase (glutamine-hydrolyzing)
MCGILAVLGCSDWSQAKRARILACSRRLKHRGPDWSGLYQHEGNFLAQQRLAVVSPLSGDQPLFNEDRTVVVVANGEIYNHKNVRKQFTGTHNFSTGSDCEVIMPLYKKYGKNFRGHAGTGCFRFWL

SEQ ID NO: 93002 - DNA, 887 bp, Zea mays
  misc_feature: Ceres CLONE 1582033
  misc_feature (367)..(367): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
  misc_feature (838)..(838): n is a, c, t, g, unknown, or other
  misc_feature (839)..(839): n is a, c, t, g, unknown, or other
  misc_feature (840)..(840): n is a, c, t, g, unknown, or other
  misc_feature (841)..(841): n is a, c, t, g, unknown, or other
  misc_feature (842)..(842): n is a, c, t, g, unknown, or other
  misc_feature (843)..(843): n is a, c, t, g, unknown, or other
  misc_feature (844)..(844): n is a, c, t, g, unknown, or other
  misc_feature (845)..(845): n is a, c, t, g, unknown, or other
  misc_feature (846)..(846): n is a, c, t, g, unknown, or other
  misc_feature (847)..(847): n is a, c, t, g, unknown, or other
  misc_feature (848)..(848): n is a, c, t, g, unknown, or other
  misc_feature (849)..(849): n is a, c, t, g, unknown, or other
  misc_feature (850)..(850): n is a, c, t, g, unknown, or other
  misc_feature (851)..(851): n is a, c, t, g, unknown, or other
  misc_feature (852)..(852): n is a, c, t, g, unknown, or other
  misc_feature (853)..(853): n is a, c, t, g, unknown, or other
  misc_feature (854)..(854): n is a, c, t, g, unknown, or other
  misc_feature (855)..(855): n is a, c, t, g, unknown, or other
  misc_feature (856)..(856): n is a, c, t, g, unknown, or other
  misc_feature (857)..(857): n is a, c, t, g, unknown, or other
  misc_feature (858)..(858): n is a, c, t, g, unknown, or other
  misc_feature (859)..(859): n is a, c, t, g, unknown, or other
  misc_feature (860)..(860): n is a, c, t, g, unknown, or other
  misc_feature (861)..(861): n is a, c, t, g, unknown, or other
  misc_feature (862)..(862): n is a, c, t, g, unknown, or other
  misc_feature (863)..(863): n is a, c, t, g, unknown, or other
  misc_feature (864)..(864): n is a, c, t, g, unknown, or other
  misc_feature (865)..(865): n is a, c, t, g, unknown, or other
  misc_feature (866)..(866): n is a, c, t, g, unknown, or other
  misc_feature (867)..(867): n is a, c, t, g, unknown, or other
  misc_feature (868)..(868): n is a, c, t, g, unknown, or other
  misc_feature (869)..(869): n is a, c, t, g, unknown, or other
  misc_feature (870)..(870): n is a, c, t, g, unknown, or other
  misc_feature (871)..(871): n is a, c, t, g, unknown, or other
  misc_feature (872)..(872): n is a, c, t, g, unknown, or other
  misc_feature (873)..(873): n is a, c, t, g, unknown, or other
  misc_feature (874)..(874): n is a, c, t, g, unknown, or other
  misc_feature (875)..(875): n is a, c, t, g, unknown, or other
  misc_feature (876)..(876): n is a, c, t, g, unknown, or other
  misc_feature (877)..(877): n is a, c, t, g, unknown, or other
  misc_feature (878)..(878): n is a, c, t, g, unknown, or other
  misc_feature (879)..(879): n is a, c, t, g, unknown, or other
  misc_feature (880)..(880): n is a, c, t, g, unknown, or other
  misc_feature (881)..(881): n is a, c, t, g, unknown, or other
  misc_feature (882)..(882): n is a, c, t, g, unknown, or other
  misc_feature (883)..(883): n is a, c, t, g, unknown, or other
  misc_feature (884)..(884): n is a, c, t, g, unknown, or other
  misc_feature (885)..(885): n is a, c, t, g, unknown, or other
  misc_feature (886)..(886): n is a, c, t, g, unknown, or other
ctccccgcggtggcggccgctctagaactagtggatcccccgggctgcaggaattcgtctcacccctagaaaaaaccccggtcggctagtcccaaggctgctgccgccgcctgccgctaggggatcgcttgctttcctcggaccactctgccgaccacatctacaccgcatcaacggtccttccaagtgagctccaatcccctgtctgtagatggagagggtgctaaaggatgacgccgtcgaggagaagggcgagcgcgccaggatggtaagactgccgtctctctgatccgcgcggtttctttgtccggttaggtttcgttgtttcgtcttgcggctcttccccatcttaattgatggggtgatnctgtgggaattatcaaaccagaaagcatagtggcgctggcgcctagtcttccgaggaatattttggttgatgttctctgcgggtgctttgctgccgcacaagtgtttcactacttctccagcttgcgcgcttaatttcagcgagtgtttcaaaatgggtatggttccgtgcttgggtgtcccatcccatgtgctggtaagcatcggttaaatccatgatactcatttgggaagtcttaacggctttagttttattttatttactggctgatgatttttactgaaaagaaatttaggtgagcggcaaaggaatacactgatatgatttgcacttgaggcttctaattgaatacatgcgtggagaggatcacagcgaatgcattttgatctgtggactctatgaattatctgaatggaggcagggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 93003 - DNA, 869 bp, Zea mays
  misc_feature: Ceres CLONE 1582039
  misc_feature: Encodes the peptide sequence at SEQ ID NO. 93004
ctccccgcggtggcggccgctctagaactagtggatcccccgggctgcaggaattcgtctcacccctagaaaaaaagtctccctctcctcaaaatccccacaaaccgctctctccctctcgcctcccgcccctaattcccatcccccacctccaaatcccacatcactcaaaaccctcgccgcgcccctgctgcgcgcccccccgatggcagccgtcgcgtcctcggaggaggccgtcaaggcggcgaaggtgctgatggtcggagcgggtggcatcggctgtgagctgctcaagacgctcgctctctccggattcagcgacatacacatcattgatttggatacaattgaagttagcaatctgaatagacagtttttgtttcgacagagccatgttgggcaatcaaaagctaaagttgctcgggatgccgtgttgaaatttaggccaaatatcaatataacaccataccatgcgaacgtgaaggattctcatttcaatgttgattttttcaagcagtttaatgttgttctgaatggtcttgataacttggatgctagacgccatgttaatcgcctttgccttgctgctgaagtcctttggttgaaagtggtactactggtttttttgggaaggttactggtcatgtcaagggtaaaactgagtgctatgagtgtcaacaaagcccgtccctaaatcatatcctgtctgcacattacaagcacacatcaaagtttgggtcatgcatcgtttgggcgaaagactactttttgcaagctattggtgataaaaccagtaaatgatcctaatgtgcactcaaagatgaaccagtcaaaaacgagtttttgaaggaggtggaagaaaaacttgg

SEQ ID NO: 93004 - protein, 162 aa, Zea mays
  misc_feature: Ceres CLONE 1582039
  misc_feature (12)..(147): Pfam Name: ThiF Pfam Description: ThiF family
MAAVASSEEAVKAAKVLMVGAGGIGCELLKTLALSGFSDIHIIDLDTIEVSNLNRQFLFRQSHVGQSKAKVARDAVLKFRPNINITPYHANVKDSHFNVDFFKQFNVVLNGLDNLDARRHVNRLCLAAEVLWLKVVLLVFLGRLLVMSRVKLSAMSVNKARP

SEQ ID NO: 93005 - DNA, 1319 bp, Zea mays
  misc_feature: Ceres CLONE 1582040
  misc_feature (281)..(281): n is a, c, t, g, unknown, or other
cttgtcttcttccatctttctcctcctcccctttttttcctcctctttttccaaaaatttttttttgtgattccccgcggtggcggccgctctagaactagtggatcccccgggctgcaggagattcgtctcacccctagaaaaaagccgggtcgagaggtggggagcatagggttcaagggaggggacaggtcgagcagctcacctttctctgctcgagaacgagaggagctctcgtcttttgctttgctgtgccgggcgctgctgaaggttcagctcantccgatggcgttgagcggcatagctctgctccttgttcgagctgctgctggtgcttggcttgcctcctcttcctcttggagctttcccaaggtaggaaaaaacaattcggcctgaggaaaccccccgccccttccccaagggcatgttttttcccccccggggtgccccaataacttttaaacccccttcttccttgggcggggggtaccctgcggggtggcccccttggggggcgaaaaccttttccaaaaaaggtaacaaggttgctttctgcctgtaaaccccgaaatattcccccctttacgggaaacccgccaaccttctccccaaattggtaaaaattttcccaccacccgggctatattaataaatgggggggccgggaaatctccccctttttaataggcgcttttttaccttcccccagatagggggtttttcttatatttccccccggcggtaaaaggctatattatggcccttgtttgtaaaccaccctaatattattttccgcgttttttccttcaaattacggcgggcacacacccactacatattttttttttctcccaataaatagtcccgcccccgccggtaaaataaaaaaatacccgtcggggtgaataaaaaattacatcccccccatttgcggggatgagagaaacataatatattgttccacgcggaggttcgacattaaaaatcgcctcccctcccctcggtgaagtgtttcctacccctacgagggggtggtcctcacttaatgaagagagggggtgatttcccctccttttttgtgtgatgctcccctacacaactaatatcactctgtaaaaaacagagaatgggggagtgctactacttctctcatcatagagtgtggtgagcgccccgccactcattgatgctctctttttctataagcgagtaggagatcatcccatactttctgtttcccacctctcttagaggtggtccaataaatttatattgttcgcctctcgcggttgtctatatcgagcgaaaccatatctctt

SEQ ID NO: 93006 - DNA, 972 bp, Zea mays
  misc_feature: Ceres CLONE 1582041
  misc_feature: Encodes the peptide sequence at SEQ ID NO. 93007
  misc_feature (378)..(378): n is a, c, t, g, unknown, or other
  misc_feature (387)..(387): n is a, c, t, g, unknown, or other
  misc_feature (390)..(390): n is a, c, t, g, unknown, or other
  misc_feature (391)..(391): n is a, c, t, g, unknown, or other
ctccccgcggtggcggccgctctagaactagtggatcccccgggctgcaggaattcgtctcacccctagaaaaagagccacagccaaatgatactctttggttagccagccgaaattctctagcctggcagcagccatgggagaagcacaagactactacgacacctccacggctctggccgccgccgccgccgccgccgccggcctcgcgctgctcgcggtctgctcgtactacctgctcgtcgggcggcgccgcatcggcggcggcggcggcaaggcgccgaagcggtacgcgccggtggtgggggacggtgttccaccagctgtaccacgtccggcggctgcacgactaccacacggtacctgttccgggagcgncagaccttncannctgctgtgcctgccggcccggacgcagatatacacgtgcgtaccccgccgtgggtcgaacacatcctcagggacaacttcggcaaactacgggaaggggaacctccacctccaaaacctgaccgaactgctcggggaacggtattcttcccggtgaacgggcaacaattggaggccacccccggaaaaatcccaagtttaaatttccccaaaaagggcctgggcggaatttaaaggggtcgggtttttaaaaaaaaacccccgagggtcccgcgggatttttcccccgaaaaggggcgctccggggccccccctggaatttcgggggccccccccctggggggaccagggaattccttttttcacaccccctttgggggagaaaaaaaaacccgggggggcccccaaaaaggaaaacccccctcccccggggttttaaaaacccagaggaaaccccccccccccataaaaaaaacctttgaaaaaaaaaaatattctcccggggggcccgcgggcgcccaaaaaaaggggaggaggggcccaaaatttttttaacacccccccgaaaaaacgactctcccc

SEQ ID NO: 93007 - protein, 136 aa, Zea mays
  misc_feature: Ceres CLONE 1582041
  misc_feature (81)..(81): Xaa is any aa, unknown, or other
  misc_feature (84)..(84): Xaa is any aa, unknown, or other
  misc_feature (85)..(85): Xaa is any aa, unknown, or other
MGEAQDYYDTSTALAAAAAAAAGLALLAVCSYYLLVGRRRIGGGGGKAPKRYAPVVGDGVPPAVPRPAAARLPHGTCSGSXRPXXLLCLPARTQIYTCVPRRGSNTSSGTTSANYGKGNLHLQNLTELLGERYSSR

SEQ ID NO: 93008 - DNA, 914 bp, Zea mays
  misc_feature: Ceres CLONE 1582042
  misc_feature (337)..(337): n is a, c, t, g, unknown, or other
  misc_feature (338)..(338): n is a, c, t, g, unknown, or other
  misc_feature (485)..(485): n is a, c, t, g, unknown, or other
ctccccgcggtggcggccgctctagaactagtggatcccccgggctgcaggaattcgtctcacccctagaaaaaaaccaccaaaatgtaagaacacacgcccggcgctgtgacgcctacgctactagtcagtactcagtacagtagtcacccccaaagctccgcctacgcacctcttcccactcgcccggccgcggctatggcggccaccacgtccacaacgccggccgtctccttctccctcccctcgcccccgcaccgccaaggggccccgcgccgccgcgcgcctttccctcctcgtgccgcctccaccgcggcgcccccctcccccgaactcnntcatcagctctcgccccgcgcgtccccgcccgcgtcgactatctgcgccgccaccgcgcttgggacgccccgtggccgcctccttcgcccgtgacgcggcgaagaactgcagggcgatgcccgcgcccatggcccgcgccgccgggnccacattttaaagcccgagttcctcgcctcccgataaggtcccgccctttaagggtgggccccggcaacggaagggctttccaacgtggccctttcggggggaatgccccgctgaaaaacggaaagggaaccccccccgaaaagaaacccccaaaaacgggggatttccaaaatcctccaaaaaggggccacacttgaaaaatggggggggggtgcccccaccccccccctctccccgggaagaaccccgggaactccccaaacgcgaaattcccccccctttccggagaaaaaatcttctttttataaaaaaaggggtcccccccttttaatcacccaggaatttccccccccccccccccccctttttggggtttttttaaaaaaaaaataaactgggggggggggggggggggaggaacaccccct

SEQ ID NO: 93009 - DNA, 898 bp, Zea mays
  misc_feature: Ceres CLONE 1582045
  misc_feature: Encodes the peptide sequence at SEQ ID NO. 93010
ctcaccgcggtggcggccgctctagaactagtggatcccccgggctgcaggaattcgtctcacccctagaaaaaagtatcgcctttgcccgcacacacggctcccattccatttccgctgcttgacgcgcacccacaccaccacagcacgcgacgcgagaccgaatccttccgtccgacgccgcctcgcctccctcagccctccgcagctcggcctctgcttgcgttgcgttgcgttgcgtgtgtatgtagtggccgcaacacaaaatcaagagacgtgatatatgcgacccccaacagccaacgaccggcctccaagcggtgggggtggagcagcagcagctggtgcagcagcaggggacgacgacttcgccttctactactcctacctccaggacgccgacgccgccgccgcctcagcgacgtcgacgctcgccctcgccgtcgacgaccccaaccccagcgccgcagggatgacgaacggccggcgccggaagcagcgcgggggagaggacgccggagccgcccaggaaaggtgagggaggcggccagaaagacggcaagaagcggttccatcgcaaagctgctcacctcgctggcgggccttggaagcggaagaacaccccaaccggcgcggggcgcccgggacccgtccaaggcgggaagctggggcttgctccaattcaaaaccctaaccccgcttcggggggcccctttgggactaattcccccaaaaggggaaagaagtttcaaacacccccgcccatttccaaggcccgccgccggggccaagggcttccaggttttcccccggttgggccccaccccctgggcccttctgtggccggggaaagaaaggttctttggggggggggtccccccccccggggtgggtctct

SEQ ID NO: 93010 - protein, 84 aa, Zea mays
  misc_feature: Ceres CLONE 1582045
MRPPTANDRPPSGGGGAAAAGAAAGDDDFAFYYSYLQDADAAAASATSTLALAVDDPNPSAAGMTNGRRRKQRGGEDAGAAQER

SEQ ID NO: 93011 - DNA, 1083 bp, Zea mays
  misc_feature: Ceres CLONE 1582047
  misc_feature: Encodes the peptide sequence at SEQ ID NO. 93012
  misc_feature (637)..(637): n is a, c, t, g, unknown, or other
ctccccgcggtggcggccgctctagaactagtggatcccccgggctgctggaattcgtctcacccctagaaaaaactgcgcctcacccacaccgcactccgtcaccaaccaaccccggccggcctgcccacgagccccatcccgccatccgcccgcgcggcgagcgcagagccgagccgagctgccggaacgcaggcagcggccaccgggaggcctccgaaacgcagcggaacacctgaggaggcggcttcccggcgaatgctctacgaggaggcgcggcgcctgcggagatggggtccaagtacacgcgcgggtgctgcggctggctgatcgtggcgctgattgccgcgctggtgggcacctcctcgatgttctccatcatgtttccccccccccgggggcctcccttcaagcccctgtccggtgtgcgggtcccccgggggccattctatcccagtatcggggacccgctttgggggtccccgctcctggtccttcccgggtttccgaaagggcgggcaaactggtgtgaatcaaccgaattccccgtggtgggggggggaactctggtggtttcaccctattttgtaaagtaatacggcgggggctggaattccttctccaggggggaatactncccgataaggcttgtggggaacccacatttgttagtgtcctaaccttttcccctgaaagcggggactttcttcggggtgtaaacccgtgagtcttcctcaccttcggtgttgcgggtggttccgggtttacttccgggcggatatccatatattaaggatcggtgtataacacaaccccttgagccctcctctcccctcctccttgccccttctcctggggggcgaaatcacaaatactcgccccgcatttgtgcttgcaacacccccttttgatataatctcggggcgctatattcccctcgggccgcgctatttttccaattttttacacctactattgctgtgtgggagaggcgttataataactttcccactatagaaaatcttcttcactcagagtggattaaattggggtcctttgaccaaaatctttgtttccgcagtg

SEQ ID NO: 93012 - protein, 101 aa, Zea mays
  misc_feature: Ceres CLONE 1582047
  misc_feature: SWISSPROT Homolog: EC 3.2.1.4 Cellulase
MGSKYTRGCCGWLIVALIAALVGTSSMFSIMFPPPRGPPFKPLSGVRVPRGPFYPSIGDPLWGSPLLVLPGFPKGRANWCESTEFPVVGGGTLVVSPYFVK

SEQ ID NO: 93013 - DNA, 756 bp, Zea mays
  misc_feature: Ceres CLONE 1582053
  misc_feature (1)..(1): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
ncctttttttccgcgcgcccccaccgcctcgtctctccctcccttctttnnnggcttttttttcattactggtgctcccctcggtggcggccgctctagaacagtggatcccgggctgcagattcgtctcacccctagaaaagacaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagccaaagggttctggtgcgggtcatggggggggacggcggcgggcaacaacggggagggccgtccaacttccgggggccaacccgggggggaacaagcccaaggaaccggaagcctgggctggggccccccggggcttaaatccccggggccaccgaaaaccttggcgggaaaacccccctttgttgcccttttaatagggggcccacccccccccctgagaaaccccctgggtggtgaaaccgttaaccccccccgtgtccgggggaaaaaaattttttaaacccctttttttccacaatatttcccaaaaagattcccccccccccccccggggggggggagacaaccaaatttttttttttgggggggaaaacccctttaataacccgggggtccccccccctctccttttgggggggggttttttcccccccccgcaaaaacccccaatttttctctgggccct

SEQ ID NO: 93014 - DNA, 893 bp, Zea mays
  misc_feature: Ceres CLONE 1582057
  misc_feature: Translation starting site: 554
  misc_feature: SWISSPROT Homolog: EC 1.2.1.70 Glutamyl-tRNA reductase
ctccccgcggtggcggccgctctagaactagtggatcccccgggctgcaggaattcgtctcacccctagaaaaatagaaaaactccgatttcgctaatgcgacggtgaaatcccgcacctacctccttcctctctctccgaggaccctcgcaccaagaactgagcgggaagagaggtagagaggcaagcgcacgagagtttctgctcctctctcgcctcgcctccgtctcctttcctctctggttctctctctgcgattctcgtcgcattggttccgttccctcacgaaaggcggtagctttctgtcttccctgatctatctagataatggcgaccacgacgtcagcgaccaccgccgccgcagcagccgccaccaccgccaagccgcgggggtcgtcgtcggccctctgccagagggtggccggcggcggcaggcggcgctccgggtgtggtgcggtgcgacgccgccggcgtggaggcccaggcgcaggccgtggcaaaggctgccagcgtcgccgccctcgagcagttcaagatatccgccgaccggtacatgaaggaaaggagtaccatagctgtgataggcctcagtgtacacacagcaccagtggagatgcgtgaaaaacttgctgttgcagaggaactgtgggccccgtgctattcaagaactcactagcctgaaacatattgaagaggctgctgttcttagtacccgtaatagaagggaaatttatgtggtggcgctatcatgggaaccgtgttatcagagaagtagtggactggatgtcagagaaaagtggtatccccgcttccgagcttaaggagcacttgttcatcttgcgaagcagtgatgccacacgccatcttgtttgaggtgtcagctggcccttgac

SEQ ID NO: 93015 - DNA, 1308 bp, Zea mays
  misc_feature: Ceres CLONE 1582058
  misc_feature: Encodes the peptide sequence at SEQ ID NO. 93016
  misc_feature (1036)..(1036): n is a, c, t, g, unknown, or other
  misc_feature (1037)..(1037): n is a, c, t, g, unknown, or other
tctgtgggttcttcccccttctcgccccctttatcccttttttttctctcttttggtgcttaaatctggagctcccgcggtggcggccgctctagaatagtggatcccccgggctgcaggagttcgtctcacccctagaaaaaatctgcagtcagcccatgtcctcctacgacttcttttacggcctgcctccgcccgctgccgcctcccccccggccggaggcggagctggcgcggcctccctcttgcatcccccgccgccaccacctcctccttcgctggagcaagcaacggcaccctagcccgcgctgaagagctccctcaagcggagcaagcccttcctcctcctctgatacaactacctcttgcactccccgtccctcctggcctgcttcgcccaatgcccatgttcccctgtaaaaagtttccccgttcaaaccctcccttttttttccgggtgaccccccctggtttgttgcgtcgcgctaatatcgtgtctcccctctttgtttaacgcttacaatgtcctttcagggtgtcttatctggtctttcgacccttcccaaggattgggctccttctcttctgcgtatatcacgggtttctatttttttctctctttcttatatatgtgcgttttcctcgtctcttctgtgttttcgtgtcccgggctctattctaggtcggtgacggtttcttctctcttttattttttatatacttcgttttttagtttgtcccttttcctatccattttgtctgccttccttctccgccatttttttttttctttttccctcttttcggtctgttgcggcacctcgttctttctcgtttctttcttgccctcttttcaatttattatttctcccccttttttgttgttgtatgttgttgtgctataggtttggccttcgtcctttatgtcttccctgttctcctcgtctctggttttttagtgttttgcggttgttccgctctccgtgtatatgtgtgtttattttatcgcctctctcccctcttccccacgatgttnntccctgtctctttttcccttttttcacatctttccttctcgtatctgtataccaccctatgtggatcaatgttatcttctttgtgttcctctgtcacgccttcgttacctccagtggtggctacatttttcccccgcgcatattcgtctttctttattccctccccgcatagtgtattactattctctcgctacctttttctgtctcttctagctctcacttgtacttcacctacgtagcttctcctcacacttcgccttgcgtattctgt

SEQ ID NO: 93016 - protein, 47 aa, Zea mays
  misc_feature: Ceres CLONE 1582058
MSSYDFFYGLPPPAAASPPAGGGAGAASLLHPPPPPPPPSLEQATAP

SEQ ID NO: 93017 - DNA, 967 bp, Zea mays
  misc_feature: Ceres CLONE 1582061
  misc_feature: Encodes the peptide sequence at SEQ ID NO. 93018
ctccccgcggtggcggccgctctagaactagtggatcccccgggctgcaggaattcgtctcacccctagaaaaagaagcatcctcttccacagtttccttccgctaccgctagtgacctttccaggacgacaactcccaggtcccgactcccccaaatttcccccttcccttccgcctcgcctccagccaccgcgtccgcctccgatggcgtcggcggcggggtcctcgaacgtgatgctcgcgatcaacgagaagaaaacgatcaccactgacctctaccgcccgctgcgcctctacatcgcctccacctactcggaacgcgaggccgccgcggccgacgacgaccttagcgtggtgtgcgacctccgcactgctgtcgagaagccctccctcccagaaccgtcctcgctcgagcagcgccgcgacgcgctcctcgcctacgcgcgggctctggcactcgtggagccccgctttcccatctcccccgatggcgcccacgtcacttccttcacttcacctgggacgaaccattcaaggggaacaagaatggggccttcgctccatccaccttgagaagggatccggggcttctttaacctcggggcccgtctattcccagaattgcgcttccccgccggaaccctccaactggaccccggggatcagggaaccggtggggggggccccttccaaaggggggggggggggggcgttcccttggcctcaaggaaaaacgggggccccggctaaaggtgttcccctgtcggggaacacccccgtgggaaaatcccccccccttgggccccggcttgcgggaaaatacccatgtgcccggcagggggcaaaaaggcttcctccaaaaagttttaggggggagggaaaacccccggccctgtctcaagggtggcccgccagtttgcctaacctcaagagaaaaaatacaggtttcaaggactcccctcaaaa

SEQ ID NO: 93018 - protein, 122 aa, Zea mays
  misc_feature: Ceres CLONE 1582061
MASAAGSSNVMLAINEKKTITTDLYRPLRLYIASTYSEREAAAADDDLSVVCDLRTAVEKPSLPEPSSLEQRRDALLAYARALALVEPRFPISPDGAHVTSFTSPGTNHSRGTRMGPSLHPP

SEQ ID NO: 93019 - DNA, 1004 bp, Zea mays
  misc_feature: Ceres CLONE 1582064
  misc_feature: Encodes the peptide sequence at SEQ ID NO. 93020
  misc_feature (352)..(352): n is a, c, t, g, unknown, or other
ggagctccccgcggtggcggccgctctagaactagtggatcccccgggctgcaggaattcgtctcacccaccaccataattttccaccagcgattgtaaatttgtgggaggcacattcgccgaggatggctgtaaccctacttcgagggatgagaacgccgataccattcagatcgaactccggcttcttctccactgtcctacggcctcggttgtcccgcttcacgactagggcggagagtgcgcaggccacagaacccaaagcggcgcccaggtcaattcagctggcgaccaaggaggcggctgagcagaaacacaatgcttcgaagcatcatcgggattgagaccatgntcagctctcgacgtcacgaaggcgtctgctcctgccctacagctatggttccagcccaacagcactatctgccccacctgcatgggcacccggggaccctgccggtctaaatgaaaaggggtcaaaatgccccctgaaactgggcccccccctcaccgggaaatcccatgacctcccaaattttacccaaacagttttttttcccgggcccccccaaggggtcccaaatttccccgtttgaaacccccttgccaaaaaagggttgggcaattttggaccccccccgggaaattttggggggggcgcaaaagaaatatgggggcccaaggggtcccccgggaaaaaaaagtgggggaagtttctttttttttatatcccaccgccctctcggggggaacacaaaaaggggggggggccccctttcccaaatttttctcccccccccctttaaacaggtgttaaaccccccttgttttggggccaaacaaaaaatttttttcccccccgggggtgtttttttattataaaaagaaccccccccttgggggaaaacctttcttccccccccgggaaataatatttgggggagggaaaaaaaaaaaataccttcttcaaaagaaaggaaaatttatatccccccccccgcccccct

SEQ ID NO: 93020 - protein, 72 aa, Zea mays
  misc_feature: Ceres CLONE 1582064
MAVTLLRGMRTPIPFRSNSGFFSTVLRPRLSRFTTRAESAQATEPKAAPRSIQLATKEAAEQKHNASKHHRD

SEQ ID NO: 93021 - DNA, 958 bp, Zea mays
  misc_feature: Ceres CLONE 1582066
  misc_feature: Encodes the peptide sequence at SEQ ID NO. 93022
ctggagctcaccgcggtggcggccgctctagaactagtggatcccccgggctgcaggaattcgtctcacccctagaaaaactcttcctcccccagtatactccaattcccacgtactcttcctccttgttctcctcctcctctctccctctctctcgccagaggatccaagaagtaccattgcagctcgctccattcgttcccaatcccaacacagcctctcagctgagctcagctcagctcagctcagggagttcccctgcttgtttttgctctagtgctcttggctgcctcagaaaaggactgcatgtgcagcagctgcaaagatagaatttctttatttttttcaccccaccttctcccaaggtgctgttggtgccccaggtggaggcaactggcgaactgtgtgcgttctttgcttgatcaactaggttaagccatttcttgccccagtgttctccgattcatggttgtggaactagtccgagaatagctggagctgctcgttttcccttccaagaagacgaaggcggggggcgaggcgatcgtttgagcggtacctgttgcgcgcctgaggcggtgcaatcaatgtcgtcttcctgcataccgaccggcctgcggctggacctggacatggtgaaggcggcggcgtcgccggtgggcgcgcactcgtcgccgctgcgcccggcgcactactcgtcgccgtcgtcgacgctgtcgtcggaggcgtccaaacgcctcgtcttcgtcggggaactcggtgtcgcctaagccgggttccggcgccccggaaacggcccaaccaggcgtaaaaggagggcgccgcgctggttccgttcatccaccccttcgggtttcccgtgaacaagagcccaagacgggccccccggccccgccgaaatttcccggggggtgggggggggtttaatccctcgccaaacttcttccgagcgttcccg

SEQ ID NO: 93022 - protein, 60 aa, Zea mays
  misc_feature: Ceres CLONE 1582066
MSSSCIPTGLRLDLDMVKAAASPVGAHSSPLRPAHYSSPSSTLSSEASKRLVFVGELGVA

SEQ ID NO: 93023 - DNA, 1333 bp, Zea mays
  misc_feature: Ceres CLONE 1582072
tgggtctggcgcaggggccctacactactacactgaacaaacacggaccgctgtttggtttaaaatataaacttgagcgccctctgtggggggcgctctagaactgtggatcccccgggctgcaggaattggtctcacccctagaaaaactcagtattccacgcttgacactccgtgacggacacgcgccctttcccctcttctgcgactcattccggagcgcgctgcctccgatccgcggcacccgcgtcgcgtccgccgtatgacaagggcgcacctgccggctgtggcggcagcggcgtgcctacggtggcgcctgcttctagggcctggcggatcgcctttcggcctcgccgttcttctccataccaatccttccttctagagccgccccaagaggcctggattccggaaccccaatgtaaatggcgctgaagctcgcggggggttccatgtcccgccttctaagcacttggcgtggctaatataaacacccccggggcttctcattcccattttttattttgcatcattgccaagcttgggttccctcaaattctctcctgaaaagggaactatataggaccgctggatataaagtgctccccacccccaaaaatttttccaaaacacccctataaaactccatatttctgcccgttcccgtttgaaaagccaatcccctacattattagggatgaaaacctaccccccttttattcttgtccaccctgtttttttcccccccttttgcccacctcctcttttcatatcactttagttcccttctcttggctaataggtttcggccctcattcgtacaccctgttttgattgcgcggtccgtccaatgattgttatttttgacccccggacacttcttagttgtgtttatagaacggccgacaacatctttgttcggtttgtatgtatatatattctgcttttcgctcactgttgtgataatcctggaactgtatatatagtcttcgcgccttcctctccttgtttaatcaattgctcgacttctgcctcctattcccctgttgttccgtcttcttcggctcgcgcacaataatacacgagtgcgcactggtttattccttagatttcatcaccgcatatctttgtatattgtctcgccactcacgtattgttttcccgctactacttttagctctgtgtgttttccagcttttttcggtgttcgatgccaaaggactctccgtaccttgagttcacatggtgtatttcaccatatgtttccgtactcctacagagatatatctgtcgtgtaacgatcgctctccctctgagagcacgcgtgatgtca

SEQ ID NO: 93024 - DNA, 981 bp, Zea mays
  misc_feature: Ceres CLONE 1582073
  misc_feature: Encodes the peptide sequence at SEQ ID NO. 93025
  misc_feature (353)..(353): n is a, c, t, g, unknown, or other
  misc_feature (923)..(923): n is a, c, t, g, unknown, or other
  misc_feature (939)..(939): n is a, c, t, g, unknown, or other
ctggagctccccgcggtggcggccgctctagaactagtggatcccccgggctgcaggaattcgtctcacccctagaaaaactccagtcctccctcccggctccctcccagtacccacggtcccaccccacccggagaaaacgaaacaaaccaaatctcgctgcgagctgggcggcgagggcgcgcggcgccatggcgaggagcaggacgtcgggcggcggcgagtacgagagcggcagcgaccacgacggcgcgctgcagaagccgctgctgcccaacagcgggagctggtaccggatggggatggggtcgcgccagtccagcctcaacgccgccggcacctccctcatgggncgtctgcgcgagtcccacgtctcccgccttcctctgcacgctcatcgtcgcgctcggcccccatcagtttcggctcaccgggcggttactcctccccgaagcagggcaggattctccggggacctcaaccttccccatttccgaagttttcggggttccgggccccgtggtccaaagggggggcccctgtgggggggggggaactcccccagggcccaaagtgggcaaaaatcctttgcgccccaaaaggtcctttttattatttcccccatttcccaaacgcgtttggggggtgggggggaattcccctttgaaaaaaaaatctttcttttttttatattgggaaacccctttttaaaaagaaaaggggggggtaattttttcttcttggggggcgcgggggttataaacaaaaaaatttcccccccaaaaaaaaagagggggctcttttcttttaaaaaaaattttttttcccccccccgggggaggggggccccttttgcccccggttttttcctttgcgggggctcttttaaaaaaaaaaaaccccccccgcgggagagaaaaaanctttttttttttttgncccaccccggggggggggggaaaaaaaataagtggtggcctc

SEQ ID NO: 93025 - protein, 263 aa, Zea mays
  misc_feature: Ceres CLONE 1582073
  misc_feature (244)..(244): Xaa is any aa, unknown, or other
  misc_feature (250)..(250): Xaa is any aa, unknown, or other
MARSRTSGGGEYESGSDHDGALQKPLLPNSGSWYRMGMGSRQSSLNAAGTSLMGRLRESHVSRLPLHAHRRARPPSVSAHRAVTPPRSRAGFSGDLNLPHFRSFRGSGPRGPKGGPLWGGGNSPRAQSGQKSFAPQKVLFIISPISQTRLGGGGEFPFEKKIFLFFILGNPFLKRKGGGNFFFLGGAGVINKKISPPKKKRGLFSFKKNFFSPPRGRGAPFAPGFFLCGGSFKKKKPPPRERKXLFFFLXHPGGGGKKNKWWP

SEQ ID NO: 93026 - DNA, 981 bp, Zea mays
  misc_feature: Ceres CLONE 1582076
  misc_feature: Translation starting site: 339
  misc_feature: SWISSPROT Homolog: EC 4.1.1.50 Adenosylmethionine decarboxylase
ggagctccccgcggtggcggccgctctagaactagtggatcccccgggctgcaggaattcgtctcacccctagaaaaaatcaggcccacgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggaatttcttttctgacacttcgattcttaccattccccctgggcctgctgctttcctgacaatcgaccagttccccagtcttgctccctgcagtcctccctcctccatcttcaagcgttgtgtcctgactcacctgcaccaaatggctgttctttctgctgctgggtgcccccccgggctcagctatcggggttgaggggctatgagaagcggctttgagatcacattccctgaaggcacctgtctttgtggaaccccatgggcaggggtttgggggccctccccagggcccggattgacccgtgttcgggatctggcgcggtgcacaatctggtccagctctcccaacaagattttggctcccttgttcctcccgaagcaagctgggttatcatccccctcgaaattggcctcagaaccgtgggacaaccagaccctggctcaatttccaggatt

SEQ ID NO: 93027 - DNA, 948 bp, Zea mays
  misc_feature: Ceres CLONE 1582080
  misc_feature: Encodes the peptide sequence at SEQ ID NO. 93028
ccccgcggtggcggccgctctagaactagtggatcccccgggctgcaggaattcgtctcacccctagaaaaaactgcggccaaagtcgctgccctgccgagtctcgactctccacctcagccctcagggccgccggctccttcctcccctctcctccgcctcgacaagcgtcggcgagatggtgaagaggagcaagaagagcaagagcaagcgagtcacgctgcggcagaagcacaaggtgcagcgcaaggtgaaggagcaccaccgcaagaagcgcaaggaagccaagaaggccggcaaggccggccagcggaggaaggtcgagaaggaccccgggatccccaacgagtggcccttcaaggagcaggagctcaaggcgctcgaggcccgacgcgcgcaggcgctccaggagctcgagctcaagaagcaggcgcgcaaggagagggctcagaagaggaaggcaggattgcttgaggacgaggacattgctagtttggcatctgcagcttccgcacagggcagtgagtttgcagcaaaggagaatgctcctttattagtggcaaagatcaacgatcattcagagagggctttctacaaggagcttgttaaagtaattgaagctccccgagggattatggaggttcttgatgcaagggatccgctgggcacccgttgcattggcctgggaaaagaagggtagggaaggctgatccagttaaacggaattgactactccccaacaagaaagatccttgttcccaaggaggcgggagaggaaatgggcttaattccctaaaagaataattggcaactgtttgctttttaggtgcaatcccccagggagcaaggtaccagtctgggggggggaaatctctccaatttggatataaaaaggcaaactccccccaagaagggggtgtggcctgtgcggcccaaaaatctattcca

SEQ ID NO: 93028 - protein, 173 aa, Zea mays
  misc_feature: Ceres CLONE 1582080
  misc_feature (16)..(96): Pfam Name: GN3L_Grn1 Pfam Description: GNL3L/Grn1 putative GTPase
MVKRSKKSKSKRVTLRQKHKVQRKVKEHHRKKRKEAKKAGKAGQRRKVEKDPGIPNEWPFKEQELKALEARRAQALQELELKKQARKERAQKRKAGLLEDEDIASLASAASAQGSEFAAKENAPLLVAKINDHSERAFYKELVKVIEAPRGIMEVLDARDPLGTRCIGLGKEG

SEQ ID NO: 93029 - DNA, 1333 bp, Zea mays
  misc_feature: Ceres CLONE 1582082
  misc_feature: Encodes the peptide sequence at SEQ ID NO. 93030
  misc_feature (61)..(61): n is a, c, t, g, unknown, or other
  misc_feature (62)..(62): n is a, c, t, g, unknown, or other
  misc_feature (1040)..(1040): n is a, c, t, g, unknown, or other
  misc_feature (1137)..(1137): n is a, c, t, g, unknown, or other
  misc_feature (1229)..(1229): n is a, c, t, g, unknown, or other
  misc_feature (1231)..(1231): n is a, c, t, g, unknown, or other
  misc_feature (1289)..(1289): n is a, c, t, g, unknown, or other
tcctttttttcttcgtccccgcttggctccttctcttctctttcttttgcggctaaaaaanntttttatgagactccccgcggtggcggccgctctagaactagtggatcccccgggctgcaggagattcgtctcacccctagaaaacccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctggacttcaacaaggatggctcagctatcaagaagctccagactgggagcaaaagctttgcagacctagtcggagtttaccttgggaccaaagggaacgaatggttgtttttggaaaacaagatatgggtcccccaaaattgtaaaccagggggttacatttccccgaaaaggttgaagtcgggaggaccctgggggaaaaaaattgggggcccaaattggggcgggccatgcactagttttagaacccatggtttccggtcgggggaagggggaaaacccaaccccggggggggccctgggcttcaggggggcgggaatttcttgaaagggggggttaagggttggggggcccctcggggggcaccactactcgggtcaaaagataacctcctggggggggcgccctagtatattacggggcgagagcacccatttttggaacgatgactccccggaaagtgtttgccctcatgaggagggtggctaaacacacatttattgtggttttgccccataatgagcgtccaacgtcggtttgttcatgtcctgcgggcccatcacctatttatggaaaaaggtgtggcgtacattcgagatatccggaggtgagcccctgtgcgtttacattgtcgcgtcccccccacaaaagagtggtcggtgtcttcaacgggctcnaaaatgggggggggggtagtctcttttgcaaaatttttctcccctacttgatggggggagggggggggagaatatactgcgtttggatgccatgctnttcactgttttcatgcgcgcacgcgtgtgtttgttgcaaaccatagggccggaacacatattatgttcgcgtgatgtagtgagcctcgatcncnactccttattaccattttgtcgggtggtgaggagaatatacaattactttccgcaccngaggcgaatttttttttttcgctcgtgtacaagacaagaacaat

SEQ ID NO: 93030 - protein, 173 aa, Zea mays
  misc_feature: Ceres CLONE 1582082
MASTFGATSTVGLMAAPTGKNVRLQRRVNFRVRAAKELDFNKDGSAIKKLQTGSKSFADLVGVYLGTKGNEWLFLENKIWVPQNCKPGGYISPKRLKSGGPWGKKIGGPNWGGPCTSFRTHGFRSGEGGKPNPGGGPGLQGGGNFLKGGVKGWGAPRGAPLLGSKDNLLGGAP

SEQ ID NO: 93031 - DNA, 1010 bp, Zea mays
  misc_feature: Ceres CLONE 1582086
  misc_feature (247)..(247): n is a, c, t, g, unknown, or other
  misc_feature (251)..(251): n is a, c, t, g, unknown, or other
  misc_feature (252)..(252): n is a, c, t, g, unknown, or other
  misc_feature (255)..(255): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (275)..(275): n is a, c, t, g, unknown, or other
  misc_feature (295)..(295): n is a, c, t, g, unknown, or other
  misc_feature (296)..(296): n is a, c, t, g, unknown, or other
  misc_feature (299)..(299): n is a, c, t, g, unknown, or other
  misc_feature (308)..(308): n is a, c, t, g, unknown, or other
  misc_feature (309)..(309): n is a, c, t, g, unknown, or other
  misc_feature (320)..(320): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (375)..(375): n is a, c, t, g, unknown, or other
  misc_feature (402)..(402): n is a, c, t, g, unknown, or other
  misc_feature (403)..(403): n is a, c, t, g, unknown, or other
  misc_feature (418)..(418): n is a, c, t, g, unknown, or other
  misc_feature (419)..(419): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (541)..(541): n is a, c, t, g, unknown, or other
  misc_feature (607)..(607): n is a, c, t, g, unknown, or other
  misc_feature (743)..(743): n is a, c, t, g, unknown, or other
  misc_feature (776)..(776): n is a, c, t, g, unknown, or other
  misc_feature (915)..(915): n is a, c, t, g, unknown, or other
  misc_feature (930)..(930): n is a, c, t, g, unknown, or other
ggagctccccgcggtggcggccgctctagaactagtggatcccccgggctgcaggaattcgtctcacccctagaaaaactgcgctcgtgctccgcccaggcccctttcctccaccgcgggcgcaaaccctaaccctacagccgctcgccccgcggcgcctgccaatggcgccccccgtgtgagtgtgtgtgagaggcagagacctagaggccgctacccggggaggagagggtagggagagggagangctnnttnttgtttttttnnnggggtgntggggttggggttggtttgnnttngttttttgnnttttgtttttnttggtgtggtgggtgtgggggtttttttgtnnnntgtggtgggtgggggtggtgnggtttgtttttttggtggcccctttgnnggtggggggggggtnnggggggtgttggtgttttttttggtggggttttttggtgggggggtggtggttttgtttgggtgtggnnntgttggttgttgttggggttgtgggggtgtttgtgtttgtggtgtttgttgngtttggggtgtttttttggggggttgtggtggtttttgggggtgttgggttgttggttggtgtttnttgtgtggtggtgttgttggttgtgttgtggttttgttttgtgtgttgtgtgtttgggggtgtttgtgttgttttgttgttgggggtggggtggtttggtgtggggtttggttgtggtgtgttggtttggtggtgntttgttttgttgttggtgttttttgttgtgggncttctctcttttgttcgcggctgtgttcgtttgtgtttttcccctcctcttgcgtttggtctgtcccctgtttcttctcccccctgttctgtttttcttttttttttccgcgctcttttttgccccctcttcttttttntctctgtgtgcgttntgccttgttcagcttttctccctttgctccgccgccgttgtatttcgtctctttgtggtttgtccccctctaattgtggt

SEQ ID NO: 93032 - DNA, 1090 bp, Zea mays
  misc_feature: Ceres CLONE 1582088
  misc_feature (277)..(277): n is a, c, t, g, unknown, or other
  misc_feature (280)..(280): n is a, c, t, g, unknown, or other
  misc_feature (283)..(283): n is a, c, t, g, unknown, or other
  misc_feature (295)..(295): n is a, c, t, g, unknown, or other
  misc_feature (304)..(304): n is a, c, t, g, unknown, or other
ggagctccccgcggtggcggccgctctagaactagtggatcccccgggctgcaggaattcgtctcacccctagaaaaaacttcccccctcatctctctccgttcattccctctctcatgcgtgcttgggttgggttgggtttgggtatagacagttcttgcagtccacaccacctcaagtgagggggtgaccccccaccctcctccctagcgctcctcaccgccatgctgccaagaaggcagagcatcttccacctcggggagagagggtggcgccnccnccntgcaccaccacntcagcatcntcagccccgcctcctctccatggccatggggccggggtatgttgccgccttcccccgaacataaacccctttttcattgggccccccaatcttgtagcaccaacaatcgcggcatagggacagtaaactcgacaatcggtaaaactaaaccctgaaccaaaatatttaaggctccccttcccccttttttttcttgggcccatctcccacttgtaactctcccctcttcacccgcgttttttctctaaagtgtccgataacctctcccaatttcgagaccttagtcccccaaaatataccctccttatgttttttgtaatgtttcacattgtgtcctccctattatagatgacctctctgtgaaatattacaaaacattgaaggactacaaagcctcccattagaactccttggtgcgcccgcccattattataataacataagatgttttccatatcggtgtaataactactgcctctcttattctttttcatccttttaaattttttccactacacctcaattttttaaagggctcacttagtaataacaaacattatcccgcatttaactcttttacactctcgctcgtttttacttatcatcggcagacatggagtttactattgttatctgttcccctcactaattgatcccgcattaattttgtacatatatctacttcacctcccgcactctggtctatcgaataacactttattgctctccctcaccttatatgtttcattcatatatatatttgacgcagccgtatatgatattctt

SEQ ID NO: 93033 - DNA, 948 bp, Zea mays
  misc_feature: Ceres CLONE 1582090
  misc_feature: Encodes the peptide sequence at SEQ ID NO. 93034
  misc_feature (746)..(746): n is a, c, t, g, unknown, or other
  misc_feature (747)..(747): n is a, c, t, g, unknown, or other
  misc_feature (759)..(759): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (770)..(770): n is a, c, t, g, unknown, or other
  misc_feature (780)..(780): n is a, c, t, g, unknown, or other
  misc_feature (835)..(835): n is a, c, t, g, unknown, or other
  misc_feature (934)..(934): n is a, c, t, g, unknown, or other
  misc_feature (940)..(940): n is a, c, t, g, unknown, or other
agctccccgcggtggcggccgctctagaactagtggatcccccgggctgcaggaattcgtctcacccctagaaaaagctctgatagcttgctccaggacgtacgtacgtacgtagatcgatccatcgatcgctagctagctgacgaccatggcgtccctctcctctgccgccatcaccgccccttccttcacggccgcgcccgctcgcgcagtggtcagcaggaggtccttcaccgtgcgtgcctctctccgcaaggccactgccaccgccgccgtggccgttgccgccagcgtcctgcttgccggcggcggcgccatggcccaggaggtgctgctgggcgcaggcgacggcgggctcgtcttcgagcccagccagttcaccgtcaaggccggcgacaccatcaccttcaagaacaacgccggcttcccgcacaacgtcgtgttcgacgaagacgaggtgccgagcggcgtcgacgcctccaagatctcgcaggaggagtacctcaacgcgccaggcgagacctactccgtcaccctcaccgtgccgggcacctacggcttctactgcgagccgcaccaaggagcaggaatggtcggcaagatcacagtcaactaaagctagctatccattccatgcatctcgatctgtatgtactccgcccgtcgatggatgatgcatccatctctacttgttttcctcacatgtacaacaattaatgcaacaaattaagtacgtacttgagagnngaaaaaaaaagnaaaaaannnanaaaaaaaaanaaaaaagggaaattttaaagcagagaagcgaagggatgtgcactgaaatcagtgnagtatatctgggaatcaaagaacagggacaatgggtgcagaattagaacgaagggaaacaatctggtaaaagtcatgataaaaattttggaaaaggaancgttcnaagtcgcc

SEQ ID NO: 93034 - protein, 155 aa, Zea mays; identical to SEQ ID NO: 89468
  misc_feature: Ceres CLONE 1582090
  misc_feature (59)..(155): Pfam Name: Copper-bind Pfam Description: Copper binding proteins, plastocyanin/azurin family

SEQ ID NO: 93035 - DNA, 909 bp, Zea mays
  misc_feature: Ceres CLONE 1582092
  misc_feature: Translation starting site: 355
  misc_feature: SWISSPROT Homolog: EC 2.7.11.1 Non-specific serine/threonine protein kinase
  misc_feature (747)..(747): n is a, c, t, g, unknown, or other
ctccccgcggtggcggccgctctagaactagtggatcccccgggctgcaggaattcgtctcacccctagaaaaagtccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtccgttcggggaaggggagtgcggcgatggggaagcagcaggaggggaagcggcggcgcggggagaaggacgggcagcggaaggggagggggaagacagctgcagcggcggtgccggaggacgcggcgccagtggccgggtgctggatccgcttcccgcgcctccgcggctgcatgccgtcgcgcgccaaggtcgactcctccaccagcgcgcgtggcggcggccgggaaacaaaccatctactgatgatgcttgcaggtacaatcagtaccaccagcctctggttccgcacaacagtaacactggaagtatctcaccttcttccatagttggagaggagctaaaactagctttccaacggcgtagatttacttttagtgaactggaaagtggcacgagaaacttccgacctgagagtnctcttggcgagggaaggatttggctgtgtctttaagggaggaattgaggagaatggactgctccgttaagccagcaccgggatactgttgcggtcagaaccccaacatgatgggttgaggggccaaaaaaaggggggagaggtttaaatttttggtgggata

SEQ ID NO: 93036 - DNA, 1046 bp, Zea mays
  misc_feature: Ceres CLONE 1582093
ctccccgcggtggcggccgctctagaactagtggatcccccgggctgcaggaattcgtctcacccctagaaaaaatctttctctctctctgctcgactttcctctgcagccggcccatatgaaggacaccacgtgaactcccccgacgactcagtgcgtcttcgccgccgttttcgtcgtcgcagattaaggttcccctcctctaacacgccggcgcttccccccctgccaccgcgacactcagtcgtcgccgccgtcggctctgctgccgtggccaagcgcgttggcagcgaggattgctttagcttgcaggcactttccccacccccaccgccgctgatttcgccgttttgcggtgatgcccttcgcgttgacgggctaatcggctgcctgatttccattacgatgggggaaggtgggttcctggttcgcgtctctgtagaacccccgcggttattcgatttcgtgaggtggaggtaaacctttctccggctttcctttttgtcaagggggaaatggctcgcttatacccctggggaggtgggtttgaattcgttcttttcccttgttgggggaaaactttttttccggctactccctcagggcttgctgtatttttgattatggctcatccgggagggggggcatctccccccgcggtgtgaatgccttgcgtccccctatttaagtggaaggatcctgtttttactacggccgactcttccgccataaatataaccgccctggtggagtcccctccggtctcaccgcgaataatgggggatgtgaaagaaaagatcttaagggtgttttctctccatattttgttttttctcggtacgaaaaacttttatcacacccccagttttctgtgggtgggggattattctccccccccgcgtttgattcaaaatacccccaccgtgttaaggttgttgaattttatttggggaaactgcgcgatgttttggcccgtttgtatctcaggcgcgtattatctattgtgcgcccttgtagcatttttcaccgcttttgttgttcagatc

SEQ ID NO: 93037 - DNA, 891 bp, Zea mays
  misc_feature: Ceres CLONE 1582095
  misc_feature: Translation starting site: 230
  misc_feature: SWISSPROT Homolog: EC 1.6.99.5 NADH dehydrogenase (quinone)
  misc_feature (608)..(608): n is a, c, t, g, unknown, or other
ctggagctccccgcggtggcggccgctctagaactagtggatcccccgggctgcaggaattcgtctcacccctagaaaagtgcaggcaggcaggcggctggcctccgtccgcgcatcctcttctggcgaggagctcccccacgcagccgctgctctctccacgtcctctgttccttcccctccccgatctcccccaatccgaccaaaccggcagagccggggggcggcgatggcgctgcgacgggcgctcctcagatcggcagagttctctttcgaacgcaaggctgcaattgagtacactcattctttatcaagggcacagcctgctcgttctctcaatggtgctggcctttgtcctgctagtagatcacttagcacccaggccgccactacgtcaagcacaccacagcctccgcctcccccaccccctccagagaagactcacttttggtggcctcaaagatgaggatcgcattttcaccaacctctatggtctgcatgaccctttcctgaaaggcgcgatgaagagaagtgactggtataggaccaaggattttgtgatcaagggggcagactggatagttaatgaatgaagaatcaggtcttcngggtcgtggaggtgcaggttttccctcggtcccaatgggccttttatgcccagggttcagattgaccccttctttacctggccgtaatggctaatgaaatggaaccctggaacttggcaagattaagaaatcttgggccatgacccccacaagctttcgggaaggagctttatttgctggaattggaaaaaagggaatcactgcctaattcctacttgaagggggaatcccgggaaagaaccgccccaccttggaaaaacccccgcggaaaactttatcccct

SEQ ID NO: 93038 - DNA, 972 bp, Zea mays
  misc_feature: Ceres CLONE 1582103
  misc_feature: Translation starting site: 104
  misc_feature (353)..(353): n is a, c, t, g, unknown, or other
cggccgctctagaactagtggatcccccgggctgcaggaattcgtctcacccctagaaaaagccactcgcgcgcccgggctcgttcccgccacgctcacgacgatgccgtccccgacgtcctatcttctcctgaatccctccaaaccctcctccttccgccgactctcggccccgcgcctgagccggttccatgtctcctgcgacgcgccacggggcggcgggaggcgcgaggtcatccccgccggtgccagcaaggccaagaaacagatcggattctgcgacgccgccccgcctgtgtcccaggagggtggaggcgccgtgaagaaggcggggagcgagaagcttacccaantgggcagcggcaacacaccgctggcgttctcgaggagggcaaccaagtagacactctcggtgctgtccaatctcccgctcgctatctccgagatgttcgccatttgcccccctcatggctctaagaaccgtgattgaccagggtagaggcacgcagctacgacttcgagaagttccccgaaggaaacccggtcatttcggcttcatcacgtggaggggggatcctcccccccggggttcgaccacatggtctactcgccagtgttcctcgggcttcttgcgctcctagagacggccctcaggggttgaccttcaggacccagctccccatgggtcaaggtcgcaagaagaagggtcgttccacctttccggagaaaggaatgggaaccctggaattttcggactcgcttcccgaaggatccctttaggattttgggagtctccttgctgggggccgggaaatgaaggtttctccccggggtccttcctttgtttctttccaaaggggaaacccgagcgggtttgcgccattatgtgctctccccgtggaaatcgttttactccgtggtgggggccaccccttattctcacaaggactcttttagagggccccgcgggat

SEQ ID NO: 93039 - DNA, 1333 bp, Zea mays
  misc_feature: Ceres CLONE 1582104
  misc_feature: Encodes the peptide sequence at SEQ ID NO. 93040
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (1252)..(1252): n is a, c, t, g, unknown, or other
cccgtggctccatttcccctctattctccaccttatgcctgtcaaggggnnnnnnnnnnnnnnnnnnnnnnnnctctccgcggtggcggccgctctagaactagtggatcccccgggctgatggaattcgtctcacccctagaaaaatctgtatcccgtggcaaggagcatctgcgcgtcacatccgcgatcgcgcgctctacgtcgcctcccgccgccgccgcacggccgcgacggatgctcggccaccgcttccctaccgccctccgcctcccacatggtctgctgctgaggaggagcatcatggcccgccgcggcctgaccatcatggccggtggcgaggcggagggtccgctcgcgggtttcttcgactacatggagcggctacgcaactacgagcgctcgggcgtgccgcgcggcgccggcaccgactccgacgacgggttcgaccttcggacgcatgccccggctcctccgccggctcggcgacccccacacccacttcccgggctgtgttttatcgccggctccaagggggaaaggtttctacttgctgcattccctgtccctattatcttgacgagccccacaggctaccaatgtgtaggcctggttaactcctaattccaccaatccttcttaaccaaataacggtgaaaaccggatttttccgggtgtgggaataattgaatagggtagggccccctggattcccccatccaccggaaccgggcgcggagtggcgaataccttgtgcttcggaacagaacatgggccaagttaatatagtctcctctttgtgattcgaatacccatatttagcgcaaaccccgcggaaaaaaaatggagggattctgcccgcggtagaaaaatagcaatactttttgggacagaggatggtttttttgattataaccgacgtgactccctcacatcccaactttctctctcgcgctctcttagtattgttctcgctccactacaaatacacagaaagtagtgtgtgttgataaacctttggggcgccatctccccactttcataataagtcctggtgtgttactattggcgctgtgaggaacacccgtatgtgacggcctacagctcaacaccaaaatatgtgtttcttctcgactgcgttgaactttatggtgtgaaaagatatgagcatcgtcgatactctcgcttgctgctattcactattatctttatggtggcgacggggagaaacctctacttgtgtacgtacccnctcttggggtagggagacttcccccgcccccaataatctcccttgatatattgcgtcgactcccgcgtgtttatattctat

SEQ ID NO: 93040 - protein, 128 aa, Zea mays
  misc_feature: Ceres CLONE 1582104
MLGHRFPTALRLPHGLLLRRSIMARRGLTIMAGGEAEGPLAGFFDYMERLRNYERSGVPRGAGTDSDDGFDLRTHAPAPPPARRPPHPLPGLCFIAGSKGERFLLAAFPVPIILTSPTGYQCVGLVNS

SEQ ID NO: 93041 - DNA, 973 bp, Zea mays
  misc_feature: Ceres CLONE 1582105
  misc_feature: Encodes the peptide sequence at SEQ ID NO. 93042
  misc_feature (515)..(515): n is a, c, t, g, unknown, or other
gcggtggcggccgctctagaactagtggatcccccgggctgctggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctggggcagcctcagccgcgacgagctgtggcgcaaggtgtgggggggaggccacctacgacctcgccaccgtgctcgcctttcctcgccgttctcggctttcancatctccgttctaaatcatgttccagtcccagggcccgtggaacctaatcgaacttcgcaggctaacaaagccggcccgaacaagctccagggtggtccaagggcgggattttctccaaccctgcggccccaattcccgggcaaatttccaacaaaggaaacggcctggggggtttccacattccctgctcggcggggccaatgtcccggggtttgtgggaaaaaaatcttaaactgtccccccccttgtttgtttttgaagaccaaaagccgatctgtggccccaccttttaaagaaggggcgccccccacaagggttcccagggtcctttttctccgcccctggataaaaatcttttaaaaaatggccgcttccgctccaataaagggggtgagcgggggggtaaatttgaaattctaaacccgaaaccctcctttcgccctgtattgtattcaat

SEQ ID NO: 93042 - protein, 127 aa, Zea mays
  misc_feature: Ceres CLONE 1582105
  misc_feature: SWISSPROT Homolog: EC 2.3.1.119 Icosanoyl-CoA synthase
  misc_feature (112)..(112): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGQPQPRRAVAQGVGGRPPTTSPPCSPFLAVLGFXHLRSKSCSSPRARGT

SEQ ID NO: 93043 - DNA, 1333 bp, Zea mays
  misc_feature: Ceres CLONE 1582107
  misc_feature: Encodes the peptide sequence at SEQ ID NO. 93044
  misc_feature (841)..(841): n is a, c, t, g, unknown, or other
  misc_feature (1320)..(1320): n is a, c, t, g, unknown, or other
gctttttttttcctcccttataccccacccttcatcatcgctttttatatcgtctcctcttttataacggttctccccgcggtggcggccgctctagaactagtggatcccccgggctgcaggaattcgtctcacccctagaaaaaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggcctttgcccaaaagaaggagctggccgcgccggcgccgcaccgcgcgggctcgagccgtcggaccaagccgtgccgcgtgcgcgccgttcacgtcgcccgcacgcaccccccgcgcccccgtcttccaccgggtcggtgaagacccccataacaatgacggagaaaaacccccccaaagggcctccaaatcacctggtctggaaccccggggaaaaaattgggggtggaaattccaagtggctttttaaacccaaaaacttcttcggtggcccgtgcctcaatcgggaatctcttaaaaaaagaaattcccggggaaggaaatcccaatgtgtccgggaacccccctaaaaaggtcttttattttgttccccccataccccttaatattccttcttatatgcacaaaacaaagtgccaccataaccctccaatatatctcaaaaatcctctcctgggggaatcccccttagtgagcttgtgcccgcccaaaaacacttacataggttgccccgctttctttataatgtttataggcggtagttttntcatttaccattatttactcggcgggcgttgggtctattgctaaatattatacacagcagggggaggttgttctcctaactaacctcacctattcagtttattccgcctcacctcgaaataatagaagatatttgtgggcgcaacagcaacgaggaagagagcgccgtctttcctcctggcgtggggtatccacaatcatctctactctactccaccgtttctgtggtgtcggaaagagcaaacctcttgtgtcgggttttcttctttattctcctctcagctctagcatgtctgatacacacatctcgcgtttaatacacttctttcccgcgttcacgatcatgaccgccgctatatatacaatgcctcctcttctctttagaagatagcccgctctctctcccctttaaatacatgttggcacgcgcgtcgcgtcgtgatggtaagcaacgttaccatatcttacatctcttattancaaacatgtataa

SEQ ID NO: 93044 - protein, 59 aa, Zea mays
  misc_feature: Ceres CLONE 1582107
MASSISAAAKASAAFAQKKELAAPAPHRAGSSRRTKPCRVRAVHVARTHPPRPRLPPGR

SEQ ID NO: 93045 - DNA, 923 bp, Zea mays
  misc_feature: Ceres CLONE 1582109
  misc_feature: Encodes the peptide sequence at SEQ ID NO. 93046
  misc_feature (782)..(782): n is a, c, t, g, unknown, or other
  misc_feature (845)..(845): n is a, c, t, g, unknown, or other
ctccccgcggtggcggccgctctagaactagtggatcccccgggctgcaggaattcgtctcacccctagaaaaagtcccgctcccttcctgctacctgctggccgctgccctttccttcccggaatggtatcgtgcgacctgtagtcgtcgccagccacctcgctccctcctagacgacacccagctagtgctcccttccacacccaggaaccagccacctaaccccgcccgccatgccgggcctcgccgcctccgacaactcgcccccggcgccggcgccgccgccgcgccggctctcgtcgccgctaccccgtcgcgcgccgtcgtccccgtcgccgtccgcctcctcgcgcgccaagcctcggaagccctcgccctctcccgcggccttccccaccgacgccgacgactcgctcgacaacccggatctggggcccttcctcctcaagcaagcgcgcgacgccatggtgtcgagcgagggcggtggcgccgcgcgcgcactcgagttcgccgagcgcgccgccatggcgctcgagcgacgcggcgagggcgccgagctcgagctcgccatgagcctccacgtcgccgccgccatccactgcggcctcggccgccacgctgacgccatcccccgtctcgagcgcgccgtcgcagtcgtcacgccgccgccagaagcgcctgccgacggcgaaggcgaagccgaagccggtgcatcgggcgcgacgaccacagcagctgcagctgccgagccctgacagagggggcgagaagtggtcctcgncgccttctcgggctgtagcagctcggcgaacgcacccatgcttgccgcatggacgatccatcnctgctacgaaaagggctcaaatcagatggctgcctcgggaggcgatctcgcgtccaaaactgcagtactggcggaacc

SEQ ID NO: 93046 - protein, 173 aa, Zea mays
  misc_feature: Ceres CLONE 1582109
MPGLAASDNSPPAPAPPPRRLSSPLPRRAPSSPSPSASSRAKPRKPSPSPAAFPTDADDSLDNPDLGPFLLKQARDAMVSSEGGGAARALEFAERAAMALERRGEGAELELAMSLHVAAAIHCGLGRHADAIPRLERAVAVVTPPPEAPADGEGEAEAGASGATTTAAAAAEP

SEQ ID NO: 93047 - DNA, 985 bp, Zea mays
  misc_feature: Ceres CLONE 1582111
  misc_feature: Translation starting site: 319
ctccccgcggtggcggccgctctagaactagtggatcccccgggctgcaggaattcgtctcacccctagaaaaaaagctgaactcatacgaacctcgatttcttccgtccggcgtttttttttctctcagtttctgaggtatttctccccctttctttcttccctccctcccagtagattcttcactgctcggggatttggaacaaaggccgtggttcgaagctggtgtgttcgttcaattgtgcggaaagaaaggccagtgttatgtgtgaagctgaagcagtgaaggctagcaggtaggctggctctcgcctagcgatggatctcgagttcggaaggggcctgaggtccccaaagagagactcgtggaagaccaccttgctgctggcgtaccagagcctggggggtggtctacggcgacctcagcatctctccgctgtacgtgtacaagagcaccttcgccgatgacatccagcactccgagacgaacgaggagatcttcggggtgctctccttcgtcttctgggaggctcacccccaatcctctcgcaaagaggaacgttggccctctacccccctgatttgcaggcccccccaatgttgagccttcctccccgaaacgggcgaatccccaaattaggaagcttcccacctaaaaaggctggaattgccccccttgaatccaccaaacagtccccgcaatcaaagtgtgggctttgaccggcccagggaaacttgcccctccctccggctgggtcagggtgttattaacggggaaattgcatggttttatcggggaaccgggttctcccccccaggcttattcggggtttccccggaatgttccgggcctcgagattttccccccgtccagggatccaccgtgaataatcctcccttaccataacacggggggcattataagattcccatttggcccccccgccctttgttctctccaggcctctaacccgctcttccgtgg

SEQ ID NO: 93048 - DNA, 1120 bp, Zea mays
  misc_feature: Ceres CLONE 1582113
aaagctggagctcaccgcggtggcggccgctctagaactagtggatcccccgggctgcttgaattcgtctcacccctagaaaaagcgtcctctggcccattcagtcagtttctctcaatggccgagtccttattgcactcctaaccgacattgttttctgcccccttttcgggttgaccttcttcccgctagtgtagaggcgtttggtccccaatcccttggtctgagcagctggacctgatcatcccggaggtggtggatccataaaggccccgcacttctagtgggagcaacttgaaggtaaggaccaccaagggcgggccccccgtgggggaaaaaaattttggcctaagcggtgggaatacctaggtacaatcgtccctgtagaatttctaaccaaccgaagaggtggtttccccccaaaaaaaaaaccattcccctgaaaaaatttttttgggtaattcgggaaacccctgcaccagaggtttttttttttatggcctccacattgtgttttgcggccccttagaaggggggtgattttttaggtaaagacctcccgcgggggccccaaaaattacgttttttttggaaactttttttcctctagggggggggttatatttttactgggggaaattccccgaaattaccccgcctgggggaaaaccaccccgagatattctgcccctcgtgacatactcccttttctcccgcggaggggggggtaaattaatggtccctctccttcgggtggttaaaaaaaatttgtccatataaggcgttttgttcctttaacaagactttgggatttttatatttctcccaatatattaggtgtccagcacctactttggaatccaaatatttcacaatgaacaattttttatagtgaagaaatcgttggaaaaaactatgagatttttgtctttttacacacctcctgtggaaagatataacgagtttctcccccttccccgtctgctaatatttgtgggatgatataattacatatatgatcaatgtttgtaggcctttggcgtgtattttcttccacttttggagcagagggatggtgaatacgcgccaccttaaaaattgtctggaaaaatattgggtg

SEQ ID NO: 93049 - DNA, 1114 bp, Zea mays
  misc_feature: Ceres CLONE 1582114
gcggtggcggccgctctagaactagtggatcccccgggctgcaggaattcgtctccccctagaaaaaattgcaagcaacaggaggagaaaaaacaggagcgagacctcgcagctgacgcgcacaaggcaaaaccccaatcggagccgtggaccgggccggagatagggctcgagggcctggcaatccgaggcgaaggcgcagggagcggcgagtcccctccccgctgcctccttggaggcggcatctggggaaagagacctttccttcccgtggggggaacgggtcttattccctggtgtataacggaactggggcccccccgcggggcggggttctaggaggtgctttccttgaaattttataggggcagccccccctttttttttctcccccccaagggggggccctctttgggggaagcacccccctctgagtctcccggtggtgagaacaattcatctctttcttgtttttggctgtgctgttccgccctccccctcttttctctggttctttttccgggcgaggcccctcccccgttttcccatattttttgcttgttcttttcgttgatcgtgggttgcgcgtgatatatttctctcgtgtcggcgttggtttttcccctatggtctcctatccttttttttgggggtctcttgttgcgccttttttttttccctctttttatttttcaccctcccctcttgtttggcgggtgttgcccctttttggggttcgcgtgtgtgtgggatggccgtcctctctttgttgtcctgtgtctgccctccccacttgttgccacgttctttctttctccttctgttggggttagttcttcgcacctctggtctggtgttttgtgtccccccgtttttttctgtttcccccttttttcctacgcttttaccgttttttcgttgtgtagtgctacatcttcccttctccctctcgtgtttatccgactgtttcttgtgggtgttgagttcctttctgcggattgtgtttgcacccgtttcgatgcgcgacgcgcgcttgggcgttcctgtcttctttttgccctcgcgcgttatcttttacctctctcacttgagtggtaccctgtcacttcttgag

SEQ ID NO: 93050 - DNA, 997 bp, Zea mays
  misc_feature: Ceres CLONE 1582119
  misc_feature: Encodes the peptide sequence at SEQ ID NO. 93051
  misc_feature (421)..(421): n is a, c, t, g, unknown, or other
ctccccgcggtggcggccgctctagaactagtggatcccccgggctgcaggaattcgtctcacccctagaaaagttcctgctcctcggccctcgcaccgcgcgccgccgacgccgcatccatgaacggtgacggcagcaaggaggacgccaacaggcgcctcgagtgggccaccttgaacatggagcgcgccgtcgtcgtgagcgagacgacgaagggcgacggcaatggcaatgcaggccggaaggcgccgataagcatcgtccggctcttcttggcctgcatggtctccggcggcatccagtacggctgggcgctgcagctctccctcctctcgccctactctcagactcttgggatctcgcacagctacgtgtctctgacatggatctgcgggcctatcgccggatttgtgggtgcanccatcgtgggctactacagcgaccggtgcacctcaaagatggggcggaagaaggcctttcatcctgcgcggatgcatcatcatctgacctctcggtgttggggattcgggttctccggggaaattggggcggcgccctcggcgaaaccaagggaaccattggaatatgtttaccgggtttcccgttggttccccccccccccctttaacttttgggggattttggggtccccgaatttttcccaaaaaaaagggtccagggaaaaggttccccccaattagtggcaaaattgggccgggggaaaaaagggcccaactgttgggggaggattttttcccctgggggggggcccccccagaggggttttgtaatttttgtcggcgccaaccaaaaagggaaaagggttccctgttggaaaaaaccgggggtgtgatttatccaccccactaaggggccctttttgtgggggggggcctataaaaaaaagcttccccctttgggcgcggcgggagggggccccgaaataataaccccccggggggggtggttttttttttttttttaaaaaacaaaccc

SEQ ID NO: 93051 - protein, 193 aa, Zea mays
  misc_feature: Ceres CLONE 1582119
  misc_feature (101)..(101): Xaa is any aa, unknown, or other
MNGDGSKEDANRRLEWATLNMERAVVVSETTKGDGNGNAGRKAPISIVRLFLACMVSGGIQYGWALQLSLLSPYSQTLGISHSYVSLTWICGPIAGFVGAXIVGYYSDRCTSKMGRKKAFHPARMHHHLTSRCWGFGFSGEIGAAPSAKPREPLEYVYRVSRWFPPPPFNFWGILGSPNFSQKKGSREKVPPN

SEQ ID NO: 93052 - DNA, 834 bp, Zea mays
  misc_feature: Ceres CLONE 1582124
  misc_feature (716)..(716): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (792)..(792): n is a, c, t, g, unknown, or other
  misc_feature (800)..(800): n is a, c, t, g, unknown, or other
  misc_feature (801)..(801): n is a, c, t, g, unknown, or other
  misc_feature (816)..(816): n is a, c, t, g, unknown, or other
ggagctccccgcggtggcggccgctctagaactagtggatcccccgggctgcaggaattcgtctcacccctagaaaaagcacacacacacaagacacaacacaactcgtaggcagcgagcgtctctcctcttcctctcccacgcaccgcgccaaggaaggcagagagagatcgccgctcctcttctctccgtcggtggtgcggttgaccgccctcctcgagcgagatctcgctgcagtccctcgagatctggtcacagatctatccgacaagatggtgaagatctgctgcatcggtgctgggctatgtcggtgggccaacccatggcgggtcattgggccctcaaagtgcccaaaaactttgaaaggtttggccctttgtttgaaaatcccccaaaccccccccatttggggggttgggaaaagggaccccccccccctttttaaaaaccccggccctcaaaaatttttgggaaaaaatgggggggggcgggaaacccccttttcccccccctggttttgaaaaaaaacccccccccagggaggaaaaaaactccccccgcccgggggggaaaacccccccccccaaaaaaaccgggggggttttttttaaaaaaaaaaaaaacttcccccccccccccccccctgttcctgggggagaaaaaaaaccccccccccccatatatatttacacacaaagattttctccccccccccnttaaagaaaaaaaaaaaaaaatgtttgttgtttaaaaaaaaaaaaaacccccccaccnnnnnnnnnnnnnnnnncncccccccnntctcccttttggttnaaaaaaacccaaaacgga

SEQ ID NO: 93053 - DNA, 1333 bp, Zea mays
  misc_feature: Ceres CLONE 1582126
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (68)..(68): n is a, c, t, g, unknown, or other
  misc_feature (1063)..(1063): n is a, c, t, g, unknown, or other
  misc_feature (1135)..(1135): n is a, c, t, g, unknown, or other
  misc_feature (1141)..(1141): n is a, c, t, g, unknown, or other
  misc_feature (1147)..(1147): n is a, c, t, g, unknown, or other
  misc_feature (1289)..(1289): n is a, c, t, g, unknown, or other
tcctttcttttaagacgctttattctattttttggcccgcgatnnntatatanncacnnnnnnntttnttcccccccgtggcggccgctctagaatagtggatcccccgggctgcaggaattcgtctcacccctagaaaaaaatactagctggaccctttccactcccctctcctctcactaccaccaccactgtccctgatccataccatctgcagcagcagcgcgcgagagctatcttcgggcagtcgatacatcgatcaatcgctcgtccatcatatcacgagaagagcaagctctgctgtctacagagattatgaaccgccctttgtaccccgtccggcctggaatccggttctccggccttattcgagtgccgtaggcctgccacctgtcggagttttcggccgttttggagaatctccatgtgaagaacccctcggggtaccgtccccttcattcagggaaagaaaccccccctgtgcatcctgccccacattttttaggattggttgtggcgtcccacccagggggaggtatgattctcccccccgtttccagtctatgtgaaccccgcctttttggatgttgtgtgacggcatttgtgactttccttctctttccatctcactcggttgcccccgtagtgggattcaaaacggatagtcgggttgccccgcccggctatagataaacatggaccgcagattcctatgtttttcccccccttctgcagtgttctttctatttcgcttatcaatgatccccccgtaggtggtatctctcccccggttcctcactacaccctctaagtatctttgtgattatcttgagtggaactacctccgctcggtgagaaacctatattgctcccgaacgcccccccggctgttattctcggtcgtctcataggacggtaaatccgtaccgattgaggaacacgaacaactgcggtatattagacttcacctcccgcctcgggtggttgtctcctcttcgtgacttgatttacgatttgcgccgccctcttcatatatatgctctgctccgttttggagcgtganacagcgtattaatacgcccgtctggtggaagagtatggcgacggatggccaattatttattgtgccccatcngccganattatntctgtctgtctcagagtcttaacatcgcgagtgacgaccttcgtttggggaacagtgtcacctttcccaaatatacggtgtttgctagccgttcgccgcgcagtctcgtgtcacctgcgctgttgcatttttctccccagtncatatataaatggagatgccccccacacgtttgtcgtcgtattg

SEQ ID NO: 93054 - DNA, 1107 bp, Zea mays
  misc_feature: Ceres CLONE 1582128
gcggtggcggccgctctagaactagtggatcccccgggctgctggaattcgtctcacccctagaaaaaacttcccccctcatctctctccgttcattccagctctcatgcgtgcttgggttgggttgggtttgggtatagacagttcttgcagtccacaccacctcaagtgagggggtgaccccccaccctcctccctagcgctcctcaccgccatgctgccaagaaggcagagcatcttccacctcggggaaggagggtgagctctttcttcttgcaacaccactttaacgacatttgatctttctctttatccttggccaagagctgtgcagttggcggtatgctcactaagcttatcgccttttttttttctctatattctccccctccaccataaactactgtgctatggaccagctcattcttttaatcttcccctttcacctatatatttgtttttttcgtcgcatcttcgtcataccccattacctagtctttattctctttctccttttttatttcataatggtattgatagactttgctttacattttcttactcccttatctgtgtacgccctatattctaataaaaataatatccaatttgttacctcctttttttcattctttttgtttcttcttattactatctcgcccaatcattttttcttttcccctcttaacatatacccccgcctttttttttgtgtttacagtggatgattatctatagcccttgttttgtttaatcaaacgatccatggaactacctacccctttttatacactatgaaatttgtcgatatagtaagaattaggtatacccatactctttttactattttctcgcctcctcccatgtccccaccattttatatactccctctcctattagcatatgcatagattatcttttataacaatgtacgagaatacatacatatttgtattacctccttatattcagacaccgcctctctctcttgccgccccctcttatccattatttctctcccccgtttttactagatcaatcttacctttctaatgtaccgcatcactattctggcttaaatcatacctcatgattacttcttgtttt

SEQ ID NO: 93055 - DNA, 937 bp, Zea mays
  misc_feature: Ceres CLONE 1582129
  misc_feature (680)..(680): n is a, c, t, g, unknown, or other
  misc_feature (699)..(699): n is a, c, t, g, unknown, or other
  misc_feature (883)..(883): n is a, c, t, g, unknown, or other
  misc_feature (884)..(884): n is a, c, t, g, unknown, or other
ctccccgcggtggcggccgctctagaactagtggatcccccgggctgcaggaattcgtctcacccctagaaaaaaatgtatcggttcgaggtcccatctctcagtcatatgaatgtcctgtagttttactttatgctttttttccgctcagacattgcctactctgagcattttattcacacactttgtacccgccgttggatgattctgaataatcttggtgttcctggacgcgagttatgtttgcggaaacgagtgtacggacaaatgtatcagaatatctcggttaacgatctaaacaacaaatgctgctgcaaaaaaagcgcggcgtgtgtccaaggagagattctgatacatcggcaagaaacatgtttgtgccatcaaggccaggccaggaaacacaaacacccatcgcctcgcgggcccggccgccccctcgccccgcccgcatcctggtcgacgacgtacgacgacgtcgtcgtcgtcgccctctttcctttcccccacagccgcggctccatacgaccatacggcagccagctagtctagcttctccgccacagttcatcacggcgcatgcgacgaaaagctgccgatgcaccatcatgcaccagcagaggggagcaagcgagcgaccacgcgggggaccgcgtcatcgatgcaatcccctccttcctctntctttggcctccgatctcncatgcgcggtgggccgcgccgccgcgggcccgaggagaagggctatgatcattgaggcccttgccggcgccttatgggggaacccactggggggaaaataggggggagagcctaccggggatttgcccggaaaattaagggcggctggttcggcttcccccgccttttatggggccagtttttnntaaaaaaagggccaaaaagggggccgcggtaccaaaagggtttgggggcctct

SEQ ID NO: 93056 - DNA, 970 bp, Zea mays
  misc_feature: Ceres CLONE 1582132
  misc_feature: Encodes the peptide sequence at SEQ ID NO. 93057
  misc_feature (407)..(407): n is a, c, t, g, unknown, or other
ctccccgcggtggcggccgctctagaactagtggatcccccgggctgcaggaattcgtctcacccctagaaaaagaacggaggtcgagcaccagacctcatctcactccgctaccccctcatcctgccatccaccagaagcagtgcaagcatatggcgcgccgtgccagcctgctcctcgccgcggcgctgctcgtcgccgtcgctgccgcggcggtgccgccgacgtgcgagcgcatcgagtgcccggcgtacgaggtggtggacagcgccaacgggttcgagatccggcggtacacggacgccatgtggatcaccacggcgcccatcgaggacatctccttcgtcgccgccacgcgcaccggcttcctacagctggtcgactacatccagggcaagaacgcgtancaccagacgatcaagatgacggcgccgtggctgacccgggtggtgcccagcgaacggccctttgggccctccgccttcccgggaagcttttggggcggccaaaaaccagcgaaacccccccccggcaagggcctgcccctggaaccctgggccgggggccagaaaccggccctggccccctttcggggggtttctggggagaaccccacctcggggaaaaaggggggggggctttagggcccgcccccaggggacaccgggggggcgccccctctaaaaaaacgcggggggggaaaacggggccccctaaaaagggggggaaaaaaacacccccctttttttcccgggaaaaaaaaaatttgtgagtttttttcgggaaaaaaacaccctgttgtggggttccccccctccccccgcaccgggttttttgaaaaaaacccccccccgggggggggggccaaaaaaaaatttggtgtgcgcgccctttttttttttttttaagaaaaaaaggctctctcaaaaaaaaaaaaaagaaaaaacctctcgtggggggggacaaaaaa

SEQ ID NO: 93057 - protein, 163 aa, Zea mays
  misc_feature: Ceres CLONE 1582132
  misc_feature (28)..(159): Pfam Name: SOUL Pfam Description: SOUL heme-binding protein
  misc_feature (85)..(85): Xaa is any aa, unknown, or other
MARRASLLLAAALLVAVAAAAVPPTCERIECPAYEVVDSANGFEIRRYTDAMWITTAPIEDISFVAATRTGFLQLVDYIQGKNAXHQTIKMTAPWLTRVVPSERPFGPSAFPGSFWGGQKPAKPPPGKGLPLEPWAGGQKPALAPFRGVSGENPTSGKKGGGL

SEQ ID NO: 93058 - DNA, 990 bp, Zea mays
  misc_feature: Ceres CLONE 1582133
  misc_feature: Encodes the peptide sequence at SEQ ID NO. 93059
  misc_feature (519)..(519): n is a, c, t, g, unknown, or other
  misc_feature (520)..(520): n is a, c, t, g, unknown, or other
  misc_feature (523)..(523): n is a, c, t, g, unknown, or other
  misc_feature (524)..(524): n is a, c, t, g, unknown, or other
ctccccgcggtggcggccgctctagaactagtggatcccccgggctgcaggaattcgtctcacccctagaaaaaatggccccaaacgcccaaaccccacctccacgcctccaccccaccgtcctcctcctcatctcactcactcccttttcctcacgccccctccccgcctcgagcccctcgctggctcgctcccattcccatctcgcaccaccaaccttccggatccagtgccgcacgcctcactccccgtccccgacacccatgacacgcaagaggcgcaagcacgccgccgccaccgccgcctagggttccgatcccttcctcatggattcgctgccgcgtaagcgcaagggcgcgcgcgccgcgtgctccatggccggatcccgccacgatgcgcctgccgcccgcaagcgcacctgccgcgagcccaagccgcggcccgagaagaagaagccctcttccgccgatgagggctccgcctccgcccgcggcggcgtgggtttaaataaacggcgcnnttnntttatccgcttccgagccaacggtaccgcgcgtgttaacgttagggccagggtcaatgtatcgtttaccgtgcctatccttcgcgggggtctatgttggccgtatttttaatttctgggtaaactatgcccgcgcatttttctttggcccgttacttcagggtgcccttgtttggggccgtcccccggcctaagaaagagtaggagagggcgaatcctgtatcccctcctattacgcgtctgttagataaatgtcggccccacttgagtccctacgttggagttgcctaatatttatcgggtcattttgaagccggtttacgacatccggttgttcatatgcgagtgaaacacctccctatctgttcccccccattctactattatagtgccgcatgttcactgaggtctccaatgtttattctccgggattatttctcgcgactagataattattctagattata

SEQ ID NO: 93059 - protein, 102 aa, Zea mays
  misc_feature: Ceres CLONE 1582133
  misc_feature (65)..(65): Xaa is any aa, unknown, or other
  misc_feature (66)..(66): Xaa is any aa, unknown, or other
MDSLPRKRKGARAACSMAGSRHDAPAARKRTCREPKPRPEKKKPSSADEGSASARGGVGLNKRRXXFIRFRANGTARVNVRARVNVSFTVPILRGGLCWPYF

SEQ ID NO: 93060 - DNA, 1065 bp, Zea mays
  misc_feature: Ceres CLONE 1582134
  misc_feature: Encodes the peptide sequence at SEQ ID NO. 93061
  misc_feature (1065)..(1065): n is a, c, t, g, unknown, or other
acccagggtggcggccgctctagaactagtggatcccccgggctgctggaattcgtctcacccctagaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccaagatcccgtctcagcccgccgtggcggccgcgtccaccgagaggcaagcgcccgccgccgcgttgcaagggttcctgtgcctggaagaagtggaacggagggcgtggagctacctggtgggaaggggggggcccccaaaggggaggatcaggggcaggggccgtccccccctgggggccgcccgttaggggccgtggccctctgtaatttgacagattttccccctgggcgaggaaaaaaaaggggcaatttccacaaaaaaacacaatgtgggggccccagaaaagggtgtttccccaaagaaagggttttataccccctctccagagttgtttctcctcacaaggtaaacccgcgcagggggacctctctaaaaaacacaatttattccttgtgggcgtttacttccaatgggcaattggttttttttaaaaaagagaaacaccgtcgtcatatatttttcgtgctgaaaagtgtttctgcgaaaaaaggagggatcaactgcggggcggccctctgttgcttaacaacggttgattgcccacccttgacatttttctcgtgccctcgttttgataaaaaagccctttattatcgtcgaagagaaataagactggatcgattgtccaccacgttggtgcgcgtttctttacgaatgtcgcctggtgcaataacagtcggcgtaatattatttagcttgtatttccatcgttttgtgtggtgactctgctattaaaatttn

SEQ ID NO: 93061 - protein, 94 aa, Zea mays
  misc_feature: Ceres CLONE 1582134
MAPAVGLKRSATQTITLPPPDTRLAVRDVMRSKIPSQPAVAAASTERQAPAAALQGFLCLEEVERRAWSYLVGRGGPPKGRIRGRGRPPLGAAR

SEQ ID NO: 93062 - DNA, 950 bp, Zea mays
  misc_feature: Ceres CLONE 1582135
  misc_feature: Encodes the peptide sequence at SEQ ID NO. 93063
ctccccgcggtggcggccgctctagaactagtggatcccccgggctgcaggaattcgtctcacccctagaaaaaacccacttattcccctccagtgcggacaggcctcactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccggctcgtgctcgaggtggcgcagcaccttgtcgagaacttggtgcgcaccatcgctatggacggcacggagggcctcgtccggcggcagcgcgtcctcacactggctcccccatcaccgtgcctgttgggcagggctacccttggacgtattcataagggtttccgggagccaattgttgaagaaggggattttaggacaaaacccttctccccctttcccttgggaaaccccctgctttcttggaacaggccctggaaccaaaattcctggtacctggaaacaaggggggggtacttccttgcccccccccaaaaggggggaaaatgggtgtcttggcggtgggggagggggggggaaaatcgggcctttttgtgggagtataacaaagtgtgcaaaggcacgggggg

SEQ ID NO: 93063 - protein, 251 aa, Zea mays
  misc_feature: Ceres CLONE 1582135
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLVENLVRTIAMDGTEGLVRRQRVLTLAPPSPCLLGRATLGRIHKGFREPIVEEGDFRTKPFSPFPLGNPLLSWNRPWNQNSWYLETRGGYFLAPPQKGGKWVSWRWGRGGENRAFLWEYNKVCKGTG

SEQ ID NO: 93064 - DNA, 945 bp, Zea mays
  misc_feature: Ceres CLONE 1582136
  misc_feature: Encodes the peptide sequence at SEQ ID NO. 93065
  misc_feature (686)..(686): n is a, c, t, g, unknown, or other
  misc_feature (866)..(866): n is a, c, t, g, unknown, or other
  misc_feature (894)..(894): n is a, c, t, g, unknown, or other
  misc_feature (895)..(895): n is a, c, t, g, unknown, or other
acccgcggtggcggccgctctagaactagtggatcccccgggctgcaggaattcgtctcacccctagaaaaaacctctagctgcctcccttcggcaatggaggaggcgccaccatcttcttctcccccctcccctcctgtgatgctactcttgctgctgctgcttatcgtctcctccccttgtagctctagcgccctcctctcccccaagggcgtcaaccctgaagtgcaagctctgatgacgatcaagaacacgctcaaggacccccacggcgtgctcaagaactgggaccaggactccgtggatccctgcagctggaccacagtcagctgctcgctagagaacttcgtcaccggactggaggtcccaggtcagaacctctctggcctgctctccccaagcatagggaacctgacgaatcttgagactattctcctgcagaacaacaacatcaccggcctaatcccagcagagatcggcaagcttacaaagctcaggacacttgatctctctagcaaccacctgtatggcgcaatccccacttctgtgggcaaccttgagagcctgcagtacttgaagctcaacaacaacaccctgtctggcccattcccttcagcatcagctaatttgtcccagcttgttttcctagacttgtcatataataatctgagtggtccagtgccggnatctttggcaagaacattcaacatagttgggaatcctctcatctgcggcaccaacacgccgagagagattgctatgggactgccccaatgccgccatacaacctaacagctcactgcctcccggcaatatgtctaaaagcccatagtttgcaatgcatttggtacgcaattggctgcatncggctcctcgtctcgctgccgggttccnngtctggtgaagctcgtaaaaccggcaggccctttttgatgtcatgacaaa

SEQ ID NO: 93065 - protein, 231 aa, Zea mays
  misc_feature: Ceres CLONE 1582136
  misc_feature (40)..(80): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (197)..(197): Xaa is any aa, unknown, or other
MEEAPPSSSPPSPPVMLLLLLLLIVSSPCSSSALLSPKGVNPEVQALMTIKNTLKDPHGVLKNWDQDSVDPCSWTTVSCSLENFVTGLEVPGQNLSGLLSPSIGNLTNLETILLQNNNITGLIPAEIGKLTKLRTLDLSSNHLYGAIPTSVGNLESLQYLKLNNNTLSGPFPSASANLSQLVFLDLSYNNLSGPVPXSLARTFNIVGNPLICGTNTPREIAMGLPQCRHTT

SEQ ID NO: 93066 - DNA, 944 bp, Zea mays
  misc_feature: Ceres CLONE 1582140
  misc_feature: Encodes the peptide sequence at SEQ ID NO. 93067
  misc_feature (757)..(757): n is a, c, t, g, unknown, or other
ctccccgcggtggcggccgctctagaactagtggatcccccgggctgcaggaattcgtctcacccctagaaaaagcctgcagcgccagcgcagcgcctctctgctactgtgctggctgacgccggtggggtgtgagccaactgcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaaggggttcgtgttcgggacggcgacgtcggcgtaccaggtcgagggcgccgcgtccaccaacggccggggcccctccatctgggattcattcgcgcacgtcccaggaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaagggaaagtcaatccagaaagtgtagcgtattacaataatttgataaactatctgcttcagcaaggcatgactccttacatcaacctttaccactatgatcttcctcttgcgcctgagaagaaatatggaaggtggttaaacgcgaagatggcggacttgtttaccgactagcctgacttctgtttataacntacggcgatcgcgtaaacactgggttaccttcatgaagccaagaaagtagcgcttcctggctatgaccaaggtctattcccccccaaagggcccatattccctgcttggggaaattcgcaaccaaccctacaagttgcccatattttccctggcactgcaacggagtggcagatccctacaaattct

SEQ ID NO: 93067 - protein, 180 aa, Zea mays
  misc_feature: Ceres CLONE 1582140
  misc_feature (36)..(180): Pfam Name: Glyco_hydro_1 Pfam Description: Glycosyl hydrolase family 1
  misc_feature: SWISSPROT Homolog: EC 3.2.1.21 Beta-glucosidase
MDARWAVLLALLVASGGVRVCAAAGAKGANWLGGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPESVAYYNNLINYLLQQGMTPYINLYHYDLPLAPEKKYGRWLNAKMADLFTD

SEQ ID NO: 93068 - DNA, 949 bp, Zea mays
  misc_feature: Ceres CLONE 1582142
  misc_feature: Encodes the peptide sequence at SEQ ID NO. 93069
acccgcggtggcggccgctctagaactagtggatcccccgggctgcaggaattcgtctcacccctagaaaaaaaaccacacccatcgcacccagccagccctcgccatccatggccgccaccgccgccatccacctgcgcccgctccgttccgtcgccgtctcctccgcgaggtcacgctcgctcctccacctcctcgcccggcccctctcctcttcccaatcgtcctacgcctaccgcccttcccctacagcgcccgccgcccccgcccccgcccccaaccatgtccaccaccctctccatcaccaccagtcggtggcctcccccaggaccccctccacagtggtccgcgcagggacatccgcctccgccgccccgtggctatgggcctccaccgccgcagcaccagcatgtgccgcctccgccaccacgcggctacggacctccaccacgcggctacggacctccaccaccgcctccgcctccacacggccacgtacctccgccgcctccgccgcgacacggccacgggcctccaccaccgggccagcacgtactgccgcccctgctaccacacggccacggacctccgccaccgggccagcacatgccaccgccacacggccacggccctccaccaccgggccagcgcgttacggcgccttcgccgccacaaaggcacggtgctccgccaccggggcagcacctacgggcggcctctacggccaaagggcaaggttcctcacccccgcaccagcaggaaccgccgcccgcctgatcccgtggctgggcctgggaagctgatgggactgtgccgggaaggggcgggttaagaatgcccggtacctcctctcaaggggggccgcacggacctggacaccttctagagctcggggcacctggtccacccaaagtggttggagagctaggaaggggcccattttttttcc

SEQ ID NO: 93069 - protein, 164 aa, Zea mays
  misc_feature: Ceres CLONE 1582142
MSTTLSITTSRWPPPGPPPQWSAQGHPPPPPRGYGPPPPQHQHVPPPPPRGYGPPPRGYGPPPPPPPPHGHVPPPPPPRHGHGPPPPGQHVLPPLLPHGHGPPPPGQHMPPPHGHGPPPPGQRVTAPSPPQRHGAPPPGQHLRAASTAKGQGSSPPHQQEPPPA

SEQ ID NO: 93070 - DNA, 1112 bp, Zea mays
  misc_feature: Ceres CLONE 1582143
  misc_feature: Translation starting site: 168
  misc_feature (1112)..(1112): n is a, c, t, g, unknown, or other
cggccgctctagaactagtggatcccccgggctgcaggaattcgtctcacccctagaaaaaactcgcacttcccaaccctggatccaaatcccaagctatcgcagaaccgaaaccgaggcgcgcaagccattattagctggctagctaggcctgtagctccgaaatcatgaagcgcgagtaccaagacgccggcgggagtggcggcgacatgggctcctccaaaggacaagatgatggcggcggcggcgggagccacgggaacaggacgaggaggacgtggatgacctgcttggccacgctcgggtacaaggtgcgtttcgtacgatatggcggatgtcccgcagaagctggaccaactccagatggccatgggggatggccccccccgggggggggccggcgctacggctgatgacggggtccttgtcccacctttcggcaacgaacaccggggactaaaatgacctcccgaacctggcgttcctggggtgtcgaaaagattgcttttcccaaggtccaaagcggccccccaaaagcccggtcccgtgccttggaaagccccggggccccaaagagttctgtttgcaaaatccttccccacctgtttataaagtgtggggcccccccgcaccgggggggggggctatatttctcgatattccccccccccccgcggggggtgaaattttttttccaagcaactaaccctataacgcccttcggtgaaacaccctatatcctcccttcggccccgggggggtgggggagcaccctgtagcgcgccgtaaccctgttcgcagagagaaattcggggcccccgggagatctctctatcccgcaaaataaaagatcttggggtgcgtgagaaactcagccgtattcatcccgtctctccccccgttgtcctatacaatgatttgggggggtcccacccttgagaaatctcctggggcccaaaatttcgcccaccccgggcaaaatatcataatcctcgaggagaactaatggagaccagcgggtccagttgtgtgggggggggaaaccccaaagaggtggggaacacggcgctcgcgacttaaattttggtggcggggaggagtatgtcctcatn

SEQ ID NO: 93071 - DNA, 962 bp, Zea mays
  misc_feature: Ceres CLONE 1582148
  misc_feature: Encodes the peptide sequence at SEQ ID NO. 93072
ctggagctccccgcggtggcggccgctctagaactagtggatcccccgggctgcaggaattcgtctcacccctagaaaaagcccgccgtaataaatagacaccccctccacaccctctttccccaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccatttgacaacgtcaggccaagatccaggacaaggagggcatccctccagaacagcagcggctcatctttgctgggaagcagcttgaggacgggcgcacgcttgccgactacacattcagaaggagagcaccctccacttggtgctgcggcctcaggggaggcatggcagatcttcctggaaaacctggaacgggaaaactattacccctcgaaggggaatctttccaaaaccaatcaaaaaagttcaagggccaaatcccaggaaaagggggggatttcccccaaaaccaaaaggggggttatttttttgggggaaaacaactttgggggaggggggcacccctggggcaaattaaaaaattccaagaagggaaaagcccccccccccgtgtgggcgtgccgccccgcggggggggacgagcgaaaattttcgggagaaacacccctggggggggaaaaattaccc

SEQ ID NO: 93072 - protein, 99 aa, Zea mays; identical to SEQ ID NO: 66107
  misc_feature: Ceres CLONE 1582148
  misc_feature (6)..(74): Pfam Name: ubiquitin Pfam Description: Ubiquitin family
  misc_feature: SWISSPROT Homolog: EC 3.1.2.15 Ubiquitin thiolesterase

SEQ ID NO: 93073 - DNA, 944 bp, Zea mays
  misc_feature: Ceres CLONE 1582149
  misc_feature: Encodes the peptide sequence at SEQ ID NO. 93074
  misc_feature (644)..(644): n is a, c, t, g, unknown, or other
tccccgcggtggcggccgctctagaactagtggatcccccgggctgcaggaattcgtctcacccctagaaaaactagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatccccgcgggcacgctcgggcggctcacaaatctcgcgtgctctcgctccgctccaaacgcgtcctcgggaccgcccccgacgacgtgctccagcttgccagcctncggacgctgtttctgcaacagaacctgctctcccgccccatcccgacgggatccagaagctcggcggcctcgagcgcctcgtgctctcccaaacaacctctcgggcttcatcccttcgcgctcaactgctcaccgcgctgcgagtgctcagctcgacggcaccactctccgggagcatcccagcattagatcgcggggtcggggcttgacgctccgaacaacctaaagggtcatcccaattcgtctccattccgggggatcttcgcggaaactccatcttgggggacccgtcgcccgcaa

SEQ ID NO: 93074 - protein, 195 aa, Zea mays
  misc_feature: Ceres CLONE 1582149
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (121)..(121): Xaa is any aa, unknown, or other
MAGPSVPAAALAALLAVAALTCCAVAEPPPSERSALLAFLTATPHERRLGWNASTPACGWVGVTCDNANSTVVEVRLPGVGLVGAIPAGTLGRLTNLACSRSAPNASSGPPPTTCSSLPAXGRCFCNRTCSPAPSRRDPEARRPRAPRALPNNLSGFIPSRSTAHRAASAQLDGTTLREHPSIRSRGRGLTLRTT

SEQ ID NO: 93075 - DNA, 1212 bp, Zea mays
  misc_feature: Ceres CLONE 1582151
tcgtttttgctccctcctccggccaacctcattcgcatctggttttctgcccgcccctttttctttcctgtaagagggtttagtaggcggccgctctagactagtggatcccccgggctgcatgaattgcgtctccccctagaaaaaacaccaccactccttccctgccctctcactcccgatccctcctccaccaccgcttcctccgcgagccccctctcgtgcttcgcctcacgaggcgaccagcggcggaaccctccgcggccgcacccatgggggcctcttcaccggtgaagaaagaatagcagcacgcccgttcgacgggcaaaaaccccgggacccccgggccctccgaaagaaaggtaacgggattcaggggggcccattatctcgcctaaccttggttcaaacatcatctcaatggccctttcctgtgtgaccaagtttatatgtgtcaacatttttttttgttctccggggtaaaggccccccctctttctttaaataagtctggtttcttattctctaaccaatattgggttgcctgcccaatggagtcaaaaacctgtttttggggcttggaaaaaaaaaagtttctccttgtcccatctccccggggggtaattctgcctggtccttcctgtgaaaaatacattctgtttggccgaagtggaaccataagggctaatctggttgtgcctctcctttctttggtatcgcgagtccactaataatcccagggggggtctccttaaggaagggaaccccccgggtggcttaaattacatcaaccgtggtaaaaagtggtgtggggcgcctgtcccctctatataattccggtttcgcggcgctatacaattttttctccccgtggattttatcgcaccgcgccccccccaaaaaaaattcctccctttctcgtgagaagaaccctcctgaatgagtatggggatataatatcccgcttctttttccgtgcagtaattagaagattctgtgggtggataccaaccatggtcccccctttttaattatgatatagtgctttttaaacccacccgccgcttgtcctttctctctttgtcttttgtgaattataatcttttttttttttccgagaccagtactaaaatgggatttcactcttccccatcggttagatactctgtttactaatacccgatccctcctttttgttgctctgcactcctt

SEQ ID NO: 93076 - DNA, 1213 bp, Zea mays
  misc_feature: Ceres CLONE 1582154
  misc_feature: Encodes the peptide sequence at SEQ ID NO. 93077
  misc_feature (11)..(11): n is a, c, t, g, unknown, or other
  misc_feature (16)..(16): n is a, c, t, g, unknown, or other
  misc_feature (59)..(59): n is a, c, t, g, unknown, or other
  misc_feature (66)..(66): n is a, c, t, g, unknown, or other
  misc_feature (67)..(67): n is a, c, t, g, unknown, or other
  misc_feature (864)..(864): n is a, c, t, g, unknown, or other
tttttgtgttnactanctaatccaaaaaaaacatacctatttttaaccaccccccccantacactnntttttcaaactgggactcccgcggtggcggccgctctagaatagtggatcccccgggctgcatgaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccagggctcacgtgggaagggacctctgctgtcaaccgtggcctcttgggcccccggcaaaaacgccagacccgttgcttggaacgaggcttcaccgggggtaaccccggaagccccggggtttcgccttgaaccgacgccatcaatgggggggccccctctggggggatcccgggccaaaaggttcccaacccccttggcttccggagcagcaccccttcttgtctcgggggctcggtctcttttcgggccacgcaccacaagaggagacccatttattcccttctcattacccgagggggcaaaaaacgccgggtggccttttcctcttccacaaaaggcggggcctcggcccanaaggaggtgccacagagaagccttaccttcccctcttttagcggagccgacaccgcccctgggacggattataacgcttggcaaccgcgcccgggggaaaacgagaaacacaaaccctgtagaatatgcgggggaaaaccaccttttaaaacacgggtgtgccccccgcgaatgaaaccaaaatctcggggcttaacattctcgtggggacttgttctatgacgtgtgattgctccgggaaaaacaaaaaattacccgcgccggggggagggaacacaaagacccccgccccccttggtgtggggaaagagggcaacccactcccctctcaaaaaaattggggggcttt

SEQ ID NO: 93077 - protein, 105 aa, Zea mays
  misc_feature: Ceres CLONE 1582154
MRRVGGDLQGDGTTPRSAAAGQAMMELQANGSAAVGGAMVVGLSPLSEALWRDSKALPPGAGPAALIGDVSARAHVGRDLCCQPWPLGPPAKTPDPLLGTRLHRG

SEQ ID NO: 93078 - DNA, 1185 bp, Zea mays
  misc_feature: Ceres CLONE 1582155
  misc_feature: Encodes the peptide sequence at SEQ ID NO. 93079
tttctcttttatccttcctacaccctattattcatatgtaatatgaacaagaataagggtaataaaattttaaaactggagctccccgcggtggcggccgctctagaactagtggatcccccgggctgcaggaattcgtctcacccctagaaaaaaccccagctcactcgtgccgtgcactcgtcccgtccccctccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgaccctcggctgcctcgtcgtcgaccgcaaggtcttcatgtggaccgtcggcaccggtcctcggccctcgagcgtctttcatcggctttcgtccatcatgaatcgttcaaagctcgttcccgacacaaagcgctccccccgtccgcccgtccggccccggacccagttacaacgccaagggcggcctggcaacaaaggggcggccctcaatggtttccctttcaaaacggccggcaagaacggaaattcccggggccccccggccctgtggtccgaaaaaaaatcaaaccaataatggaggcccgtttgaaagcccttgtggaaagagggggggccaaacacttccgcttgggcgcatggtaaaagggggaaagggggcccccttcttcctccgaaacagaggcataccccggttcctcgtgtcccgggaaagacccctgggtgtcccgagagaggggccttttccttacacaaaacccccgggggggggaaaactcccccatttgcaagaggtttttaatactttacccccccacgaggggaaaatgggtgtcccacatggaacccaattggctttccaggcgtgggaagagcgtactcttctccagagtaacaacgggtcgcccaaagtaaacgaaagggcccaatctgtggggagagcttcttcaacccaattataaag

SEQ ID NO: 93079 - protein, 181 aa, Zea mays
  misc_feature: Ceres CLONE 1582155
  misc_feature: SWISSPROT Homolog: EC 3.2.1.4 Cellulase
MFGRDPWGGPLEISNADSATDDDRSRDLDRAALMRQLDETQQSWLLAGPGDQAGKKKKRYVDPRLPRRRPQGLHVDRRHRSSALERLSSAFVHHESFKARSRHKALPPSARPAPDPVTTPRAAWQQRGGPQWFPFQNGRQERKFPGPPGPVVRKKIKPIMEARLKALVERGGAKHFRLGAW

SEQ ID NO: 93080 - DNA, 1088 bp, Zea mays
  misc_feature: Ceres CLONE 1582156
  misc_feature: Encodes the peptide sequence at SEQ ID NO. 93081
  misc_feature (10)..(10): n is a, c, t, g, unknown, or other
  misc_feature (11)..(11): n is a, c, t, g, unknown, or other
  misc_feature (17)..(17): n is a, c, t, g, unknown, or other
  misc_feature (18)..(18): n is a, c, t, g, unknown, or other
  misc_feature (39)..(39): n is a, c, t, g, unknown, or other
  misc_feature (72)..(72): n is a, c, t, g, unknown, or other
tttctctttnnctcctnnccttatactgttttagtatanccatccccacccaagcgtgtggatataaatttntctcaaactgggagctcccgcggtggcggccgctctagaactagtggatcccccgggctgcaggaattcgtctcacccctagaaaaattacagagtcgaagtgcgctgtggcctgtggactctcccctccccaactccggcgaagggagcagaaacgttggcgtgttggttgggtggcgtcggcatggacgaggcaacgaagaagaatgtggaggctacggtgctggagatcctccggggctccgatatggagtccgtgacggagtacaaggtccgcgccgctgccagcgaccgcctcggcatcgacctctccatacccgaccgcaagctcttcgtccgcggcgtcgttgaggaatacctactttcactctcctccaaggaggaggcgaacgcggaggaggagggcgtcactggcagggagagcaagggcaaggaacacgaagaggaggacgaagaggatgaccatgaggaggaggatgaaggtaagggtggcgggaagaaagagtacgatgaccaaagtgaaccttatcccgtgccgccttttctagcaagaaaaaggggtgacttttattcggaatttaaaggggcagggtcgtaggggtggtcccatccgcccagattcctaccttaaaacggacgggtcaagggaaaaatgcccccttccaactcaaaaaaggctaattgcccaggaacccctggttagtttttcacaaggcgatccccttcaggaaaagttttcttttctaagtcgcccaaatttttatctcgcccttttacccaacatgtggctgtccctaacccttcgatataacctattttacaaaaataaacctccctgcgtttgaagatacatacggaacctctccgtggcctttatcccggaataatcttggaggaattgggcatgttctccaccgcagaaattactctttggtacggaaaaattgtcttttttacaataaccgggaggcatagaaggtaaaatctcgcgtggaaaaaaacttgctaaataggcc

SEQ ID NO: 93081 - protein, 137 aa, Zea mays
  misc_feature: Ceres CLONE 1582156
  misc_feature (5)..(60): Pfam Name: DEK_C Pfam Description: DEK C terminal domain
MDEATKKNVEATVLEILRGSDMESVTEYKVRAAASDRLGIDLSIPDRKLFVRGVVEEYLLSLSSKEEANAEEEGVTGRESKGKEHEEEDEEDDHEEEDEGKGGGKKEYDDQSEPYPVPPFLARKRGDFYSEFKGAGS

SEQ ID NO: 93082 - DNA, 799 bp, Zea mays
  misc_feature: Ceres CLONE 1582163
  misc_feature: Translation starting site: 112
  misc_feature: Pfam Name: Dor1 Pfam Description: Dor1-like family
  misc_feature (773)..(773): n is a, c, t, g, unknown, or other
ggagctccccgcggtggcggccgctctagaactagtggatcccccgggctgcaggaattcgtctcacccctagaaaaagaactcacgactccagatctcccaccgctcgccatggacctcctcgacgcgaggcaccgccacacgccggattcgagctcctccccacatgccgcctccgacatgggtctcccgctcgccggggctgcctaccagccctacgtctctgagctcctctccttctccatcgagcgcctccacaaggagccggagcttctgagggtcgacgcggagcgagtgcggcggcagatgcaggaggtggcggtggagaactacggcgccttcatcgccgcctccgaggcgctctccttcgtccgcgcgcagctcgagagcttcgatggccacctcgaggccatgatagaggagataccaaacttaacatctggctgcactgagtttgttgagtctgcacaacaaattctggaggagaggaagcttaaccaaacattactagccaaccacactacattgcttgacttgcttgaaatcccaccatttgatggacacgtgtatacggaatgggaactatgatgaagcacttgatctacaagcttttgtgagcaaaatatcgaagttgcacccagatttacctgttggtccaaggatagctgctgaagtaaaagagacagtacaatcattaatttcccagcttctccagaaaactccgatcaattattcagttacctgaaagccctccgtattgtagcacatctgcntcgaaattggaattttcagtggagtt

SEQ ID NO: 93083 - DNA, 1096 bp, Zea mays
  misc_feature: Ceres CLONE 1582166
  misc_feature (1096)..(1096): n is a, c, t, g, unknown, or other
ggttgggggagtttggtgtgaatttgaagcacaaccagcgctagcatatctgtcttttaaacccgcgccccttccccaacaaatgctacccgcgtggcggccgctctagaactagtggatcccccgggctgcaggaattcgtctcacccctagaaaaaatcccaaatcccttgtgaacctcctaaacctaagcgatggcggtggcggcatcgccgtatttcctcttgctcttcctcttccattcattagctgcactcgcctccctcgcgccaccgccttctcagccaccaccgccgcgggtgcctcagaaagtgcaggtgtggcccaagccggtgtccatctcgtggccgttgccggcatacgcgccgatctccccgtcgttcaacatccgcgcctcgccgtcgcacccgtcgctccgtcacgccatcgcgtactacacccgcctcatccgcaccgagcggtacacgccgattatgccccccgtcaactacaccgtctcgggcgtccccatccgcctgctcgcgctcttccgtctccgatctccgacgtccccgctcggccccctgcgttcaaccaaatcctaacacgctcttccgtgcccaccccaatttcccgcctctcgcctgaacaatctccttcccggcccactccccctgggggccatccattccgccgggttctcccaagaaccctttctcccccagccttccgccctgggaagacaagaccgggcggccccccccgaaaccccgaagaccggggcccaaagccccgaaatttgttccccccacggggcaaagaatataaaaaaaattcttcccggaaaccaaccccccctgaaattacaccccccacccccgcggggggaaatcctttctctttcgaaaaacccggttagggggaaaaataaccaaaaccccccggtcccggtgaaaaaatatcctttgccgaaaacccatttccggggcgcccaatgtgtgcccctcccaaacacaagctgtcacaagggttaatttccccacttgggggcacacacattaacccaaaacatccccaaagtgcccattttccccccacacaggtacccacccccccn

SEQ ID NO: 93084 - DNA, 850 bp, Zea mays
  misc_feature: Ceres CLONE 1582172
  misc_feature: Encodes the peptide sequence at SEQ ID NO. 93085
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (813)..(813): n is a, c, t, g, unknown, or other
  misc_feature (816)..(816): n is a, c, t, g, unknown, or other
  misc_feature (818)..(818): n is a, c, t, g, unknown, or other
  misc_feature (827)..(827): n is a, c, t, g, unknown, or other
ggagctccccgcggtggcggccgctctagaactagtggatcccccgggctgcaggaattcgtctcacccctagaaaaaaaccgaggccacaggccaccaccattccttccttgttccttccccagctccgcaggctgctcatcgccctccctccgcgcccccgatccagatccagatccaggggcttgtcatggcatccaaacgtatcctcaaggaattaaaggacttgcaaaaggaccctccaacatcatgcagtgcaggtcctgctggtgaggatatgttccactggcaggcaaccatcatgggtcctcctgatagtccatatgctggaggtgttttcttggtgaacattcatttcccgccagactaccccttcaagcctccaaaggtatcttttaagacgaaggtcttccatccaaacatcaatagtaatggaagcatatgtcttgacattcttaaggagcagtggagccctgctttgacaatctctaagtacgaggcgacagcccgcagctggacccagaagtacgccatgggatgaaatgttcggcgttactggctaaatgcagacgattgtggtgttgcccatgaaactgttatcggggacgtatgttcttctgttccttgtgcaattctccgatccatctctaggatccgagttctagtccaacaattaacctaccattgcccttgggtaaatgagatgacttggtgccttgctgtgggaaaccaatgcctagtgtttggaggtttaaggaatccccaattgaagggctttgtttcaaaannnnnnnnnnnnnnnnnnnaacaaanaananaacaacaanaacaaacaaaccacaaacctaca

SEQ ID NO: 93085 - protein, 116 aa, Zea mays; identical to SEQ ID NO: 85072
  misc_feature: Ceres CLONE 1582172
  misc_feature (5)..(110): Pfam Name: UQ_con Pfam Description: Ubiquitin-conjugating enzyme
  misc_feature: SWISSPROT Homolog: EC 6.3.2.19 Ubiquitin--protein ligase

SEQ ID NO: 93086 - DNA, 1329 bp, Zea mays
  misc_feature: Ceres CLONE 1582173
  misc_feature (1036)..(1036): n is a, c, t, g, unknown, or other
  misc_feature (1163)..(1163): n is a, c, t, g, unknown, or other
ggtgtgttggtgggggtagggtacgggcgcggcggcccctcccgtctatttaaaatttaagctttaccccacccaaaaacgaaccccccgcggtggcggccgctctagactagtggatcccccgggctgcaggaattcgtctcacccctagaaaaaaaccgaggccacaggccaccaccattccttccttgttccttccccagctccgcaggctgctcatcgccctccctccgcgcccccgatccagatccagatccaggggcttgtcatgggcctcccaacgtatcctcaacgaattaaaagacttgaaaaaggacccctccaacatccatggcagtggcaggtccctgcatggtgaggataatattccacttgggcaagggaaaccattaatgggggtccctccctgaaaagaccaaaatgcttacagcgtgtttttccctggcgagacataaaatttcccttctagaccatcccccttttgaagccctttaaaaggtattccttttactgaccgaacggtcttttcccttcccgaacacacaaaatagccataggggaaacccgtattccctcccttgcacacactctcttaagtgaaggacttcggaacaccctctggctctttttacaaaaatttcctcaaaactaacaaacaaccgataccatccccttccgcgccgggaacccccctgaacattatacctgacgtgggagaaagaaaaagggtccccgggctcgcttactcgtggttttataatgttcgagatatcgttgtgtgatgaccttggagttgctcctgatgaggcagaacaattagtatgtagcgcgcggtagcaacgcccaaggacgtcattaacggttgctcagggagcgcgccaccagacgctcctctacatactctaactcgtcatctatccacattatgtccctaaagggatggttctcttgacctagattaaattagaacacgtcactcacacatatataatatccgccgtatatgcagtctgttgatcgcatgaggtgggaatantataacgtagatgtcaccatatttgttagtcataacacgtgtccctgctgtcgtgaggtgtcaggctatagcccggcgaggaggggatgcggcgcgtagctttatcgcagagcgcaagggatccccncctgtcataaggcgacgcgcgtgctgtttcaaggtgctattcacggcaactcggaccgctgtgcggtctctaatatcgcgttatgcactcttctcgcacggacgcctacacaagcccacgtgtgtgaaagatgagagcggcgcatgtcccctgtgctccgacttcg

SEQ ID NO: 93087 - DNA, 893 bp, Zea mays
  misc_feature: Ceres CLONE 1582175
  misc_feature (893)..(893): n is a, c, t, g, unknown, or other
acccgcggtggcggccgctctagaactagtggatcccccgggctgcaggaattcgtctcacccctagaaaaaccctccgtaggcaaggcaaggggggcaaggctctaacggagatcggatcgaactgcctgtgcagtctccctccctccctccctccctccctccctccctcatgtccatatataccaaaaaatctccgccgcgccgccattagctagctctcgtcgtcttcgttcctccgcaaataatttgttactcaagccgaaggaggacgagggcgacgggattggctaatcaaatcgaccgatctagtggctggtgcccaggagaagggacgcgggcagtgcggctcgtcgtggtcagcagcttgtggcgaccggtcgccagggaatcaatcaattcaatcagaaagttgcaattttgattgagctcgattcgtcatccacaagacattagggaatcgaaaccacacaaagcaagaaagcagtccagtgccgaggagagagagagagaccaggaaaaaaaagagaaaggggaaaaagaagcaaagcaatggatgccgccctcggctttcgtcgtcttgggaaaaaacctggccccccgcgcctgggaaatccaacaaaaaaagggggggccgcttcccccctggcccgtaaaaaaaaaaggaaacccccccccccctcaaaaaaaccggaaaaatttccaaaaaaaacgggccacacaaaaaaaacggttaaacccttgggaaaaaaaatggggcttccccctccacaaacggggggataaaagggcaataaattttttaaaaaataccttgaaaaaaaaaaggggccccccaaaagagggaaaagggggggacaacattgcgcttctcctcataagatgagggaaan

SEQ ID NO: 93088 - DNA, 936 bp, Zea mays
  misc_feature: Ceres CLONE 1582176
  misc_feature: Encodes the peptide sequence at SEQ ID NO. 93089
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (53)..(53): n is a, c, t, g, unknown, or other
  misc_feature (55)..(55): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (262)..(262): n is a, c, t, g, unknown, or other
  misc_feature (263)..(263): n is a, c, t, g, unknown, or other
nnnttttnttttttttttgtgtcgtccttttttccctctccnntntnnnttcncnttttggtnnnnnnnnnnnnnaagttggagctcccgcggtggcggccgctctagaatagtggatcccccgggctgcaggaattcgtctcacccctagaaaaacaaatcctcctcctcctcctgccgcagcccgcagggaggtggagttgtcaacgtgccgaggactggagcgcccgcgtccggcgtctctataaacgagaccgcccgnngccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactcccgccttcccacatgtcacccgccatggttcggcggccggcgttgctcagccctgccctacgcccatgtcccgagcttgggcctggggcccctggcatcccccgttgcttggtggttttccctggggttaaacaccccctgtacaacccctgggggcacaaatggggggaaaaattcacccaaaaatgggtcccccccgggaaaagccggtttcccaccccgtttaccccccaaaacttgggggcaaccaccccccgttttcgggggaacccgggcttggggccctcggtgggaactctggggggccccccaaacccacctgggtgccctcccaaagggggggggcgggtaaaacaaccccggggaacaccgggggaaaccccggggcggggaaatatcccccctgaaaaaaagattttccccccacc

SEQ ID NO: 93089 - protein, 158 aa, Zea mays
  misc_feature: Ceres CLONE 1582176
MGTQAPENYPAEKVQDARSAREKAIDDWLPITSSRNAKWWYSRLPTCHPPWFGGRRCSALPYAHVPSLGLGPLASPVAWWFSLGLNTPCTTPGGTNGGKNSPKNGSPPGKAGFPPRLPPKTWGQPPPVFGGTRAWGPRWELWGAPQTHLGALPKGGGG

SEQ ID NO: 93090 - DNA, 1150 bp, Zea mays
  misc_feature: Ceres CLONE 1582183
  misc_feature: Encodes the peptide sequence at SEQ ID NO. 93091
  misc_feature (10)..(10): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (46)..(46): n is a, c, t, g, unknown, or other
  misc_feature (50)..(50): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (91)..(91): n is a, c, t, g, unknown, or other
tttggtggtngnnnnntnncanncnttctttttgttagttacaacntccntctatttttagtcttnnntttcaaatacggaactccccagngtggcggccgctctagactagtggatcccccgggctgcaggaattcgtctcacccctagaaaatgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcagaggttcagcactgcagcagcagtagaggagcccatcacgccgtcagtccatgtgaactacacaaagctcctcattaatgggaactttgttgattccccatcccgccagacctttccaaactctggaaacctcgtacagggggagtggatttgctcctgttgggctgaggggggacccccaaaggaacattaaccccgggccagtaacctggccggcttccccaagggcctttttgaaatgaaaaggggccaattggcccccaaaaaaataaactcggcccctatgggaaaaaagtgcccccccgttatttcctcttaattacccgggttttttgcccctgaaatatttggaataaaggaaaaaaaaagacgccccacattgtggtgacggaaagcgcctttgggggcggggcgtttttttgggggaagaaaaaaccgtgggggaaaacaaaccgcggggggagaaaaccccctcttttttgttgaagccaaaggcccggccccccccaaaattttttgaaatagacaccccccgtgggggtgggcgcccccccccctctattagggccggcattaatctatcctcctccgggtgttggacgccccatataaaataataaccccgggggggtccccctttttttgccccccctcctttatgggccccccccccccccgttgtaaaaaaatctggcgggagtgagaccaatttgggttgtttgtagggggacataaaacccccccggggagacctcccctccccatggaggtttgccccccga

SEQ ID NO: 93091 - protein, 111 aa, Zea mays
  misc_feature: Ceres CLONE 1582183
  misc_feature: SWISSPROT Homolog: EC 1.2.1.3 Aldehyde dehydrogenase (NAD(+))
MARRAASSLVSRCLLARAPAGAPPAAPSAPRRTVPADGMHRLLPGVLQRFSTAAAVEEPITPSVHVNYTKLLINGNFVDSPSRQTFPNSGNLVQGEWICSCWAEGGPPKEH

SEQ ID NO: 93092 - DNA, 832 bp, Zea mays
  misc_feature: Ceres CLONE 1582184
ggagctccccgcggtggcggccgctctagaactagtggatcccccgggctgcaggaattcgtctcacccctagaaaaagtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagttgcagtaactgcgtgaaatgctataccggagatgccattgtgcacggaggtggtttattttgaggaagagtcgggacacagtttggtgaattttgttgtgtgctggtctgagagctagtgctgctgggattgaggaaatgcaagttaataatgaggcaccactagggtgcctcaagccaaatatttctcagtataactctccagagcagataggtggtgttgaagggtttcctgagaataatgaaaaaaggaatgatattgttgctgcagaaaaaatctgggaggcgactccaaaccaaggccttagcaggcccatctaccgacaagaattttatgcctggccatatatttattcagattatcaaatcgtgcgtcagccactaccttatggttttgacaaccaattttatcagataaatagggaccacggtttccctattgagaacagggttcaatatcttccattcaagatgctccctcaaggtcacccccatgatgcacagcttcaggaatttcagtatttttgtggttattgactttgaaagcaccctgtgacaggtgaacaatcccattcccacagaaatcatcgagtttccatctgt

SEQ ID NO: 93093 - DNA, 806 bp, Zea mays
  misc_feature: Ceres CLONE 1582185
  misc_feature: Translation starting site: 293
  misc_feature: SWISSPROT Homolog: EC 1.11.1.6 Catalase
gcggtggcggccgctctagaactagtggatcccccgggctgcaggaattcgtctcacccctagaaaaatccctccattgtttcccggctctccgtcccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcagcccgcccgctcgacgtgatcccaccggcagccatggatccatacaagcaccgcccgtctagtgggagcaactccagcttctggaccaccaactccggcgcccccgtctggaacaacaactctgccctcaccgtcgagacagcgaggtccaatcctccttgaggattatcatctaatcgaaaagcttgctcagttcgacagagaacgtatccctgaacgtgttgtgcatgcacggggagccagtgccaagggtttctttgacgtcactcatgatgtctctcaccttacatgagctgattttctccgtgctcctggggtccagacacctgttattgtccgtttctctacagttgtgcatgagcgtagaagccctgacaccttaagggatccacgtggttttgctgtaaagttctacaccagacagggtaactttgacctcgtgggtaacaaagtgactgtgtttctcctgcgagatgggatgaaattcccagacttgatccacgctttcaagccgatccaaagaccgagttgcatgataactggagaa

SEQ ID NO: 93094 - DNA, 1159 bp, Zea mays
  misc_feature: Ceres CLONE 1582191
  misc_feature: Encodes the peptide sequence at SEQ ID NO. 93095
  misc_feature (11)..(11): n is a, c, t, g, unknown, or other
  misc_feature (18)..(18): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (724)..(724): n is a, c, t, g, unknown, or other
ttaattttatncaatctntcaatactcaatctaatcatattcttcccctaccgcgagcaaaattttcaaannnaaannnnaaaaactggaactccccgcggtggcggccgctctagaactagtggatcccccgggctgcaggaattcgtctcacccctagaaaaaatttgattgcagttttgcactaggcattgattgcatctctagtgccccgtcctccgtcctccggagcggctatgggcgaagagagggagttcgtgggcgctaggttgaacgccggcctccgtgctgcccgcttctcgtcgccgccgtctgccgacgagtttgcggcagatgtcgagcccaagaacgtccctgcggtctttcgcggcgtggttaaggagtgggcggcctcctcccgttgggatcctctccatggccgcctcaattacctgctggaaaaatgggacccgacttggctgtggaaactatgatgttaaacactggccatgtggttcttacggggaatctcaaaaacccctgaagagggggctgggttttttcccccgggaactttgcaaaaattaaaaaaatcccccgcccataatgggaaggggttttgccaaatttgtagggggccccccaaaaggccccccccttttttcccccccccacacccccaaggtgggtccccgttgttttacaaatttctctccccccacaggtttccaaattttatcacagncctctggggggaaaagagagttcttcttttatccccgccgtgtggggggaccccccatatatactaaaaacaagactctccccccaccccctatgtggggatgattatttctctacactccccccaccaaaagaagaaaccccaagggggggaaacaaatactcttttcttggggggggaagagccacacccccccttctttttcttccttcggagggtggagagaaaaatatctattttttttaaacaaaaaaacaaattttttccaaaaaaaaaaaattcttgtgggagaaaaaacaaccacctcttatattttgcgtcccacaccaacggacatctcccctctcctctacaaaaaaagccggcgcgcgacacaacctctacgagggaaggaggggccctcttattaaaaaaaaattttgatgacggggccag

SEQ ID NO: 93095 - protein, 78 aa, Zea mays
  misc_feature: Ceres CLONE 1582191
MGEEREFVGARLNAGLRAARFSSPPSADEFAADVEPKNVPAVFRGVVKEWAASSRWDPLHGRLNYLLEKWDPTWLWKL
